United States Patent 9,487,797 (GENOMIC PLANT SEQUENCES AND USES THEREOF) - sequence listing, part 93

SEQ ID NO: 81837 - DNA, 7465 bp, Oryza sativa
cttcaggatcccgtgtatccctgcagcagcaaggtgagcggcgcgtttcgcaacgatgtcgcagacatccaccacaagccttcttgttttaagggaggtgttttggacctgcaattttgtattgatatgcttcggtgaatcgattggaaaaaagatatgcctgagaaactttgacaaaaggttaaggtgagtacccccaggatatctttcagtttcgctccaactgttctgagatcaggtgatctgtcgcagtgcatcattgacatgtatggagtcctggagatgaaagccttaatctgtttagttaaagataatctttcgggggaggacaatgatgatggggactgcaggcattctttggttcaacttcttcaaagaatggagtgaacaacacaatacccaggctctagattgtaaaaggaatgaaattcatatataaattattaaaatttgaattcgtctaccagcttattcaaagatcaatatacatcactaccactaccactgctctgtataggatgccatggttacggttttgtgtggctaccttttacaaggtaaacacaggctacacagcaatcaagcaatatgatatttttctcttatgtatgtgcatgttcggctgtgatttttgaagcaacgcatattcatgatggaagattagaagctggcaaatgaacccaaaactaagattacctgataataaatggaatcttgagttttggtggtacttcatcaccaaaaagagaagcttcttcagccatctttaataggactctacgaacaatttctcccaaatacatgccagagatcaacttttcgtaaacctacaaaataatgaatgaaatgcttcgtcctagttggcaatgaaatacgagatggatctttttatgttacctgttcaccaggattcaaactttcagcatctaatgcttgatcaaattcagtcaaaggaagatgggatgacctgaagttcccccattccatatttattacctgtgacagcacaaacgctgatgagaaccctgaaaaccatctaaagcttatggatgaactaaacatgcacaagtgactcatgctaacagtacagacaatgtttctctccttttgcagcgtcatttgtatatcatgtcttagtaacccgaatcacatgaccccagatattataaacagatttcatgatttttcgcaacatatctattatctaatgagtaatgcctcatcaccaataagctaggtagaagcaaaagcactcaccatatctcctgacttcggcaggaggtcatgccatttaggaattgcattggcacgttccacgtatgctgcattagtacctgttcccagtataacagcagcaatgacatcattatcatcatatctcccaccagccaatgtccctatagtatcatttatctgcataagaaaaggagttgtgtttggatttcaggttacaagcatatcttcatacacagggtatttaacaaagttctatcataatttgtcaaatcaaaagaagctcaccaatgctgtgactttcatatcaagcccctggcgttcaagagccttggttaattcagtcacaacatcttcaccaacctgactttacagcaataagcaaataattcttacatcccagaggaatatgtaacaatcatgagcgagaaggttttccagtaaagaattaaatagtttccaatgggaaaaggaaactcttgtctatcctttgtaagagtatattgctacctatatgcatatacttgttaagatcataataataagatctaaccgtttcatcaatcgaaaaacccttagtccaattaataagagtgccagatgcaattgaagtttgctttactgggaaagagaacgtaaagccaagttctctctgcctcccctcagcaagatgaaagtcttcaccctctgaagcaacaaattttgctaaagaagaagcaataaaatcaaatagttcctgaaacaaaaaatatatgacaacagtcatacttagcatttaattgaatacggaatgaatgaaccagataggatacatggagcaattcttacatttgaaccaccagtcatcagatgcggaggaattgaaatctcgtcatgttcttgcttgataactctcccttccttgccacctaattgaacccgtaaaacacggaaatttgtacctccaaggtcaagcgcataaaacacccccttctcttccctgcaaatgcagcctttgacatatcagaagtcaatccaaagtacaactaagagcaatagttcaataatttgatcgagggtgcgcctcggcaataagtttgaactgcctgtggtacacgttagaacaatagaccccttcttttattcagtcttcggacaattactatgacaccctttctgtaatctaaaatatctatagataccagaattatttctgatgtatatgtgaagtgatacagtaattgcaaggttatagtaaccacatcagatgcaacctaaaagtgcatagaagttggctttacaccaacagacttaggagagactcatgatattcaataaggttggtttcttatctaatgccataacagctgaattcacattttgttcatttttatctaaagagaagtaatatatacacaagaaagaaacgtactttcctgagtagtaatcagtagcaaattagcaaagacatatatgacttggtttgtcaagttcacatctttcagaccaaatcaacattactgcgagtttccgacatcaaaattatcaacaagaccatgtccattacacaaaatcagacgcccgccactgcaaccaacctagcagcatcacattaccgtgacatcaatgcgcaaccattcaacgttttgcaggcgctgctagaccgcaacaccgttcaccgcaatcaaattaaaagaaaacattaaccacctaacgtttcaactttgaagcagatctgtgggacttcacactgttccctcgcagcagccattatccaaacgaatcaggcgaagaaaccaactcttcagactacgcctccccatacaacacaatgatacatgcaaatcgcgcgagaagggggcgagccattttacccggaagggagggcgtcgacgtagctgatgatcatcttgagtttgctcccgccctcggaggcgagcccggcgtgcatctcgacggccatcgcgtccgccacctgccgcagccgccccggcggcgccgcgcaccgctcctccagctcccgcagcaccgcgtcggcccggccccaccgcttcgcctcccgcagctgccggcgcaccagcagcgccacgccgaccgccgccgctgccgcgaccgccgccgccgccgccttcctcatcgcggtcgcccagcctctcctcggcgagatggggcccttacgtacatatgtgggcctcagccaccatcccgtaaaggccgcgcggcgctgcagtgccgttccagcccagcccaactaaaagacgtcatgtggctagagttggaaaaggtccactctacatccctcagctgtggattaattttcaacccaaaactacacgaaatgagcccagagagtccccaacttgtaaaaccactacaaatcgagtccttaacagtatagagggcggtttttgactaacattgcgcctacataacttgttgatttggccttctttcacatatgttgcgcttacattatgttctagtctgcaaaaaatgagaaaataattcaaatgaaaacgtggtgtttgaatctcctgaagatgaagataaaaatttaagtgtttcacgtaaaacgaggtggtaataatatgtgattaattgagttttaattattacaaacttgaaaaatggattaatcttatattttagaacaactttcatatagaaattttcgcacgaaacgcactgtttagcagtttgaaaaacataccacgagtatccaaaagttaatccaacctttgttggagaaaaaaacaggccctcaatgggctccacatctcagtgacaatcttcatccccttacctgcctgagttgagcttgagctcaaccatccatgtgggctagtcccctccctccatctgcctcccgttccatgttcctgcccgccgcgggtgcctctccgtctagctctaaatcggctgtgggaaaagaggaagggaaattggtctgaaggggacccccacaactgatatgtaggtcctatcgagtttattattatttttattttttttccttacaatgatatgtaagcactacatgggacaaagataagtcaacacatcacgtatgaggaaaccaccattaaaattgtcgagagacttgatttatactgattttgattctcgaacgatactatatatatttatatatttggttttatggttaaggatacaaatgaaacttgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatttgatgatcaggttgtctcctgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaaacccccgactatgtggttaatcgaacaaaccaaacatatagtcaaggaataaataatccaaccaaccgagtggttttgataattatagtcaaccaagtgacttgatatcaatatatagcatatgcggtgtgaatcctccaaataacatgatccgagtgatataccaattgctttgtaaaatatgatgagtgatatagcaaaatagctataaagaagcttgtatattgtgaataaaaaaatttccacagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagacaatgaccacaatatataatcagcctaagccataatattggtcaataaaaatgcacacttacgtggcgaaaagcaatgatattgtatccaatcaattgcttaaaaacccaaacagcaccttgacttatataaaaaagtcagcgggacagctatataaagcttttgtcacgcccggaaattcaccagtaatttccgaacttatttgtgcataaaatcctcgtccaggaatcagccgaggtacacaaactgacaatttaatatacagattcatcaataactaaagcgaataaatacttacttaagaggcacttagtcctcaacatgaagaaaactgcagcggaaaaataaaatctagcgaagctccggctccactcccacaggcagctcaactggggtataagccaaacgtcttctccttctggatcctttttcttcaactgaggttgattgattattgcaaggtgagcatatatcatattcatcaaccacgacatcaaataagcaagtgcccaagtataccaaaggatggcgtaatattggctcatttgcaaaaacagcatttagcaaaacatttaagagaagtaaaatagtggagtaattaatcaggaattttaatcaacactgaacagcacacccatgctgcacaggcccaaccatcctgaacaaccatacccggctgtacagatctaatctccaaaccaggagctaagcaaattattaccaggtataacatccataactattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcatggctaagcaattatatctaatatctagttgaaccaatatatataaagctcaactagtccaattataataacccaaggtatcaaggaatagaataatcaatgcaaacaggccataacaaaggaataggttcacaccacccagtgacattcgaaaataaatgcacagttgaaataaatagagaatttaaatataggatcaatatgctcaaaggattgtgtttaggatctgtgtgacttgccttgcaataatcggtcttcaattaatcttcttgaatacttccggcgcactcgcgaacctttgcaacgacggaaacgacaagctatcacgcaaaacgaggaaaaagactaataaaaaccaaataaacaatacataaaaagtaaacaaacatgtagatcataattttagatgaattatgagacttgaacggcctcattctgacttcaaatgaatttattataaattttacaagattaaatctaattaaagcccatttaaaaagaattaaataaatttattcaatttatggacaattttaatatgtagatctttattttacacaacttttgcaacttgaaccacattaaactgagctaagatgaattagatatgaatttttaaagattaaatcggattaaaacctttatatggattttaattgaattatgacgcaataatgaattatttttgaaaaggaaaagaaggattattgcgtcagcggctaggg

SEQ ID NO: 81838 - DNA, 10434 bp, Oryza sativa
gcttcagcgtcggcctaatcaagaatcaatactgcgaaaataaaagatgtagccatattaagcgtcgaaccgggaaaaatagcgaaacaaagaagcgcatagcgaaagcggagtctcaccgttcgtcccctcaggaggaaccagcttcagcaaaccgtcgacctcttcgtcttggtcaaccgcgacttgccacgaccgggagaggggaaaaaagcgaagcatgcagaactcctccaccaagtcgcggcagctgaggcgggagcagaccttgcgcagcaaggcgaaccgtgcctccatggcgccgtccacggtgatcttgggtttccggttcggcgcaatcgccctgcgccgacaccggagggccttcgccgactcggacctagcctcgaaggggatggtgtgatagaaccacctcgccatccagtggtgatcctacttccacatggcggcattcaccggccaaagatcggagcgctcggggcgaacgttgaagttcatgctcctgaacaccgtcttcttcgttccgaccggggtaaccatcgtcttcgaattcatggtgcaaaaaatatggcaccgaagagttcggtgctaggttcaaacccggaggtccggcacgcccagtcgaagatggcgaaggatctccgacaacaacacgttgcacggaaaccgaagccccgcctcaaaaaagacggcgaacaccaccgtccggttgtcgacgagcttcggtaccacggccttccccggggcgaaagcctgcccctcaaccaacgccccagagctgaccaacttcgccagctcgccgtcatccatgagagaaatccccaaaaaggtggtggtgtcgtcgtcaatccggccgggatcgggccctttcgccgaagcggggtttggcttgcgaggagccatggtgaagggtgtgtgcagtggcgaacaaaaagaaccgacggaagatctaaggggtcaaggggcaccatgaaaggaaagaacggcggaagaaagcgcgcgcggtgaaaatgacaagtgtggcggtgaaaagggaaaagaggggagaatatatagcccacccaggcaacggttcgcctacccaccagtaataaagcgcaacgtcgcgagggtaggcgaaatggtaaattcccatcgacttagccgcacagtaataagcccatgtagggaaagcccattactgttcctttcggcccggggaaaataaaaagtaactctaccatccgcaagaggcgaaagctacaaaacaataccaaccgaaaagacacaacacactttatttgcaggaataatataggtttcggcaggagcatcggtcgaaagggggcgccacataccataccacatggcttgcacggtctcggccgaagctcctatctcacccttgcccgtgaggggcttgttggcggtatggcatgaggcccttcgaccaaacctgccgaaaccatgcgaccagtgaggattcaagcctgagacgtcaagattagtcagggcgaagcccccatggcgaagactatggaacaaggacggcgaggggcggagaatcgcgcgggtacctcgccaagccaaaggcctcttgggcgaagaatgtgaggcgaagagtgtatgtcgaaggaagacgacttcgccatagcaagttcggcctcacgaaggccgatgaggccatcctagcatatcaagcctagcggccattgggccaacaatcgcctgacggcccattaagagcccatgtacctcaattacacagtatacccatgtaaatgtccctttcataagggcaaccatgtaaattcccctgtataacctaaaccctagtagtaagaacctgtaatgaggctataaatagtctcatagggccatgtaatggggggatcccaagaaaaattctcaattcaatacactttactttctttccaaccactgttgagtaaccacgtcttccgacgtaggcagttgtcatttcgacaacaacttatataggggaggattggattaggaaaggtggagtcgtagtgggagtaggactaggagggaggggagggagaccgactcgggcaaggggagggggaggcgcgcgcgggaaggagagggggagggcgcggctggctagggagacggggaggaaaaaggaaacaagggggctaggactttcccaaaaagaaaaaaaacaatgcggtgccgttttaggaaaggaatgaaaacggtcccgtgaactgacactgatacggttcgtcatgcaaaacgaaactgcggactgagaggggagagaattaggcacaattcacaaccaaaggcaaaggaagaaaaaatctaacttgacacttttaacttagcaacattgcctctggtgatctaatatttactctttaagtcctgttagtgattttcagagcaaagagaatttggaaaaaaagtttctacctgacaattccgattattaaatgcatggttaacaggggttttctcctggttaaccaaagcaaattcttgaagtcataaaactccgggtgtgacactgtactaccatttaaaagtttactcaatatttgctgctgacaatatgtttgatttaatttatattagctgctgccatgattgtaaatgctgctaagcatttgttgctggccagctaagggcctgattagatcccttggtaaaattttttaccctgtcacatcgaacgtttgaacatatgtattaagtattaaataaaaacaaaaaaataactaattacacagcttgtatgtaaaattgcgagacaaattttctaagcctaattagtccatgatttgacaatgtggtgctaacatttgctaatgacggattaattaggcttaataaatttgtatcatagcttatagccaaaatctataatttgttgtgttattagtctatgtttaatacttcaaattagtatccgtatattcgatgtgacgcgtcaaaacttttcacccctgcatctaaaaacagcctaactctatggtgctaggcaaaagaaaataatcacgtaggttccggggcaaggaaaatcgaacttgtgatattttccttacaagataattttaccaaacaacattgtaccacaaatttttatacctcgagatactttttagtataaatttgatatctctaatataaaatttagtgccccaatatatttagtatctggaggtaaaaagaatttttgtgtgcaaaatatggtgttgatggtaaaacacgcgactgtgtactactgtaccagctcgcttttttgccatatacacacaagttgcatataagtatacaattacaatctattatattattaagacagctcgaaaagaaggcaccacgttcactgtgggggctagaaattcccacattaatcgaagaaaaagaaaaaaaataaaaaggagagttcaagtagaagtacaatttaaaaatagctgaaattcggaattaaaaataagcaatattgaaagaagtttctatataagaacccaatacgagattaatcaaaattcgaaataaaaataaaatctattatattattaagacagctcgaaaggaaccacgttcgctgtgggggctagaaattcccacattaatcagagaaaaagaaaaaaaaagaaaaaggagagtccaagtagaagtacaatttaaaaatagctgaaattcggaattaaaaataagcaatattgaaagaagttttgtcacgcccagaaattcactagtaatttccgaacttatttgtgcataaaatcctcgtctaggaatcagccgaggtacacaaactgacaatttaatatacaaatccatcataataataacgtttcacacttacaaaagaaaagaaaacagcagcggaataacggtctagcgatggcttcagctccactcccacaggcagctcaactggagtataagccaaacgtcttctccttctggatcttttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggttgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaaccatgctgtacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatttcttgaatacttccagcgcactcacgaaccttcgcaacgacgaaaacgacaagctaacacgcaaaacaaagaaaaagactaataaaaaccaaataaatagtacatataaagtaaacaaacatgtagatcataattttagatgaattatgagacttgaacggcctcattctgacttcatatgaattaaatatgaattttacaagatttaatctaattaaagcccatttaaaaagaattaaataaatttaattctatttatggataattttaatatgtagatctttattttatacaactttagagacttgaaccaactaaacccgagctaagatgaattagttatgaatttttaaagattaaatcggattaaaacacttatatggattttaattgaattatgacgcaataaagaattatttttgaaaaggaaaagaggattattgcgtcagcggctagggtttgcggtggaccgggtgcacagcggcggtctacggaacggacggccgagatctaccctatccaaaacgaacggccgagatcgatcggtccacggccggaccacgagagacgacgacgatgacgtcagcgacgacgtcaccaccagcggcggctcgggcgcgcatgctcgccggcgaacgacggcgcggcggcgcgaacggagagcacccacaggtagcggacggcacggctacctcaccggtgaccaaaacggcggtggaagatcaacggacggcgacggcgtcgaggaagaagcggcggcgaccttcggcttgacgacgacggcggtgttccggcggtcgacagcgacggcggaggggcggacgaggacggcgacgcgacggcgaccacgatggcggccttcccgagcgacggcgacgactggagcgacggcggcgcacggctggagcggcggtgacgacggcggcgcgaggtctcacggggctagggcgctaccgacggcgagaggcgaaggcaagagtggcgacgggtagcggcgggcttgggggtccttttataggggcaaggaggcggcggcgaaggcccacggcgactggcgacgagaaggaaagattagggttcggaggagagagatcgatccgaatcgaactcgaatccacggatttccaaacgaaattagccgacgattccataagagaaaagatagagtggatcgcgaggatcatttcccctctatcgattcggccggagatggaaaggagcgacggaatttggaaggagacggcggcggcacggcgctacgtttcgggcggcgggcggccggaggttgacgacgaccctgacaggtggggcccacctgtcagcgggagagagaggagagcggcggctcggttccggcccggcttgggccgaggagagagagaaaaagagagaggttttgggccgactttcggcccaaagccaaaagagacttttaaaaacctttttcaatttaaattattcatgaaatgcaattccatttattaaaaatactttcttggctcaaataaatcccggaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactaaactgttctttgtatcatttaggaattgagctccgaaaaatccgagaaaatttcagagagtatacttaatcatggagaatttaataaaaattagatccatccatgctttaaatttaggaaattttatttcccacatttaacttcacttgtaaattaatgaacatttaatataaattctaataataatttattaaataatttataaatcctgaaacaaaaatcaggatgtgacaagtttccacataagaacccaatacgagaataatcaaaattcaaaataaaaataaaataaaatccaaaattagaaaaggaaaggagagtgcaagtagaaatacaatttaaaaatagctgaaatttgtaattaaaaataaggaatattgaaataagtttccatataagaacccaatacgagattaataaaaaactgaaataaaaataaaataaaatccaaaattataaaagtaaatgagagttcaagtaggaatacaatttaaaaatagctaaaattcggaattaaaaataaggaatattaaaagaagagtccatataagaaccaaatacgagattaattaaaattcagaataaaaataaataaatccgaaattagcaaaagaaaataaaataagagttcaagtaggaatacaatttaaaattagctgaaatttggaattaaaaataagcaatattaaaagaagaatccatataagaacccaatacgagattaattaaaatttagaataaaaataaaataatatctaaaattagaaaaattaaaagagagttcaagtaggaatacaattttgaaacaactgaaattgaaaaaaaaaataaaaacattaaaataacacaatacgatattaactaaatttttttaaaaaaattttgaaattagaaaaagaaaattaagatttcaattaggaataaaatttagaaataactaaaatttgtgataaaaataaagattattgaaagaaaagaccatctaaaacacatgatgagataaattaagtaacatgcctataaaggagtagagtggtggtggttgatacgagatataaaaattgttaataaaacaccaaatagaatcctactgatgattaaaaggagggacttcaggcaggccatgaagcaaacgtgtaaggcggttgtcgggacttctagaaagtaaaaaaaaacaaaccccaatgataataatatttaattttaaaaatctcaatgacaataaaaaggagaagcagtgggcggggtgtataagagtatagttgcagagccgccgacggttgatgggacttctagaaaataaaaaatgaattcctacgatagttatgttcgatggttagaatcacaatgacaataaagagttggcggcggacgggctgtagaggggcatagtggcatcgacgggatttctagaaaataaaaaatgaattccaacgatagttatgtttgatttttagaatcacaatgacaataaagagttggcggcggacaggctgtagaggggcatagtggcatcgtttgatgggacttctaaaaattataaaaaattaaactgcaagtccaatttttaaaggtttggaacttctaaaaagtaaaaaaaacaaatgataatcatatttgattttaaaatctcaatgacaataaagaagggaggcagcgggcgagctgtaaaggagtacaatggcaaagccactgacggtttggcgggacttctagaaagtaaaaatgaacccaaacgataattatgttcgatttttaaaatctcaatgacaacaaagagaagagacatctagaaattacaatggcaacgtttaacgggacatctagaaattataaaaataaaatccaacgtgacaataaactctaaaaattataaaatccaatttttaaagattccgagaagaatgaatagaaatagtggtagattgagcaagcaaataaagaaggagataacataaggggtagcaactggtgtgacttttgaaaactatataattagaaacacgaggatgataaggtttggtcttagcaactggtgtgacttttgaaaactatataattagaaacacgagtatgataaggtttggtcttttaaaatcttaagacgatgagatagctagatagctatttaataaattttaagtaaaatcatactaaaaaatatatgattttgtttgggtgctagccgcgcaattgcacgcgccacccaactagttacaatacaaataagctccaattaaatgttgcacagatactcctttatttttctgtaaacattaaatcagacgggccaacaatgtcagaggaaagggagtggagtaggaatcttggtgatcataatttcacaggctcttatttctctctttccttgactctctctcccggtctcctctctctcccccacacggcttcaccggcgacgcgagctcggctccggcgactcgagcttgactctggcggcagtggcgggcggcgtggccttgcgatttggcggcgggtgcaggctggtttgatcgtcggcgtcagcgcgggctcgatttcaactgtgcaagctcgagatcgccggtgtagtgggctccacatcggccgcgcgcgggcgcgagcttggacttcggcggcactgctaacgtacagttcctaactcctaagatcaatttgttgctctctctttagtatgcctggtcaatttttcattttccatgaattttggggtaattcattttttttaaaaaaaaaagagaaaatttgggtaactagggtgagttcaaatataaaaaacatgatatgttgacctcttattctaattcacaatgtaagttaactttccgttattgattccagagtttcatactaattgttgcaacagtagtgctgctgccattgaattagtttggtctaaaactaaatgtagttgctccttttgcaattccattcacaggggttaggcaagatactttgaaatatgagtggaatggaagctgctgtagcatctgggctgttgaaggtcgcaggacacaagttagtttcactgataggcagcgagtttgctgccatagcgcgcgtggccgaagacctatctgagctccatggtatacatggtgaaattactagctggctgtccacagttcgtgatggatcaatagagtgtgatccacagttccgttgggtgattaaattgaaggatgttgcttatgatattgatgatctactccatgaagtccaactagaatatgagaaacacaagatacacagcaatggtgacaagcatgctatatttgacacgttacgtgaaaaaccaaagtgatttatgttccgtcgcaagatggcccgtaagatcaaggatatcaaggtgaaatataatgagattgtgcgacaaagaagggatgccaatactatacgcagtagtttacaagtggatcaacctattcctagcagtaacatgataatcggggagttgtccttgttgagtaatgttgaagaatcaaaaatacctatcagggaccaggagatggatacaattgtatctatgcttgtagactctaatgagggagagaattgttggatagtttccgttgttgggctaggcgggtccggca

SEQ ID NO: 81839 - DNA, 16445 bp, Oryza sativa
  unsure (1)..(16445): unsure at all n locations
aatcggagttgtgagcgtatcagtttgtcgctgaaattgctcttttgctctggatttgtcaagccctaacaaaaaaaaactaacccttatgtcttttttgtgtgatggaactctcaagccgtaagaagcatgttggttatctagcttacaccacgcttaattagttaaagtttgaactaactgagatccatagggaaaaataatcagaactattattagtgcttgaaaatttgttgtgtgtttaattttttagaagcattatgtgcttttttactttcggtttacaatgcataggtaaaataacataaagaaataactaccatatgtggttctatgccatttatataacaagccacctaaatggcatataacaagccacctaaatgagactgaatataggttttcttctctacatgttcatgctagactaatggatttggtatgcaaggaacaaggtaaacctctatatgtcctcagggacattacactattgttttctttttttgcaggcttttcatggagctcttgatattagattttgcatggcaatttatcctatgttttgattgctagaatcttagtttgagttgaaccgctaaaataacatgtttggaatgttttatatgagtaagattttcaaattttgatacctttgatttggttctcttttcctcagagacctctaggagttcttatattggcatgcttttatctgattgcatacaatattttctctaacaaaatgttgtaaagactgtttttctcttggaggttggagctgctatattacatattttatagtgccacattccatccaaggttttcaaatttgttaggcacactaatatgctatcagcaattatagcatataaggaccaatttttgcgaagcacgtgatctgttagctacatgaaacaaagtatggtaattttcatatccttaattttctgttagtgtttatgaactccatttccagtggctgggatcttggggtttcaagatggcgatgatactccccatcctcccccggcatgacgactatggtgctctccgtcctccctcactacgaccccaggctagaggaggagcagtaggacactcaccggcgatgaggaaacaatagggcaggtgtcgaaggaagcaacagaacaggcggcgcatggaaaacggtgaagaattgtgtgggcagagaagagcgcaggacacttgttttttttttggcgcaatatctcatccctatggcattccattgtgtaaattttcggattattagatgtagtgcttttcctatggcatcccattgcgcaatatctcattcctatggtctcccattgtgtaaactcttttccacaaatgagttttttttttctagaagttgtatttttcaatgtctccagttcactatagttgtttagctgtgggcgtggtgccatgctacgccctatgttctagtgtttacaatcgctagcttatataccttatatacccaaatgtgcacatgttgtgggctagttgttactaatatcctgatgatcgatgtagcctaacaatataggcaaaatgtactgtatagaaaacacaaacaaacccatacttgaaagatatgatagaaatcctcaatcctgatatagatacaacatatatatgccttgtacgaacacacattatgaatccattgtatcaacacaaacgtatggagtctccctctaattaaggtacactaccaagttttcatcatcacatccttctatataacacaagaatcaattcaatttcaacatgatggtgatagacggatgttgatatgcttggtgtcgtcgctatgggccagcgagaaggttccctcggcagtgaggttgagataggtgaccgagagcttgtattctcccaagaaggcagaaaagttgaaggagccgcggtcattggtggttcccagggtctccttggtttgccactcccccagcagcttgtccaccacatctcccgcaggaaggttggtgaagttctggttggtcaggcacatctggtagcagctagcattggtgtccattgccgtccacagcattatgccatccacggatggatgggcaaacccttctcggagcacctcttccaagtatgcagcctgcaacatcatatcatcgtatagtacattaacaatgagatatataggttatatactacctccttctcatgtagctacctagtattggatttgacactatctacacatgtccagattagtagttttaggtagtgttaaatccggtactagatagctacgttttgagatagagaaagtatttcttatggtctgtcactcgagttttacatctagtagatatatatttgtgagtatgtaactacgtacctgcgttttggggtcgaaggagctactgatgtcgatctcggtaagccaaatggggagacgcagggtgccgagcttatcgagcacggcgcggacgtaggggatgttgggcttgccgaagtgtccctcaaggccgatgccttcgaaggtgacgccgccatcggcgagttggcggaggcgggagacgtaggagtcggcactggagctgaggtcatcgcagacctcgacgacgttgaagtcgttgaggaagagcgtggctagcgggtcggcgcgcttggctgtgtcgaagaagtcgacggtggcgttgccgccaaggcggttctcatagaagtcgaagtgcagcatctcgttgctgacgtcccaatgcacaaagtcgcccttgtaccgagagaggaggctctcgatgcggccagagacggcagcacgtagctgtgaccccgtcagattcttcacccatgctggcgtgtactttgggtcctcccagaagatattatgcccgcgcgccactgcgtcgttggcctgcacaaactgcaacagctggtccgccaccgtatagtcctccttccccgggtatggctccgttgcataccacttgagctcgttctcgaacaccgccgcattgaacctcttgttgaaccattcctacaaattcattaattaagtacattattattactaaattgtcatatattatatatcttaacaccaaaacaactaaataacatttaatgtctatcgctaccgattggatatagcgagctgtaacctagcagccgctatatgagctgagttagcgatccgtggtagcagtcactgtatgatataacaactaaaggcgtcgatggtgccaactccgacgcttgctccacgaattacgaatcaacacattataaactctttaatctatgttatgtatcgaaatatcactaatttatttctcagtttctttgttaatgtattataaaatcattattaatgatacacatactcaaatttatgtgtgattattaaatttcgttattggaacttagcttcagttatccgtggttcgctacatagacacctgcaatccgctacgaacctactgtccactatttgttttgttgcttaacacacggtttaatttcataaatcaatgctaaagttcgtcatatatctcagaaaaaaattaaggaaagaatcatgaaaacaataacctgataaagtttgttcccaaggattgtcctgctgatggcagagccgaatgggaaatccctggtgatctgatgcaccgcgaccttggcaccaaccacgcgactcccgttgctgtccgccacgtggacattgacaaagcgcttccggttctgttcgtgaaaaagaattacatgctggcatcatcatttgctccacacttcctcacaattaagttggattttttttaaattatccatcgtgtgacagtttttttataatggattaaaccggtctctatacccaaaagagttacacagcctaagagtcgacgaaacagtataagtacattttattaccagctgaatacggtcctccctgtgctgattccattgttcaggtgaaaatggttgcaaagaggcacttctgatcgagatcgttgaagcatttgggcttgcagtctgcagtgaataaattgcaaactgcatgacgattaattaattcaccaagtcaagatctaaactaggttcagctaaatttgtatgccaatatattactgtgctctctgtgacttaaccgtgaggaattaaattaagtatatcacctggaaatagaggacggaggtttctgaagcggagttgagggtgaaaccacccttgaggaaggaccaacagtcgtttcgcaccagagccgtgccaaggcattgagatgcagcgtttgctagcgtcaatatcttggctttcacatgagcagttgttggcccatcgattttcacccagcgtagagaaaatcaagcaagcaattccacaaggttaattttactcccaggaaatgacaaaattaagccagtagaattgcaggtccatcagaaatctgaataccaataacaaaatcaaattaaatgaaaagggaaacaattatctatttcacttgaatatttgctagtccaataatttttaattcacctaaaaaataacgattgcttgaagaaaactttcaagaaaatgctcaacagaccagtaccaaatagtaaagtcataaaatcagtaccatgccaaaaaagcaggggagcatgcatgaaaatgtgcgtgccaaacagtagaaaacagggcaggaaaattcgcatcgctggttcaatatggcagcatatatatgcacgatacgatgtttgggactccccgttttctttcgtttgtacgcgggcaatctgcacgaatctttggccgccccgcgcccaacatatgcatatgcgcatgcgcggccagggttgagacttgagagaggacgatgcgatgccggcgagatccggctatatgcgtgcggcgtgcccatctcatcatcattctccctagtttcctccgtgtgtcttgtagctcttcttggcttgttctcttctatggtgggggcctgctcacgctcacgtggtttctttttgctcatttctggctgggatacattgggtcagggacccctactgcagccacagtccttttggttccaaatgttagggtgtgtttgattgggtggatgtgactggatgggagatggctgtccgattatatgagttgtttgattggagggcagggtggatgggatggtaaaaaaaagtaaatattctctcaatatttttaaattatttttcgtttttgctagaattgtggcgtacgcctaggggtcttaggttagctccacaagctaggtggtgtactagacgacctggattcgaaacatcatcaattctaattatttgatattaggtaattcccaatattttgctcttttttgataaacgcctagggaatttccgaatagctccacaaggtggttggctaaacgacttggattcgaagtctcaccccttctaattatttgatatttggtcattccctaatattcgcgcacatcggttggattacaatccatggctgtttgcatatgtcaccaagtgacttgacactttttcctgagccattaaaaacaatcagcccacttaggatcagttatattttgccaaagctaatcaactggaacctactcctccattttaaaagagtgtagttttagtcgaagaatttgtctataggatgttatatatcatagctatatacgctactacagaatcccattaagttctagcttgctcctttatatttaacctatctagatgtgggggaaatatccggtgaaaaccatcaaataagtaaaaacccgtgaaaaccatatctaaaatttttataaatttatgaaaaaaaaatactagagataggtatatgcataaaatacatagctttttttttcttccaaatggagttgattttggactcgagatttggtataaatgtatttcatgcatatacctatctctagtaattttttcataaatttacaaaacttttagatatggttttcacgggtttttacttattcgatggttttcgccggatacgtccccctagatgtgaacgtgtatgtatttgttttcttcatttttatatattttttacgttttcaaaagaaatttagagaggtcaaatatttatcatggaactcgtcgtctctgacatgtattaggggattccatttaggctagcctgcaagctaatgcatagttcgataacaatgcaagcatgcatgctttatccatttttttcttttacgcgtacaatatgatcgaacgagtggccggggaaattttagccttttctacagttaaattagcaattactagcttttatactttagaattaaatggcggtctctgagagagctagtacaaacaaacaaaaagaaaaggataacggctggaaacataccatgcttagagcaggtataatagggtacagtcagtagacggtagaactgttcatctaaaagtaaatcctacatggaagagtgagaaaacatcagaaagagagtagccggcccttaatctatcgccaggctagccattaaaaaaacagcacgaccaatcggtcatccatgcatgcttcagctgcaagatttttccactaattacacgcttcccaatggcctcaatgagagagaatagagattgtaagagaataatttttgctgagctggactttttatagcccgctgctagctatatactattatgttttgtgttggtgggggacgggacgtaacaattagtaataaatattttctataaaaaaatattacattacatgatgggtgcatcagacataaagagcattgtgtgcgcaaatgaatgcctaaggcaccaaaaatattttggagcatgcacatgtgaatattcagtgaacttgtcctcattcgtgtcatattacgtagagaatctattctatgtaaatgaatttactatagttaaatgacttaccattgactttggctctctttaatatgccactaactttactatttttttctacaatatatcattaggatggagtacttttaaaaatacctaaaatacaattcgagttacacaaggggttaacaaattgattgaccccactacaagtttcgaaaaaatataattttttcatgtagcctccttccaaaatatagaagtgtatgtatatttcaagattttgaatttacatgtattaactgttttgagaatataaatatattttatatgctaatagaatactctttttattgatgttcttttatgtaaattatctttcatatgatataaaatattttttatccggataccttttgtgtatgtgattccgctttcataggctatataaaagtagttttccaaacaaaaaaaaggaaatcacaaaatatacacaaaaacttctatattatataaaagacaacacaaaaacttttatattttttcgaaacttctagtggatcaatcagttataacctcttaggacttgaagggtattttagacttttttgaaaaatatccattcaatcacacagtagaaaaagttgacaaagttagtagcatattatagagagagaaaaacgttaatggcaagtcatagtaaactcgatggtatataataattctctccatattataacataagtgttgcatgcatgcacaacgctagccatatcaaaaagccaacaaccctcaaaattattagaacaagtttttgtcgagttactaatgcttgaagtttgacaaatatcttcttttttgagtcccatagttattttttggaaaaattggttatatagcatcgaaagttcatgtttttggttttatagcaccgaaagataccgattcactttaatagcacccaaagttcaccatgttcccatttttagcacttccatcaattctcgatcgttttccgtccgtcgtgatccagccacacacacgatatgacgtttctacccctcacaacgtttctacccctcacaagtacaagtagaatgcatgtcaatgaggggtagaaacgtcatatcgtgtgcgtagctgggtcaataacgatcaagacggacggaaaaattganggaagtgntaaaaatgggaacagggtaaannnngggngntgnnaaagtgannngganntnnnnggngnnatnnnnccnnnnnngnngncnnncgatgctatataaccaattttgccttttttatcattttattttagggtgttgatacctctttcatacagagtttatgcttcacaacctcctataatatggttcaggcaattgttcgccaagataccctttgccgtcattcacttcaacataaaattactacgtactcattcaattcaattcgttatctctagaatttgttttcaagataatccatttggtaattaatatttaatgtttaagactatcaattgttgtactgaaataaaattataaataaatctaataaatttgtgatagtatttttcaaggtaaatatatgtatagctttttaactaagcattttagaaactactagtcaaatttaaagggtttgatcatatctttttttctaaacatcaaatacttcctactagagggagtacaagataagcaagaaattctgcatttgtggatagcaccaacacactgcaaagttgcaccagctccatgtaaaattttcagatcaactagtcaaatactcattctttgaaaaaaaaagagagaagaaaatcagtttcactagttttgaaaacacgagcacaaattagaagacagaggaacaaaaacagaagtgacgaacaaaaaatgaagtgtgatatatatactcacaggagaagctgtatactgttgccgcggacatattatacagcacaaatgccggcgaatagttgccatcgtcctctgttctgaagtccgtcactttgttcgcccagcgcaggatgccaccgttgtacagtgcaggttcaggatgcgatttgcactgaaaaagaaggcgggggttcagagctcagacgcatacaggcccatagttttgtttatgcttatacttataagctaaaataaattttcgtcatataacatttgatttttaatcgtgaagttcgtttataaaaattttacacataattcttttttttacaaatgtgtaagtataagtataggcgaaacgacgaggctggtaaatcgatcagcataggagatgaggtagagaggaagagatctagacgatgcgttgcgtacctcagtgtaagctctgtaatcatagcgcactccatctgcaaaacagcaaatttgttttccttttctgtcaggcgaaatccataaagtcgggtgccaaaatgagcaggattaattcctcccatggatcgattggttaactcaccggaggatgcagcagggcgagctagcaagacgatgagcagcagcagcagcaagagcaaagccttccgatctgcagggagaagaggcgatgatgatgacgacagtgcagcagcctccttgtgcttcttgccaatcgccatagttcccgtcgtgagtgagggtaacacgagcacacagagactagctctctctgttgtctctcgtgatttcttcttggatcgacgtgttgatgtgtgctcacacggtatttataggaagccaagcaactgtacagctagctctagctagtgtctagataagttgaaaagaaacgcaaattttactacaagatattatggttttagttctgaacacgataaaagttaacttttttttcagaaaacagttttaaagtttgtgaaaatttgctactttacattgcacacattaaaatatttatttctagttagataggagagaaaaatgatgtgagaggttaaaaatacccattgcttccacatctcagctctcttattcctcttttcgataagtttgaactttcatattttgactaccaataatttgttaatgcttacttttactatggtaaccctattaaattttataaacttattgtaattgaagttaaagttctacagttttgaccgaacgagcagggcactaagtttaaaatatttttaaaatgactatattttgtagcttatttcacatggcatcaaaagttcaaaacccatataatcccactgataaacgataacccataaataacatgtagccatgtaggtttgtaacgtgtcagccctacatatgttggagcgcgctatcaagctgcatgtagctgcactaaaacttgtgcattttgtaagaggtaaagcagaggagcaactatttttttttctccaagcatgaattttagattgaaccctcttttcttaccaaaagtttacgttaaacccctgaaacacatatttttgctttgacaactttgtatttgaatcttttttttcaataccattcttatctttgggtagacgcaggcagagacgccgagggtgtcaacgcagacacgcagtggtgaaaagatcttagtggggtacactgaggcctagttgccgttccggcttaactgatcgcgtgaaaaaatccgctaatgattaattaagtactccatctatctcttaatataagagattttaacattttacttgtaatatttgaccattcgtcttattaaaaaactttaaaattattatttattttttattgacttacgttattatccaaagtactttaagcacaacttttcgttttttatgtttgcacaaattttttgaataagacgagtggtcaaaaagtgtaagcaaaatgtcaaaatttcttatattatgggacggagggagtattaggtattataaatttttaaaataaatttatttagctttaaaaataatttcatatataaagtatttcacgaaatatgctgaaatgcacctaagactaaattagtttgatgacaacagtaaaaagatgctataaagtaaaaagaaaaaggaaaacgaaaaaaggaggtccagagtgcaagggtaaaactttggcaaagaacaggtgtcaaactgaaattcactctgaaagctaatgagcatttgactttcttaaaagttttatacagcatcacttactactaggtactatactcctacgtgtcatttttacaaagtactatgtggtcatacatcacgttagccttgacagcattaattcttggcagtttatggacgtggaagcagctgcgctgaatggggcctgcagcatgctagctagccttgctagcttccggctggatagaacgcaatatgcagataatggtgaaagaaagggagtttggaacgtgaagactaacaacatgtgggcgtgaggcaacaacgagagacaggtagggagaagtatactgactagtgcacatgcatgatcatatatcacagttcacatacgactcgcaagtgcatgtatacccaactttcggtgtgacatatattgcgcgtgcagttgtcacgcgtacattgaaattaaactagatgggttctgttggtatgcaccaatttcagctcatatactccctccgttccaaaatgtttgacgccgttgacttttttaaaaatgtttaaccgttcgtcttattcaaaaaatttaagtaattattaattcttttcctatcatttgatttattattaaatatatttttatgtatacatatagttttacacatttcacaaaagtttttaaataagacgaatggtcaaacatgtttaaaaaagtcaacggcgtcaaacatttagagaaggagtaagtactaaatatggtttattaaattataaactaatatattacctcaaatatgatatgtaaaaaaaatacgtaaggattcaggatgtatttgtgtccgtccctcctcacgtcggcccaggtggcgcgactcatccccctctccgcgtgcgcctctacctccacctttgtctccctcccctgatcttccctccctcccggcggcctccatctctccctcgcgatcccaaaaaattatttgatccggcctacctgcacgcgcccccttccccccacggcctctctcctctccctcacagcccctctcctctctctggcgcccctcctccctgtcgctcctttctcccagcgcccctcttctcccttgtgttccctccctcgttcaacgagaccggaacccactcgtctaggaatgagttttgatgcactcacccggctgcgatcaccaccagagctcctcgttgccatttatctctctctcgggaccacatagtcgttgttcccgctattatagttttcttcattgccaactgccaccatctatggacgagtcacattgtgcgacacgtccggccatcttactcactattgtttggttgcaggaggaccggcgcccatcttccctcctcttctctttcttgttttgactaggaagacgatgaatagtgttagtaatttttatctccatctttcgttcttccagcgtgttcaaggaaaattgaaccccttcatctggaacgtattttgatgcactcatctggtcgtgttcaccaccaaagctcgctgttgccgtttctctctctattggtaccacatcattctaaccgtattcatgttgttctgattttcttcgttgccaacctccaccatctgtggatgaagacacaattccttcctggtttagcctgaacatgctcctggatcactcacataatattaagaccataggaactatgaatagagcatgaaaattctaatatgtcaatgaaacgggtactcgttcagaattaatggatcggattttcatttatgggctaaaatatttttttttaatttctagctaatttcagtagtttttccatttacattattaattttagcactatttgatccattcaaaattgttgtaacttataatattgaattatttatagctaaatgaaaaaaagaggatttagttatataattttcattaaatatattaaattatcgttccggccaaagttatttttagtttcatgctgttatttatatgattatatttccttcaatccaatcgtgatatgcggtttaggattttaatttaatcatatttcttcagtttaattgtgatatatggtttagaattttaatttatgtcaatgaatgttatttagaatccgttgcaatgcacgggcatcatgctagtaataataataagaaagaatgttaatgcgaaagcggatggtggaatggggcgcagtgcatactaaggtaggagaagctaaaatgcggatagttgaaagagtaggtaatgaggtaaattatgttataccaaaggtttgggtccattttgtcttttcctcgatgaccctcatttccacaatcatatctatatgatgtaaatttgctatcagattcttttttgtctgtgtacctttttcctgacttcaaagcccttttgacctccatggctatgccaaaacatctaagcctcatctgcgacttttgaattccattccaacatgaggtcccaaacatggcagtggcatatcttcatacataaaaacagtagcaagtatggcactagtgtatacgcatgatgataaaaaaactgaatacacaagcatggagttctattacaaacctatatccttccatcttacgagtatgatggcctagacttgattagcatctgcaatcaaatgtttttttttccatgggaaagggatcgaaaagcttgatcaaaggcaacctaatatgaggaattgaggagtttgatcaattctaagaagccattcatagggatatggtagaagagaggtagatagttaacactaatgatcaaagtgaacaaaagctcttattgtttgccgaccctcagaacaacagctgacaaggattttttttcccctccatctgacagggatggcaccctttttccctccagatgaccgggcggtgaatgggcgcgcggcggccagggcgagcacgaggttgttcatgggctgattttccttgcatgggccgagtgcgagatcgctcgcctgagttgctcactggttcgtgcaacgcaaaagggatgaagcagctacgatcatgcgatgcagatcgagcagtccagcgatgtgcgacatccctctgacatcagttggccaaagtcagacggccgagttccgtactatgggaccttagtgttaacggtttccctctgtatcatattatattataagtcacttgacttaattaaacttttttatgtttggtcaagtttgtaaaaaatatatactaacgctttcaatataaaacaaatatattgtcaaaatatattcaatgttagatttaatgaaactaattttatattatatatgttattatttttttctataaatttggtcaaatctaaataactttaactaagaaaaaagtcaaatgacttgtaatgtgacatagaaggagtactagttaagaaacacatataaacatcacgaaggatataatttaaaaacattaatttggtagcaaatgcagaatcagcagaaacaacatttagtcccaactcccacgagccgcacaaactgaaagaagatcattcgatgagaaggaaataaatagagaaaataagcaagatgtcatggagtgaagaaaaataaattaattgaaatcacagaaattgcaagggaaacgaagaaggatgatttttttttaccatccacttgccctcctcgggtggaggttgtggctaagggagggggctgggatcggcagcggcagtgggggcataaggtcgttggctgcctgacgatgaggtacggcggagtcagggtcagtggtgtcagctaaacacaggacacgtggcagatacatagggatcatcagtgatctatattcctcatttgcgtgacgcgcgcagagtggttgattcaacgatgaggtcctggcaatgatggatcgaggcggaggggctgattcagtgatgggtcccgactgatggatcaacgtggaggggctcgaggcaactacacgatggtgatctaggttgatgcatcagtagcacctgaaacaacggcgacgtggcgcgcttgacgacatcaacgatgatagattgatggtgccactgtttgaagcggagtgaactgaggtggcagcacccacgatgagtgtatggagtgctagggagaccaagatagggaattgggggagatggaggcggaagtgcaggattaagggtgtgggaggtgggagcgatctaggatgttggatttgagtgacaagatcttgactgtttcatggtggatttgaaaatgtaagaatgaaagataagtataataagttggtgaattatagaggagatagatacataattaatacttggtccacctctctcttttatatagcttgttgaaacctgtgttgtaactagctataaatttatggtccgtttttcttctccattctctaacaaagaataaactaatgtggcaatttttatagcctacttacctcatcctattgtactcagcaaacagaacttagatgagtcatgggagtgctctagtcatgctttgggtcaggattctccgcactgaagaacaaactgcagagttacagtacagtgcattagggtatgatttttgctattggatccacatccaacggttcaaaacaaagtgctacaacagatctaaacactaaaccttaatcagtaattgcataacagtaaaacggatactgttcatgtacttttgctatagtgctactgcacttcactgtagcggtagacacaatgcacttttgacaaagtgtccctatgaattacaggggaggatcaggatccatcagtgttacgtgcccccgcccaaagccacggagacctgccgttgggtatggttacccattccgcacacccatacccacttgaaatggtagggtatggtcatgtcgaggacaacttatgttgcccatcatgaatgtgttgggtatgggtaacccgtaacccctaatagaaacattgtaagggagaggtttgtcttttttatctaacataaggatgatttttccccaaattgaatacccaaattgaaatgtgacatgccgagggagatatgacggagtactaagatggcagcgattgtggggtccaacgtttaataaatagcgtatatcgcgtcggtagtagattgttgcctatgtagcggatcgtggatagtgggtgctaagttccaatagagtattacaaataacgactttataaaacattaacaaagcagctaagaaataaattaatgatataacctacaaggataagtagagatttagtagcactcaaaaagttgatgtattatttcaacctaaactaaattaagaagcatacatgatattctattcattagatgttatgactcacaggaatataatgttttggaagacaaaacaactaacaaactcgtcattaatttgttatgggttagtggttatataaaatatgctcacactatagcggcccgttaaatagaattgcagaaatagtgctgctatattccaatatgttacttctagtccagtggcgaagctatgtatgtgtgtttgggggagggggggg

SEQ ID NO: 81840 - DNA, 1687 bp, Oryza sativa
attcctaattcccttaacccatgaacccatgacagatgcgccttgctctaccttctgtggaattacagtcagatactactactgacttcattatggtctactttgttattttctgactgaaaatacatattgaattattgatttttgcgggcagaccaaagatgaagatggcaaagcagataaagagatggacttcaacgatgagtatggacaggacacaggtgatggtgaaacattcgaaggtggttatgattatcctgattacaactatgatggctatggtgatggagcctacggcgattatgatggtgttgatttttaatacccgatatatcaatgctgggtagaattgttacaattttatttgtgtgtgtatggcaacaattatcaattttacatgaatagttctgattagttgacgaaaacggagttaatcagtactcagtagacagtatagcagtgtagctcgttgatttctctggtgatatgttgagaagctgttgtagtaactgtattatttcattcagcgacctatacttgcaagttgtatattaaaacaggcctcgaagaaaaaggaaaattttgaatgcctcatgaggtatcatggtctacacattcgacaggagtggtgtgcatgtcgtcatttgcgtgaaatgttgacttaagctgtcctgattggcgagcacgtctagttttgagttgcagtgcacagttctttttttctttaatgcagcgttgaatgtttgtttgctgttgttgatgtagtctgatggtgatgaaagtagtgtgcacttcgtcgtttgcgtggctgtgttcctttcttcagctttaaactgtaactttcttgttttctagcacgttttgtaaagtgttttttgcaaataactttttatatagaagtttctttcgatgattagggctattaccttactagtggtctgaaccagtataatctatgtcttctatgtgtttgatgtcgtatcgtgtaaatcatcgaatcaacgtacctcaataccttcataatacggtccgtgggtatccctcatcgataactgttcatcgtcttccttagccgaaggcgagaaacaaaagagggaaagtcttcctcagccgaaggcgagaaacaaaagaggggaaagatgggcacggtgctttgggtttacgacttcacgagttgttgtcgccggcaaaatcttggtgagagagaaggggagagtggtggagaacggtcatgtggagtggggttgacgacatcatgagttgtcgtcgctcggtgcagctagatgaggttggttttgctggattcggcctcttcctcctctctactgcttggatttggtcttatttggtccaccttgtagctcccgacctctcgcgcacaaaccatcagtgaggatgctgccacctcaaccggcccactcgtgttggcagccgggcacctcttccatccataaagtttactgagaaattaaagttccccaccttttccagggcgatgcgtgcgaacgaattcgtaggcggaccacggacgtgaacgcgtgggaaccgtaggcggacgaaaacacaaacgcgctcctgaatcggatgtgtgcagtggccaacggtgcaaaagcgaaaactaacgacaagggcaagcatgagagtcagatgacgtacaaagaaataacgcagtttcctttgcatcacc

SEQ ID NO: 81841 - DNA, 6642 bp, Oryza sativa
ttcggcggagaagcagtccaagttctaggccaagcgcaattgctggtagcttttggcacaggcgaaaacagacgcgaagagcaaatattgttcgacattgtcgacatcccgtacaactacaatgccatcttcggccgtgcgaccttgaacaagttcgaagccatttcccaccacaactatctcaaactcaagatgcctggcccgacaggagtgatcgtggtcaaggggcttcagcctttggctgcttcaaagggcgatctggccataatcaacagagcagtgcataatgttgaggccaaaccacatgaccgggcgaagcacgcgccaaagcccgcccctcacaacaaggtaatcaagatacagattgatgatgccgatcccacaaagcttgtatcgctggggggcgacataggcgaagaagaggttgagaacatcctagaggtgatcaagaaaaacattgatatcttcgcctggggccctgatgagatgggaggtgtttcgacagatctcatcatgcatcacccgacagtcaagccggataccaagccaaggaacagaagctacgcaagatgtcagttgatcaccaagaagcagcaaaagccgaagtccaaaagttgctcaaggctagggtcattcaagagatcgaccaccctgaatggctggcgaatccggtaatggtgcggaaatcaaacggcaaatggcgcatgtgtgttgatttcacagacctaaacaaggcatgtccgaaggatgatttccccttgccacagatcgaccaactcgtggactcgacagctggctgcgaactcatgagctttttggatgcgtactccggctaccaccagatccacatgaacccggccgacatccccaagacagccttcatcacaccattcggcaccttttgccacctcaggatgcctttcggcctgaggaatgccggggcaaccttcaccaggttggtgtacaaggtcctttacaagcagttggggcgaaatgtggaagcttatgtcgacgaaatcgttgtaaaaagccgcaaggctttcgaccatgcgtcctacctgcaggagaccatcgacaacttacgcgcggtgggtatgaaactaaatcctgagaagtgtgtttttggtgttcgcgcgggcaagttgttgggtttccttgtttttgaaaggggtatcgaggagaaccccgagaaaatcgatgccattcagcaaatgaagcccccgtcgagcgtacgcgaagtacaaaagctcgcaggccgaattgcggcactcagtcgattcctctcaaaggcagccgaaagaggtttgcccttcttcaaaaccctccggggcgcggaaaagtttacctggacacccgaatgccaagcagcgttcaacgagctgaagcaatatctgcaaagcccgcccgcttagatcagctctgcggcggagctatctcccttcggcttgcattttgtcgcccgcactgctatcaagtcccaagtgctagctgacttcgtggccgaatggacaccggcattcacccctgagcccgagcccgttgaataaccctgggtgatgtattccgacggttcgtggtcgcacaagggggcgggtgttgcggcagtactcacttcgccggggggtgtgccgattcggtatgccgcaaggctgcagttcaacacaaccaacaacgcggcagaatacgaagccattcttctaggcctaaaaaaggcaaaagcattgggggttcggcgcttgctcatccgaaccgacttcaagttggtagcaagtcatgttgataagtcctttgaggcaaaagaagaaggaattaagaggtatttggaggctgtttggtctatggaaaagtgcttcgccggcataacggtcgaacacttacctagaggccagaacgaggaagcagacgccttggcgaaatctgctgcttgtgtggcccacattcgcctggcatcttttttgaagtcctatacgcaccaagtgtgcccgtagagagcctggatattatggcaatcgaccaggcagaactgggcgaagatccaaaagactggcgaaccccattcgtaaggtagctcagaagcggttggcttccggaggacgaagcagaagcaaagcgcctacagctcagagccgcaaagtacaagatggtctcgggccaactatatcgctctggggtgctccaacctttgcttcgctgcatctcttttgccaaaggtgaggaaatggcgaaggaaatacactaggggctctgtggcgcacaccaggccgcaagaacagtagcctccaaagtatttcgacaaggtgtgtactggcccaccgtgctgaaagtctgtgttgagcaagtcaagaaatgtcaaagctgtcagcgccatggccgaagccaaactgcgccccaatacgagctgaagcctatcgcaccaatttggcctttcgccagatgggggttggacatcattgggctattcccggtggcgcgaaatgggtacaagtttgcaattgtggccatcgaatacttctcctgatggattgaggccgaaccacttggcgcgatcacttcggcagcagtacaaaagtttgtatggaaaaacattatttgtcgtttcggagtgccaaaatagttcatcactgacaacggcaagcaattcgactctgacaagttcagagagatgtgcgaggggctaaacctggaaatcaggttcgcgtcggtcgcgcacccacagtcaaatggggcggccgaacgcacaaatggtaagatcctataagcactaaagaaaaggcttgagggggcagcgaagggtaaatggccggatgaaatgctatctgttctctgggtccttcggacgacccccacaaggccaaccaagttcagcccattcatgcttctctatggcgacgaagcaatgaccccaacagagctaggggctaactcaccaagggtgatgttctctaggggcgaagaggggcgcgagttgtcacttgaactcttggagggggtgagagtcgaagcacttgaacacatgcgcaaatacaccacaggcacttcggcaacttacaacaaaaaagttcgaccgacggagctgttacctggccatctcatcctaagaaagaaagcgaacccagtggcggttggcaagcttgaatcgaagtgggaaggaccgtacctcatcaagcacaagtccaggacgggctcctttcgcctggcgacactggaaggtgaagagttcgaccattcctggaacactgcctctctcaagcgtttctatgtgtagaatgggtggcacccaaatcgccaacttgtaaaaatgtacatattgttatgtaagcctttcggcactatgtaagcccttcggcacaaaaatgcaaaaaaaacaggaaaatgaaaaaagacaaaaaaaaactggatgtgggctattatccatcccggaggcccgaaccagtataaaatctttgtgtcttttgccttcttatttgtatgattgataatttgtggaaaaaccctaaggcaaacgcctgatcagcaaaaatgccagggggcgaaacgaatcggccgaagcaccgttcgccgaacgttgaaaccgcaacagcttgtttcgggaaacaactaaccgaacaccgttacattcgatcaaaatgaaagcacaagtgcttccttgaacgtagaataaaacagatcgaaaacggaagccgaaagctaaaaagtcatagacctatttcgctaatacacgcaaaggggccgacacgttccgacctaacgaaagcacgagaagtgacaatgcaaaaaattgtgaaaaggaaataaagcacatctttcttgacttcgaagaaaatatatatcgaagaatacaaaccctacatcatggtacaagtaaagaaaagcgatggctctacagcccagcttacagataaattacatcttcgcccccacaaccgtccttactctctacggaatggtcggacgaactaggttcgtcatcactaccaatatcatacacaaccctgagaggagaagggggcgaaacacagactagactgtaacgacgctgggaaatcgcctcctgccgatcagacttctgatggtttcgccaaaagcaaaccatatcctccaaacattttgaatgaacactatcgtaatcttccaagctttgcccggggtgcgcccgcatccagccagcaaccttaaaaaccttatagctgtggccgttattatcatttcacgataaacgggccgaaacgggcatcgcacctttggcagacccttcaacgccacaaacttctcgtttttgcttcgccaattcccagaggggggccaaatgcacaattttcagcgaacatcctgataaacagtgcagaaagggcaaaaggcaaatttcatagtaagaatgggcgaaaaagagtaaatattaggtaatgcgaaaatggcgcaagcgcatacgccaaaggcatcgaccataaaaagtgactaagaccgagtcatacattccaaatatccaaaaggccattttcggctacaataagaagggtaaggggccatcagccaaatatacattgttcgcctttcgtggcaaacgcaaaaagaaaaactacaaaaatctaaggaaagggcggagggcctcacacctctaggtgatcctgggcatcgcctccaccccctccgaccgccgcatccttgccttcgccctggtctaccacctctgccttcgctagttgctccaaaaggcgtgccttggcagtggatcggacgtccttctgccagaactgtttccgccatgcgcggagcgcgggcgaaacgtcctgcgcactaacctcccagtcccccttcgcatagttagggaactcggcgacgtgctcacagccgaactgttgcagaacgcccatagtgaaggccgccgatacacgtgcacagcaatcactttacgtagtggcgcagtccgaaaccacaccaccagcctgctgcgtccactccgagaagtcaaaggcagaggcatctttggcggggactcctcgcaccctcgcacccatgtcgaaaagggcaaggcggagcgtttggcacgccgttttcgcggactcggtggctttcgccatctcccacaaaaaccgctgccactcctccgcaacgcttgcctcagccttgctggcctccaggcgaagagcctctatcttcggctcagtaagattgtaatagtcggtcagcgcagcggaatgggctttttccttctccagtttggccttaaggcgatcgacctcagctctagcctttcttcccttctccagttcagcttggagtcgcttgttttccccttcgcctccttgagggtgttggagagggcctccatctccaaactcttgcggcctatctcgtcatccttggcccgaatacggctcctaaatccgtcaagatgggcccgcatggttcgctctgtcgaacagtcagccgcaagaatctggatgtaaggtaaagcggacgaagagagcaaatgttagttatgggatctgtaagaagaaaataaagacaaacaaaaagagagagagcgaacagcatacctgaaccgccaagcttttaatagcagaacacccttcgtcgaactcattcagctcggtgaataggctcggggtgccgacaggtgagacaaggttgcttacccccacgacaaagggaataagttccacccaagtctcgaaatcgccaggggtgaagtggggcgccgcgagagaatactccgaggcagatgtttcgacggccgcccccttccccttcgacttgactagaggcgaaacaaccggctgacgcaaggggcttcagaaaaccctagccgcaaccttcatgacacgatcagtggaggctgaggccccggcggcggcactgccacccgctccgccagcgtcgatcgaaagaacgggggcggtcgaaagatctaagctgcgactagcgggcgaagttggggtttcgtcagaagactcatcgtcgctgaaaacacgagcaacatcaacgagtcctttcttcttggcggccttcttaaccggaccccccttcaccaccttgcccgccgaaaacacaactagcgccttcgccccctccaaatcctttcgatgaaggggggagctattcgactccacctcggtctcgttatgccctagacttggagtaggagtgtagccaggggtcttggtgcggttttcgaccgcctcgtccgcagcctttctggccgcagcctccgccccctcttcttcctccccttcctcctcgccgtcacgatcttcgacgtcgtccctgtcgtcggcgtcagaatcggaggaagcagggacccttcgcttcctaggggccagtttcacttgtccgtgcgtccgctttcgcgaaggctctgcatcgtcgtcggccttgttgtgtgagcagctggctgtactcgacgaccgacacgtcgccaatcatcttccgggcttcagcgtcggcctaatcaagaatcaatactgcgaaaataaaagatgtagccatattaagcgtcgaaccgggaaaaatagcgaaacaaagaagcgcatagcgaaagcggagtctcaccgttcgtcccctcaggaggaaccagcttcagcaaaccgtcgacgtgttcgtcttggtacaaccgcgaccttgccacgaccgggagaggggaaa

SEQ ID NO: 81842 - DNA, 609 bp, Oryza sativa
atgcattatccttacattccgaatcttttgctttcttcgagggttgggttgtaatcatatcagcatgaatggcgtcttgattgacctgagtaccacataaaattaacaaggatctatattgtacagggaaattatataacactgaaaagatatagttaatgcacttagtgattaaatttggggaaattcaagaatttattacaataaattgtgtctcaaatctgctaactgttatagaattattacgcaaaatccaactatggtgtttcaaaactatgaagcacgtaaatcagttcggtgttactacttctgtttaaggcaaacctttgttttcaaaaaccaatagatacttatgttgggtcaatcatgagcaaaagattgcaagtccaagcagttgacaaagacacacacaagagcctcttgcatcgcatgcatgctttgaaaagaagattgatcaaatagctagtttaatctacaataccatgtattaatctacagtaccaaacattaatctacagtaccatgcattaaccttagctagctaatgtactgcctgcaataagtagtacaaattgcaagatagcatagagccttagatgtcatggactc

SEQ ID NO: 81843 - DNA, 10391 bp, Oryza sativa
acaccccactatccgtcccccctgttgtctagccttgaagcccatggaccttactaggatccaatgttctgtctgctcgagagaatcaacgagcagagtagcgatgtcgacgtctcggcttcttcgttaaccctcgtcctatcgcttcagcttcgcattgtgcgacagcgactgtcggcaacagtgacacactacgcacgcggtaagcctctctccgcaatctgtgcctctgcccttcgatcaacgatcgcgtgcgtctcaccgtcaagtacgcagcacacctaacatgaccatcggacgcggcctacaagtgaggttttgtccattttccccaatacagcaaaataacctaatcgcttgacttttagttttatgttttcttttacttgtacggtagtcacttgtccataatttagtatatagacatttagtccgttggtgagtactggattttgtgatgtttgaggcttggaggtagttgctactctctccgttttagattataagtcgttttgactttggtccaagtcaaactacttcaaacttaactaaatttgtgataattgaatatatttttataatatatttgtcttgggttgaaaaatgttactttttttttttacaaacttggtcaaacttgaaacagtttgactttgacaaaagtcaaaataacttttaatcttaaatggaaggattacctaataactatatgagcacttgaaccttcttttctatctaaaaaaatatttttgttgattatctaccaacaatgaagccatgaaggctatagtatgtatatgcattgattgtcatggactttggccattttgtcttctggctccctcaatctcagatttggcttcgctcctgtttacagtgcactacatcatataggcactggtagagggccactgtcatgatatttattagctcaagcatcgtataagggctgagtagtaaaaaaatcaaaattgaaaacaggataaacagaaaagccaagaccgagaccgaactaactgattacttttttttgcgacaaatacagggagctttattaaatcatatcaagattacattcttgagcaagaagctcagaaacattccctggagcctgcaggcgccaaacgggtatcgttccatcgatcggtggttacctctgttgcgccaccgccaccaccagccaacccatcagtcgagttctcggcttcacccttccaattcccgagttggcttaacgagtcagctagctcaattcaactcatcgagtcgagccgacctgatagtactatataaaactgattgattcatattactacgacgttttagagcatcaccaagaagttttctaaactgaaaataggaaataaataagttgatctccctaagagaaagcctaaattttatcaaaaaaaaatatttttctggaaatattttttttgataaaatttaggctttctcttaaagtgatcagtttagaaaactgaaacaaattttcggagagattatacgtctgttgatgcttaaggctgtgttcggtagaacaagttcgcatccggaacagaatagtgatcacagaaaacagagcggtctattagcgcgttattaattatgtatttgctatttttttttcaaaaatggattaatttgattttttaagcaaatttcgtatagaaaattttaaaaaaacacacaccgtttagcagtttgaaaagcgtgcacgtaaaaaacgagggagaggggttgggaaaaggggcatcctagctgcagccgaaaaacctacatccagtttgtggaaaacaaaaagaaaaaagaaaaaacccaaaacctaactactgtagcctgtacgcacatctatcccccatccgccgccccctccctttcgtctttcgtcgctcgctactaccgtgccgcgtgccgcctccctcgatctcacgattcgcctccgccgccccgtcctgttccccaacgctagctcccattccccacgcctccctctattctattcccgctttccctatcttccaaagccgccgagccgcgcggccgagtgcaaaaaggaaaaatatcggtccccgcgagctagggtttaccacccccccctcgtccacctctctctctctccgggtgcccacgccggcggcgagctctcctcaactgcgccgccgagagcccccccgccccccctgttcgtgggggaagtacaggttcgcagtgccaccctctgtgtctactagtgaagtttcagttttggactatgattttgttattatgctccattatgttgggagattgggattggggaattgaaacagtcacgtgaatccaattaggcaactaaaaaaacaaaaacaaagagagtacaaaatagggaaaggcgaaaaattgagaggcaccgcactggggatgtttgattgcttataattcaatggctgatctgtaaatgttagccatttcggcttggaaatgagtggaaaaagctaattaatcggaattttttcgcaggctgatcttagttgggggggtatactctgcggtctacttgctactccagcaatgtattgttctcactgtcaagataactgccccgtcgtaaaggaccctgacaaaaactacacgtgaggcctcccttcctgtcttttttctccttccatttcgatgcaaaatcagctagtacaaattgtttataagcatggccttgttggtcactcttaaatttctgtgtaccagctctaacacttttgtgcgcgtgtcattatgtaatttttcatatggtgatcagatgttgtggtttgtgtgggaaggttcttgatgatcaggtttacgatggtgagccaactttccaaaagggcgccgacgggcaggttgatctttcactttgcttctaatttggtttggtttatttatttttcacttctcatgttggttgttttggagctttacaggcccggttggctggtagtattctatcaagcattgagagtggtaattcagtatcccatgaaagaactataaataaaggtacgactttgaggtcattcctctatctcattttgctgccactttgtgggctaatttcatgctttgtttttccaggaagagaggagattaggcagattgtcagcagcttacatgtggctggtggagatactattattagcatggctcatcgctattatacagtatgtatctttgttactactacctccgtcccaaaatataacaacttttagctttgaatctggacacacagttgtccagattcatagctaaaaatgcttatattttgggacggagggagtagtcagtagcttataatttctaaaataatatggtacatggtgatgctgatgtttattcttgttgaagtttagctagctgttgacaagaattttacaaggggccgtcgaacaactcatgttgctgctgcttgcctttatattgcctgccggtatgctaccacctaattactttgttgatttattgaaagtcttctcactcattgtacttgttttttttctcaagcagtacctttcaatagaattatttcttgagcatgattcttttctttgtcattgaacttataaaatgcctaaactataacacagctaagctattccagactatagagcatgcatggtgaacatttgtgatgggtttgtttaatacatatatattttaccaagcacacaatctgaacattgccatgcatggccctcaaatatatcttccatgtggaaaggaatgctgtgtcctaaattttcaagcgcagagtacttaatggcctggttatgctatatctcatttttccctttaggagaacataatactccctgtaattgcaaaacaaatcctaggatttgacaccggccaaactttttaacccttgatcaatggtcatattggaaaaaataacttccatttctctagagaacatataacatccatgattgtctttatccatagaaatacatgagcatgtaggtggttatagaaactagcagtcaatgtggctcattgtagattatgtccatgtcccagatggtgtgctatatttgcaatcataggtcgtacacagtattttcattagttattgctgttcttaagttgtccagcattattttttttcctattagttcccttggatatctgttgtcaagtttcaaacttttgttgatattcattcctgacattcattatacctaatttgtgtgctaggcaaagtaaaaaggcatatcttcttattgatttctcggaccatttgcagataagtgtgtaagtgccccattctcctgcccttatcttgtagcccttagtgacatggctcatctggatttttctttcagttatgtcctaggtgctgtttttctgcagctttgccaagttttgctacttgcggaacatccagttatccaaaagctcatcgaccccagccttttcatacatcgttttacagaacgtaagccacactaaattgtattatttaaatttagcggctgaaaacacatgtgccatttcttgtgtacatctctacatttccatgcactttgaatatgcacatttggtttcttcaatgtggggagggggattgttcatgtcatgcaattataagaggctgggccaggctgttccaatgttggtacctgccacatttgccatggagaacatgttggagtgcaattctgtttggaaattgcaattacaacatgaattctgattcttaaatcataggcgctgtttgattgatttgcagaattggatcgaaattgtggtattcgagtcctgaatcaaattttactcgaaacagtcataggctcttgcatttacaccccagtgagaagtggactgatggatggaccatttgataattcttgcacaaagatttatgtagcttttgactaatttcttcaccttaatttatctaatctattcaacgtgcttttacattcttgtgaaaaaatatataacaattatttaaaatcacatatgatatttattttgaactatttgatagatttgtatatggtagagtcatgtgtagtagtcagactggggcatactatagtcaaactatctcctcgcttgtgttgctcatgtgaaggagttcaattgcaatgcaagctccatccttttatcccccccttttctgagatctttgcaaggcaatgccagaaggcaattgcttgggttagtaaggaaaccaaacatgtttagtctgattatttttgttttttgtgtcactttgttggttttatctgtaggtttactggggaagagggacaatgccgtatcagatacggctttacgcattgtagctagcatgaagcgagactggatgcaggctagcatatttttctccttccttctttaggttcttttttgtgattgtaataacttgacttatgttgcagactgggaggaaaccaagtggattgtgtggtgcagcactatatatcgctgctctctctcatggatatgattataccaaggcagatattgtaagcccaagtacttttgtctgatatacttatttagaattgtattctgaagtcttatgccctccttctgtatcagttagcatgtatcgggcacatgctacattttgtattttttataattggacatgaatatgattctatgctacagcatataatgacataaatttctgttttatgttttttaggttgctgttgtgcatgtttgcgaggcaacactaactaagcgcttgatagagtttgaaaatacagattcgggtagcttaacggtatggattctctctccaggaaattgccaaattcataggcgctgttacttaccgcatacagatgaaaatttgttgcaacgatgtatttgtaataaagatgggaatgacagcgctaagttgattgttggtacaacttttccctctgaaagtcattcttaagctgtctatgctgaaacatattgtaattactatcagtgtatggtgtctgttatggtgcaagtatttgacattactcatgacactaaagcaactattgacctaagcaagtactgattagggcagggcagcccatgtcaactagacatgcattcactttctttaccctgtccatagagctagttttaggtgcttatttttacccgttggttcagcatggtctatctggcaaaaaaattgggtattgccccctttcatgtctgttttttcatgtcatcaattcatcatccacaactgttatctactactccctccgtcccagaatataagaagttttagggttgaacacggttattaagaaagtaggtagaagtgagtggtggagggttgtgattggatgagtagtgaaggtaggtgggaaaagtgaatggtggagggttgtgattggttgggaagagaatgttggtggagaagttgtcatattttgggacggagggagtatatgaatattctttaagcaaatgaaatagtattatgctagattgtaaacgaaaatggtccttgaggtgtaaatgtgtcattgtgaagcccattaggggtccatgcaatgggcgaaggatgctgcctctgcccactactgcctaagcactgttcatggtgccttgtgctagttttatttagtttaaaaataagatgagattgaattatttatcggtttgtttccttagttttagagcaaagggcaaagggtttttgcctctatcatgcacagtacatcaggattaggattagaggtgtcttcatttcatacttaagtgattggacacatttccagctcgcattcaacgtattgtatccatgccaatttgcatttgattaaacattatattttgctgccctcttgctagattgaagaatttttggcaaaggctgatgaacaagtgcttgttactaaaatttcaccaaagtctggagaagtactttgcaagcacaaggataaagctgagcattttgctcatggactctgtgaaaaatgctacaacaaagtaacagacctttaccatgttcataatacatcagttttgggacttcattactcctgacacatgcatgactgttcagtttatgaaactgtctggtggactggagggtggctctgatcctccagctttccaacgagctgaaaaacaaaggttggaggctgctaaaaatgctaaaggaactgctgcatctaaagaggcagcactggaatcagtttgtgaggcacgcgaatctgatgttgagaataacattacgacaccgccaaaggtaatatgttcttaacatagttaagctcatgcttgttcccctatttaccatacattcttcctttgttagccaactaaataatgtgctcttttagttcattaacaagggcagaaaaaggtgacttttgatcatctagatcctgtacaagtacaacagttttgttatatgaatatgttgcattctcatgcaccacgtatatgagtataaatttacacgaaactgtatataggtcccgtttggaagtggcaatcagtaataatccgccctggattatttgttccatgcacctaaattatgattttttgaaaaactctcttatattgccttgcttagacaacttgttcctagctactactccatctgtccacaaatataagggattttgggtttctccatttgtccacaaatataagagattctggagtactttcccaatccattgaaccattgcatttgtttctcactggtagttgcatcattagatgaaatctttcccaatcaaataaagtcccgagagcatcaaagtaattccaccttatgtcacgagctccaggaagagactggattggatatgtgtgggatgtgggcggacgtggtttcgggagattggacgtgcgatgccccgtgatggcgacgctagaagaacgagatgagaaaacagagaaagtagatgagaagagtagattgaattcaagcttgatctttattgaatgaaagattgcttatataagcttatatgcaactgaattgctaattaaaagagataagaactaatgcaacaaaccggaaccaactaaacaaactcgagataagatcctattgccaagccgtactgtagcgcgtccgaatcacgccattcatgctgccgttgcgcgatctgattgatcgccctcatcacgcgccgccgttcccgtgcatcccgcattcatacgcctccgatgatatccaattctgaccatgataccttaaccttaaactctgctaaaaaaaacctagcatacttatatattttcgaactgaaggagtatttgttaagtttatttctcaaaatattaatttaccgtgttaatcaagtagatcatccatttcatttcacccgtgtttcatcactttcaaatggggccttattttgacaaaactatagttttaagacacaataccacaaagctagtatctatttagcattgaatttataaaaagaactacatatttatgttctactataaaaaaaacttcagatttagcatctcatcacaaagctatggatttataagttctattaggacaacagtgtgaggatctaactcataaaatctatatatcttttatggtctatttagttctatgatctgtggtttaatctgcagttttgttataattttgtgaaatttctgaatttgtgattttttttctctatttattaaaacatctgcatttgttatttctgttgtataccatataatgtgtttttgtaatttgaatactcaatttaacttattttgacagaatataattggagataagcattcgacaattccttctgtgaaagttgctggtgattctgtagctacagaagatcctgaaggggaaggtttgtttgttgctgtaccatcaacgatgatactccacaagaaaattcatatttccattttaggtcccttttgataagttcattcctgctgcatgcatatttcatccttaggtaaaaatgataaagcagatgaaggtcctgaaagtctctctgatattgatgatgcggaggtacttcatcctatccatgagatcacttctatatatttcatagagtaacttatttatgtcatctttagatcttgaaagataatcagttaggctctttatgatttactacagtgctactattaatttctaggttgatgggtaccttcacaacgaggaagaaacacagtacaaaaaaattatctgggaggaaatgaataaagagtaccttgaggtagctaagctgattacatagtagcataaggactttcttattttaaccacatagtgtggttctcagctggttgctttacaggaacaagcagcaaaagcagcattagcagctgagctggcagctagaggagtggttgtggaagaggggaagaggaaagtatgaaatgtttctagtgctaccaacctttctatgccgtgtgttcactgtagttcgtgattaagcatggatatttcatatgtagagaagaagacataatgaagatggcaagaacgcaacacccgctcaaacaccagcagaagcaacacagaacatgttgaagcggaaggtactaatggtcaatacaccccgatgctttgtaaggtttttcatttacttttgatggagaataggagaggctccactacatattaatttcatataagggagttatttgtaagcagtaaagaatcagaagatgattagtgcattttaattatacttcgaatcatagtttcacaagatagtttataggataagtgcatggctttattcatatccatagtatgcctactcatgagactgtcatgtggtccctgcgctcagatgttccttggcatgttatagaaaatggttgaaacttgaaactgaatggttttaaattacaatacatcaatacatggttagtccaaacatgaaaaattgcagattttattttaaattagattttttgcttccagcatgacatgctctttaaatggtctaaagagaaatctacattaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaactaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaacaaaggcccataagaaaggtatagaaaactgtggacatgtttgcatcatcttaattggcccataagcgaggaatttgctccaataagcccatagcaattaagcagacaccaattgaattgagtagac

SEQ ID NO: 81844 - DNA, 3950 bp, Oryza sativa
gaacttaacaaaaccagaggcatatttcaaggtcgcgtgcataccatccaccatgctcttcaggtgcttgggtttcgccacacaaacattatggtgcttacatgctgttaactttcctttcgatccgatggcatgaaaaattcagcaccagtaatcggtggtaaacagcagtcacaccggcacaagacaggcaagatgaaactcaaaacaatcgccatcctcaatattaattaatttgttcatttccattctgcttgcattacaccataatatggaacaaaatgaacagaaaagtcattggtcagacactcagacctatagtacaattgttgcactcaagaaaacgcctaaaactgctaaccaattaaataagaagaataaaatataacgaactgaaattctacccgggagcgctgatgccttcatgccgctggttttcagacttcatgatgttaagggagcagaaggaaacatagagtagccttgtctgatctataaactgagtgctttggtactttttaattagggctgaaaacgatgcctataaatgtgagttgtgacccaagatatgagatatatagaaaaatattaatacctgaagacgccaactattggaagacccttttgcattgcaatgtcacgtctcattagtaagacagctcgagcaccatcacttacttggctagcgtttcctatgggttaaaacaaacactaatcttgagaggtgaatacaactaatcaacagttgtgcctaacaaactttcattacacattaccagcagtaggggtgccatctttagagaatgcatgtttgagttttgactggactgccaatgaagtgcctggtctagatatattgactcaggactaaagtgtcttcaaatattctcagtaatacgcccagccttcaaattcagtagttttatttatggtgtaacatatatgctaggagtaaaatttttcatggttaaatgcatggtaattgtaatgttaagttggagtggcaatgttgagatcagccaaatggggaaaatgaacatcagtacccttcattggccatttgacattgagaagaatatgtgcaaaatatctggtcatatcaatcacacaaggaaaacagaaataccatatactgctacagtggtcagtcattatatttgtgttagatgtatttttcactaaataactaaatattgcatcttagagatactgcttttgctattgatccgaccactattttgttaatttcattgcattttaggcatggtatctcaattagcagaaaaagaaagatgttataacgcatcaatgagatcttctagagatgatatgatttttaattttgtactgatcatcatcaacatataaaatatattccccatcagttaaaattttccagactgctctattgatagaaccgcttagcaatttttaaatggtacgatacatagcttgcgtacgtagttcatgcacaggtaagtccaggcaatatcaatcaaatgcgcacaggaccaaatcaaggaaatactaagccaaacatcatggtaaaggagccaagaataccttgagctagcaaggtccgagcttcccttcgtgcatccctggcggtggacagtaagccgaggtggacaggtgaaaaaacagccaggagtcccacaggtcaggtgacctctgaaggagacaagggatatgttgattgtttctattattcatatgacaaatgttgaaaaaattcactcaaaggtaatattctaaatttggaggtaccgatgcaagaaaaaccactacttatgtggcataaaataaatttgtagaagctagaaggttaatttcagagcgaacaagatccgttcttgtaaacttgtactgatgcagtgatataaactctacgtccaatcaataatttaagtaacatgatggagaccatgtagatatcactcaaaatacaagacaagtatttcacaatagacaatcatatgcagacattcacgcacgacccaatcatccttttctaactttgcacaacgatagaagaaatgaaaggttttaagccatgataaataatcaaagctgtagaagcttccgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcataagggtactataagtataagtatatacattcatatgggtactataagatgtaatttaaggcatatatgtacattttcataatatatttaagaactccaaggcaagcattccatcaagcaggtcacaagcagtggcgacgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgagtttgaatgcatttgtgcataccgggtcagcaagccagtgcatccggggcacgaagcccaccatggcagagagcgcactctgccacacggcgaaggcggcgtcggtggtgagcccctggatgggcctgaacctgttgttgaggctgtcctccgcgttgatcgcgaaccgcacccgcgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgtggcgtcgcccgcgtctcccgtcggccgtctcccccgccaaacgccgccgtcctcacgccacctgccgccgtcgcccgctccgtcagctcaccggtcagttccggtgatgacgggccggatccagccacggaagggccagatccggcggcggcggatccgcagccacgcgccgcgaggccttcgcggcgcgctgtgccgcctccttgcgccggagacgagccgccgtcgggggttttggccccgccgccgccatcccagcgtccgcgtggtttccggcgccggcgagccggtaaaagaaggggtgggtgccgccgcccgggggctagggttcgcccccggtcgcccgcgcgtggacgacttcttcggtgttccctcatacaagaaggtctcggtcatcttctttgcctgcaggcatcggcgtcagcctccttgttcttcttcttcctcctcgggctcctccttcgcgtcaggcgcaatgagggcgcggtggagagcgatgggcggccagtgacgatggtgggcgctggcgcggcgttttttcgcggtagggagaggcgcgcggcacgatggtggtgcggactgcggaggaggagcgcgtcgattctgtgaaaaatccggcgcacgagtgcacgacggtgagggggcgagagagcgcgaggaggaaatgcgtgggagatgcgggagaaagaggagggaagagcgagacacaggacggtggatgcggcgtgatttcaccatttcaggtgcggggaggagaggagggggagaggtggggtaatctgaggcgttggattggatgattttagaccattggatatgtgatatgatgaatgatgagtgagtaaaaggatttgttgaactaatagg

SEQ ID NO: 81845 - DNA, 1544 bp, Oryza sativa
aattcttctatccatgacgaaggtgctcgtcacagaattgctatccagctggctagtgacaagcatcatccatgccacgtggctgccatacgtggaatccacgttggatgtgacgtggcagatgacgtgtactccacatttgtccaagccacgtggctgccagacgtggaatccacgttggatgtaacgtggcagatgacgtgtactccacatggcggatgacgtgtacgccagtatgctagagccacatggcagtcgtatttaaccccacgtgttggcatttcatatgtccacgtggcgttagcgtgcaacgccacgtggccaaatgtggcaacgccacatgttctcattttgaggcgccacgtgtctttatgacaggtgtccttacctgatacagccacgtgttaatatgttttgatgacacgtgtcaaacacattaaggattcaggtccactcatttgttctggcccaacccatttggccacacattttacatctagttgtggcccagtccactattagttctagaaaatttttagcattggcccatttggagcaacaattagaactttgcacacattacaaataggaccaacataaacattgaacacagataccaacttcattacaaatagccccaacatcaacattaacattgaacacagaaaccaacttcaccgatgatcccaaacttgtgagccagtgttgccatcacctccactggcagcagcagccatggcccgccgagctcgacatcgacgatgttgccgaagtccttgctaacaacatcgatcctctgaaacacctgataatcaaacgaaaccaagtttcagattataccaacaccaaatttctgattctccaaatcagattcagctgaataataattcaggatcaattgtttttctgacctgcccgagggtgatggggaggagcctagcaacctgatagtacataaccatatgttagattattttttttatgcgctagataaacaacaagaaacaatctatagatacgacattagttttttaatgatagggctactttgcaacaccaatctgatgtccccataatatattgcactaacatatctcaatgtccccatccccaacccacctcatttcattggccaagcaaacaagcaaccgaactagaatgcataggagtttagcactaaaatttagacactaaagttatgatacgagtaacttcctatacatgcttcatttctacagactataggcatatagcatgaccgtaaagtgtggtgtaaagttatggacaccatttaaacatgcttcatttctacaaagtacatgcatacaacggttccaaaatttatatcaccagtggaacaatgtagcagcaacatcactaagtactataacactagagtggaacacacagcgcgctgcaccagtggcatcagaagacgaaaatttgtcgttattttggtaaacagagtaaatactaaatcaaaaggtattataacagatgagtaccaattctacaatatacattttaatctcaatggaaaacta

SEQ ID NO: 81846 - DNA, 5526 bp, Oryza sativa
gttggacttcaccggtggtggcaggagcatctccatgaatgtatagaggaattcagcagtggtggcgttgatttctgggagtgaaggaagagaaacggtgtcgatttgtggttgggggggggggtgggtggtgtccttttttttttcttttttcgtgctaggaacatggatatttgggggaagttccgatgcatctggaaggtaggtggagggagggatataatgtcatgtgtggcttacaggtgggccaaggctatgaatgtaaatttttcttatgttagagctattttgcatttttatttaggaaaagtatgttttagcaaaatttatagactggtttaaaaaatacaaagggctaaaattttaaatcatcatatcccatccaaaacaattgtgcattgtagagtagtatccattcctcgtgcctttaggcagcattcttcaccgtctcggagctcatgattacagtgtaaggcattctattgtcaaagattgggttgattagatttgatgtctcgacaagatcatgtatatcccacgcgacgcttagctcatgtcaagttttgatttaaaactatatgccgatttgagacacgtcgtaggacttgattcatcgttttttccatgtttaattctaattgtgttctactcggccctctactcccctcttcctctctctacctaaggtttggaaatgccgcaatatccctccaccattgagcaaccacctcctcttttcttttacgctattgccttactcgaccattttgcccaccttgctagctccatatcttgaatcaactagctcgccttttctttacttctcgatcgcagtcaatgtggcaaaatgacgatgggcaagtgaaaacatgtagataatggatgttacatccaatacgagagaaaattcttccagaaaatcttagtgtgttaaagcatgtagataagaaaaaaaatctattttcgaacaacctatgtgaagaaaatattttcttaaagggcttagatcattgttggtatttcttacgatcacagataagatccgcaagcgcacggatataccgatgtagcacttcccctacagagtattcgaagggtattgaatccaagggaacgtgtgtggtcagatcttcctccgggttatccaaagacactaaacagtgtctacggaaagcttaattttaatcctaacgcaatacttcgggcactggccacccgctcttcctagatgtcgctctactacgtacccggacagggaggacttaagtgctcttgagtgctgtcaccacctctacacctacctcaaacgtactgtgggatgcgcagcaaccactgtagattaattacccagacaccgcgtctacgcaattaataactactctagtgccgatcaaacactaaagcaaccactataaataaataaactatagtgatcaatgatcccgtatgctatttaggaactaaccaagaaataattctcacgagataaatctaaattactcaggaagaatattatattgaattcagagtaataaacagaataaaataaatgagagaagattatcgacaactccagaattcttccgacttcttctactctactctcttcctattctagtatgcaatatagtacaatagagcctcttataattcagctcaagcttggaagtgtgtgtcgaagtgagtaaagtgaagtctttatatagaggtaggtatgacggttagcgaaggggaaatgtccgaactgccccgcaaccgccatcaaggagtgatctcgaatgtccatgccaaaacctgagatcaacggtgatcaccagggttctgccgaacttgggccatgccccccaggcctggcctttggcccatgtcctcccctgatcctcctctatccattcctcggtattttgggctgattctctggtattttgatgaagttcacaacccatccttgtgttgatacaagattctcctcactttagtctagatttcctcccaacttcggggtttatcacctgcatacaaatatacaccaacacttgtggaatatgtgagattaagcacctatcactatgttggatgttttattatctggacttttatgcagatgttggcggtatagaatcaaaatttaacagccgccaacaaaaccccccacacttagttctttgctcatccctgagtaaaggttagtgtagaatgaatttcttcaagatatgaatcaggcatataaaatcatttacaaccatacatgtacctgtgaactttatcaatggctatcttaccatcttgagcaattgataaatggaacgatctcgattcgattccctcttgcttctgtgccagactcatgggatttttatgaattttcgcaaactagctcttttcctcgtattgactttctctcttatctctcaaggatgtatattttctttttggatcctcaccaaggcaaaatgtaccagaatttatccctattctaaggctgatatgtggagctcggtagggacaaattgtgacatacctgcatcatatatattacaaagccaaaaatacggactcaagaagatcatcagtcatactcctagatcaagggtatttatttgtggtagaaaatggaaaagtacatttttttgtggaatggtggaataaagaaatgattctcccttttttcctatactttctcctcctttttgttttcttggcatgaatatggaaggggcatggctatatttcttttcatcatgctcaatgttttgagagcacgctttatttcctctcttttttttttcttttccatagccacgcctttccctccttttctcattttctttttgccaagacccccccttttttttctaggagaagaaagcataatctaatgtaggagtttatttgaatggaatttttgtggaaagccaacttccagtgtagaagcttagcttaattatgtatgtggaaacggaagtggaaatgaccccttgattatgagagtatgtaagatatctagcacgagtcacacaaatttgacaaagctcaatataatgtcaagcagtcatacagataataaggtttatcaaagatatatttgcatatgtccttggtaggtataaaatgaagtcaattggaggaacgagctttttaaaacaattttatttttgaaaacagattcccaagagtcataacaaaagttgcaaaaattcctttcaactttaatcatctcacataaagcaattacttagatgtataagggttcctaaacatggatggttgttcacaagcacaagttcagctgagaataatgaatatacaagaccaaccatatgaagattttcattagttggaaattttatttttttaattatgcttgaaccaattgttttctgaattttcagctctagtactataccatggtggagatatatagataaaagacgtgctcacctacttacctgtaaaaattgagagggattggggccagttttggttcggccgaaccactctggtgcccattccctctgcaattttctgcagagttgtggtggttcggccgaaccactctggtgcccattccctttgcaattttctgcagagttcaatgtcttccaggtgttcagagattcagcaattttcagagtatgcgcacgtcagaagctgggatatcttccccacacttattcaaaacctgaactttattaaatatgaaacaaaaaccaaacttggcatgcattggggttaacaccaatgagccacattatttatagcaagtgcttacatgattggaaaaataaaaaccaagcacctactactactttattcgtgggggagggtacatctaattagcataatacttattctccttccccatctctatgaatgcacgcttgattttagcgcacaaaccacgactaagggtatcaaaattatttctaagttcagcgagttctacccctagctccgcgttgcgatccctaagctctatgttctccttgcggagtttctttacttgcgcggcgagcttatagaccgagggctcctgtgattttacttcatcttcttggaattagccgtccgcccttataattggagggggcgtcaaatgacgcttcaccttcataggtggagggctacgggattccgctgccccctccttctccgatgtcgtcaaaggccggagcaaacccttgccatacccaccgccgggagttaacactccttgaatgcgaaaccgatcctccttcggagtggatggagtagcggtggtgtagtgtacttgtggagcacctcatctcctgcttttgtgaacatggtgcccacatatcgctcggcgggaggcggagcggccttctcatcatcttggaaaaggcgtcacgcctttaaaagaccgagctcgcccgttgtcgtccgtcacacaggcgaatcccctcggattttggtcttcgtaacatggtgaggggagagggatcgcactgccgaacggagccaatgggggttcggccgaacccctggttctgccgaaccagggagctcgccaacgggctccagattcgcaggggagcccggcactgtcgcaaggggctgcgcccacagtgcattcaccctttccatggtgtagtgttccaccgggatcaattgattcgccggtgtcggctctccgtcaaggttgtatgtggagttggaggaagagccgatgaatgggatcaaagatttgccagctattggtgaattggaggtgatggagcaagggaattaagataagatggagaggaagcttgcaaaagtgggggagaaaaggaagaatatgtattctggaatgatacgactgatctaccttcgaatgcgcatcacaacggattaaagacgagagggggagactgaagttcaaaatcgaggctgattgggcgccgccctggttcggctgaaccctagtggttccggttggccaccaattcttttcctagtgtttacacggattttggctcgtgtcctaaatataatttgttaaattataaactgatgtattatctcaaatatagtgcgtacaaaatatatataataagaattttatcgagagacagatggtgaagtaatttaattaaatagcggccacgaaataaatggccatgaaataaaatgtaattcacttatattggacaaaaataatttttggcttaaaataggaatgcatatgcgcgttccacatatgtagcgtgaacaaatattttccatgcgcttttcgtcggaccggcgaacgctaatacttagctttctcgttgtatccgcatacgaaatttggcctgaaacatatggccattaagtgggattttctcactgacccgaaatagtcacgccccgaatattttcagaaaaggcatgcccaccatataaaatagcatacaaaaattaaaatgtaagccaaaatagatgtttatctggctagtgaaaaatcgtgccccaaatagtcgcgacttaaaataaaaatgcatgccacgtgcacgccgctataatggcgtggatatatatacacgc

SEQ ID NO: 81847 - DNA, 600 bp, Oryza sativa
caattaaagaattttttattatttgtgagtaccctatagttcaacaaatccttttacttactcatcattcatcatatcacatatccaatggtctaaaatcattcaatccaacgcctcagattaccccacctttcccctcctctccttcccgcacctgaaatggtgaaatcacgccgcattcaccgacctgtgtctcgctcttccctcctctttctcccgcatctgccacgcatttcctactcgcgctctctcgccccctcaccgtcgtgcactcgtgcgccggatttttcacagaatcgacgcgctcctcctccgcagtccgcaccaccatcgtgccgcgcgcctctccctaccgcgaaaaaacgccgcgccagcgcccaccatcgtcactggccgcccatcgctctccaccgcgcccttattgcgcctgacgcgaaggaggagcccgaggaggaagaagaagaacaaggaggctgacgccgatgcctgcaggcaaagaagatgaccgagaccttcttgtatgagggaacaccgaagaagtcgttcacgcgcgggcgaccgggggcgaaccctaggccccgggccgcggcacccacccct

SEQ ID NO: 81848 - DNA, 17874 bp, Oryza sativa
aaaagtgtttggtaggtttcgagctccagttctgaaaattaaaaaaaaaaaaaaagaaaaaaactccccaatcgcaactgctggccgtcgccgtccccgtgtgtgggcaggccgcctcttgctgcgcgccgcccgcgccgaaagtccgcccgccggccgagcgccactcgcgctgtccccgatgtcgcccgacgactgccgccgtccgtccgccaaccgcatgccgtccccgatgccgcccgccgtcaacctcgccgccaaccgcgcgccgaccgcgcaccaacccaccgcacgccgcccaccacgtgctgctcgccgtgcgccggccgcggtcgaccccgccgcccgccgtgcgccagccgcggtcgacctcgccgccaaccgcgcgccggccgccgtcgagctcgtcggagtggagagtgagggtgacggcctgatgggagggagagagagggggtgagagatgagttaggggtagttgagtggcaattttgtgtaaatatgtaaaaaatttaaagggtagtgggtcttttggtttggagtggagttgtggagcagcaaaaacccagctccacccccgtagtacaaatttgtggagtagctctgccaactcaactcccaaaaatggaggatctggactgtttggcatagctcctgctccaggtaagttggagttaggagcttgagctgtgccaaacggggcctgagtaaaaccatttgttcaactatagggtagattcatcaactcactcttacacctacattactcattcatcaaatccaacggctcatatatctctaccccaattgaacgatcaagatcagctccgcctctcttccgcatgccgatcgctcgtcacggctccgtttcggcgtctcccctgccaaccccccgcgcacttacgccctcacccctccccaccacatcttcaacccccaactcacgcatcgcccccctcctctctcctggactccccatcgtgcgccgttaggtcgccgtcgccgcatgccgctcctctccccactcacgggaggaactctctccaaaccctaaccctaacctcctctctctccacgaatacgcgctgcacgctgttgcgcgctcccctccccactcgccggttcctccgcgtctcacctgatctccacctcgaaatccgccgccggagcagcgttaggtcgtcgccctcggtggctcatgtcgcactgtcgcccaccttcgcgccgccaccggtctcctccgcacggtttgttttttcttccgttgtccagtttcaatctcttctcccttctagttcattatttttctttggcctgattgattttttttaacaaactggccaatttgattttggctgtgatataccagcaaggtatgtttttgaacatgcacatgatgttttctattgaatgctgcagaaacagtccgccaccctgttcgtcaagcaattttgttatcgatggttggaatgtattacgccaatgtgttagtgccaactaatttttgggtttctgcctgaaatgctaacatactattcgatgcattcatgatagtctggggacaaaaggaaaaaaattatctcgtgctttaggggtcaaaataggacatgtgatatttggttgttcacaaacagctagcccagcattaatccactgatggtctgcttgctgaatttatttctaagtaattagcaatctttatttaagcctgaatgatttgtactaaaaatttccccttgtttttcatggtatcacaatagattggaacaggataatcttctgctcaagaaaacaccaatgttggagatgatcacaattgtcctccactgctcttgatcattcaagcaggcatgtactttcttttgcagatgggtacacattattgtgttatgcatttagctaattgattaaaatatcctgtgattttacaggcatgttcttttgaattaccctgtctttcctgtaattaatttatgcagtatgctaactgattagcacgatctcatgaatactacaattgcaggcacatatacatacatatacaaaaagatatgccatggtgtggatggaaatcgtggaggaattctgcatctgcactctattgacagagttctacttatataaacattgcaagggatgcatctttcggtaattcaccattgataggcattgtactaaactactaatactataatctgcaggtaatatatatccatctattttttcccttcaaatctactagacttcaacatacaattttctcaaccccagatatgtgggtatatgcagctgatttgcaatcaccaaccccagatattttaacccttatagcttaactttgaagtccatatgttaggcgcagagtggtaaagtggtttatgtctattttgatcgagcagtttggcgagcggagacgtggaattatacaatggtagttcaggagaattaacataggcataggtactattttttactgatagatgtattttgaaatcttcatggattatggagcggaacagctaaactttgctctgctgtaacttagacccaattgtgcagtgttcatggtatgtccgacgttgcttactttgatatgcttatgctcttagtggaatcactaataaacatcgccggatatgtgtccttttagatatgcttgtgtgtttgcttcctggagatttggttgggttggaacaaaatgttatttatttgctttagaatgcagtgccctatgtattacgaaattatacttcctttaattgagtctaatggcttagaatccctataatattgtttaattgtgtggagaacatgaccaaaaatatataaaatggacatataatatactgctgcttccctgtatttcttgggagattctttttcaagatcatcactgatcagatgctacgagtctaggaatctttaaagtttgattttctttttggcatgtatggatgtatattttggtttaatcttgccataatttatttatttattactactaggtcaggagataaaattctccttcaaagctcattatacaatacaatgttacaataaggataacataaccttatccaaacttgtgattagtcaatgcttaattaattacatcattttgagtcatcgtgggtgaaacatggtacatttgtgttaaacatattattgatagcacttccctttgatgcacatgtaggcagctcttaccctgaattcatataattggattagctgaactcagtgcctccaatgatgattgaataggaagggaactaactagggtagtattgttttgtgcttgagatcctggttgcggaactgagatgtactattgacttgagtcatatttagttttttgctatataatgttgatttttttactcatttttgcagaacgaaggatggcgcttgaccgtggatgaggagcggatgtcctgctcaatgagaactactgtggatgcagtttttctttcagttttggtgacttcagtgctgctattttatgagattttccattgtttgtgatcagtaagcaagcatgtactaatcagttggtggcactgagcatggctctttctttttagatcagactagcaaaactgcccgtgtgctgcaacgggtgaaaaattccaatgacaatatatgtttttcataaataaccatgtgaataataatgtttgtgttgattgttgtagctaagacatatcataaggaaaaatagaacatcttccattctttgcccaaaagaattggattattcatgtgacagcatacatataggccatgtttagattccaacttttttttttaaacttccaacttttccgtcacatcgaacttttctacacacacaagtttccaacttttccgtcacatcattctaatttcaaccaaacttccaattttatcggtggatctaaacacagccataatctaaaatactctttcaatcctattcttgcaataaaaaatatgattaatcaaaatcctacactgccttgcatggtaaagtctaaaaaaaatagagccaccgtgcactcttctctaaatatcaatttaaaacatattttccttttaatattatttccatataatatgttataaagaatagtagctatagtagtatgataatttataggagaatagatgagaaaacaaaagccgtgaaggagatggaaaaaatcgatggatcctatcagacataaacgtccatcaatttgatcttgtgctcataaaaaaaaggcccaaacaagacttgtcttagttccagatgttagaacattcaaccaacgctttgaaaaaaccaaaccgacatggtagattatggacgatacaaatgtcacgaatctttttcatggaatcagatgtattttttctaaattcggacttttttttgcattgcacagtgccgaaccagtttttttcttttaataaacagtggtgtttttctcgcgttgagtcacatggttttttcaaagctgttcttttataaatagtgatgtttttcacgcgtaatcatacggatttctcacgaaaaggtggttttttcctcgcattgagtcggatggttttattatcttttttataaaggtgttttactcatttttataagggcttttttttctcgcgcggtttatataaacttcgacatctttaggtggattttaatatatgataatttgaatgaataaaaaaagtaattcgaaaggagaaaattgaattcgcttttacatttccaaatctactttgacggtttttatggaatcaggcattttttttaacgttgcacaggaactttttttttccattaacctttttttggaggaccggcttatacatactatttttaagaatctaatagaaatatttttttcctttttttaggaagatggaaacccttttttcacacttttttttaatcggacagaaaaaattcgcgcttgcttttttttggcacggacgccgggatattttttttaatcggacggaaatatttttgagggcagctagcccacgggatactttggaaaagtgaagtcacgggacaatttttacgtatgatcaattagcgtacaacatgttatacctaaggtactaggtatcacaagtatcaggtaccaggtgtcgaaggtatcaggtaccaggtatcacatgtaccaagtgccaggtatcacaggtaccaggtgccaggtatcaggtatcacgtgtcacaggtattaggtaccagatgtcacaggtatcaggtaccaggtatcacatgtaccaagtgccagatatcacaggtaccaggtgccaggtattaggtatcatgtgtcacaggtatcaggtaccaggtatcacagatatcaggtagcagctgtcacaggtaccaggtaccatgcaactggtaccatactggtatcagcatagcggcggaaaagcgaacaccagtcaaaaagagaaaaaaaataaaatctatgttacataatatcattgtgtcaattaatttacacgacatactaaatctcaatgtgtctcactcaagaaaagaaacaaagcaagaaaaggagaaaacgaaaaattaaaaatgaccgtggtatatagaagatgtaagtcaagcctacagaggtgcatgcccaaattgattcacatggcctaagtgcccaaccaatatacctagagttcttgtgctgcaggaagaacacatacaagtggatgtgttgtggagtatagacctgccacgtagtaggaaattgtgtcacatgcgtgtacaattattttgatggaaataacgtagaccttttaaggcatcccgttcccgttatctagattttctgatattttttcacactcttttcgcctttttttagcccttgttttttgggtacagaaatctttctttcctttttaatggaaaatggaaatcctttcttgcatttcctctttcaatcggacagaaaaagtttttcgcactttttttttggcgcacatatgacggaaatttctctaattttttaagtagtataatagatagataatagatagatatagatatagataaggatagagatttttttaataggacagaaaaaaattcgcgcttgctttttttttggcacggacgacaggatattttttttaatcggacggaaatattttttcacacttttttcaccctttttttagcccttgttttttccgtacagaaatatttctttatttttttaacggaaaacggaaatccttttttgcacttcctttttcaatcggacagaaaaagtttttcacacttttttcggcgcacggacgacggaaatttctctaattttttaagtagtacagatatggtgtttcctgcatgatccttagctgccaatcccctgttgcggtggctatagatcactgcaacgatcccatttcccaccttcaacagcgacgccgatctagagctccgtcaaccctggccggtcatttccagttatgaactttctcatgccatggctaatcatcaacctatcattgtttgcaatttgctggttgtaaagagatggaagatcatttgtgctggaatatcattttttggctatgaagattcatcatacaccatcaggtgctatgctgactactatttgtgatagaagaagacattgatgtggggggaaacagagaagtcctgaatcaaggaggtaggaggtggagcaaatctattttggagctaggcatgtcttttttttttaatcagatggccaagtcacctaggatgagaggagctcatactatgcgagtttaatgttgactgctcaaatttatctattaccacttttaggattaaaacattagtattgtgaaggaaaacaagaaatgatatttatttcatgccattcttttatatccgtttacaaccttacatgaagctaaaaaaaaacatggtttatattatcaattacactatagcgtttagcacggtgaattgtttggtttgtattatcaattacaccgtagcgtttagcacgggtatattactagttcctgctaaaatgcctctgcacactactacataacgcatcttgtcatgccttattaatccttaactaacatgctatcagtagctttgaatttgctattgtgctattctattttttttcttttttaaaacaatcctgaaacattggttttcacctctgagaaagtccctttcggaagtatataatatttgcttatgttgtcttttatgtaagatgatggctctcctagttgatttgtattagcctgaatatgagtaggctaataattagctatagatattattattttaatatatagttccaacggtatggctttgtgaattcctgcctatgtagctactgtccaggtctcggcggaacccagagcctagtcggtttgtgttggcaacgggtaatactgcccgtgtgcacatatcttaactaattaaaagattggtatttttccaatcgtcacctcaattttcgttcatcccttcgtccgcaagatgcgatagccacgactccgcttcttccgtttattatccgattgtatttaggtagggcaatcggagtgggaaatccgccgcacggccttgcggggaagaagaaaggaattggggaagagggaataaatcagattgaaatttcccccaaaatttccaaaattagtaaccctaattcgattgtatgaccgaatgcatgaaaacccaaatcaaattcaaatcttatcttatcttaatctaatttttcgtccgtcccccagaaaagatcacagttgaaatttcatcacacaaatagacggagaaaggaaaaactgaagcatatatacacaaatatatcccaaaattgccatgcaactagatcgaaggagaaggtgccacagaaccgcagccggctcccttcccgttggatccggcggaggggagggtgccgccgccgctgggacgccggtgggccgccgtcggctcccctccctcctcccgctggatccggcggagggaagggcaccgcccctgtccgccgcctcccctcccgccggaagggagggcgctgccgcccgctacggtcgagccctcccacggccccatggcgagggagagaaggcgagaggcggagagacgccgccgcccgtcgccgctcgcagaaggagcgccgccgacgccgaggagtagcttgccggccgctgctccctagcccgtcgtagaccgctgctcgccaggcagccttggcatggcgtcgcatgtagagggagagggagagaggaggcgccatggtggggtcgtaggtagagggagagcatggctgagccgctggctcggaggaagggcaccgccggctctagggagcggggcatttaactatttgccacttttagatgtggcaattaactatttgctacacctatctcaatgacatgtgggtccacatgtgtctatgatatatgggtccaatggcaaatagttaattgacacatctaaaagtggtatatagttcaatatctcctagggagcggcgcctccgtggggagagaaagggacggagacggagggctgaggagagaagaagaaaaagagaagataagagaaaaggatgagcggtggaggagagaaaaatgaggagattagaatgggtggaagaatcaaggcgcaccgtgcacgacgctctctctcggtctctcctctctctctccccgagcggttattgctaactaagctgtcaacagattttagtggcctgcatcatgcgatttttttggtcgtcacatattctttgagatgtgtgcttggatcggcccaagtgtggcaaggtgacgtgggctctgtaggggcagagtcaattgggctccgcaagactgttcaattttgatttttgtgcgtcccttataaatttaccatttttaaacgttattaaaaaatggcactaaaaaatataaaaataccactagaattatcattcgagtgacatccttgtaaaaattaaaaaaccgatagcaaatttacaaatgcctcttaagaaaaccatttataacttagtactttatttataaaagcggtatatcttatcttaactacttaaaaaaataataatttttcgttcgccacctaattttttcgttcgtaaatccatttttcgaccgtacgcacatttgtgttagcgttcgtccttcgttcctttctcgcaatccgatttgagcgatgcaaccagccaaggtgctactaaaacgaagggaaaaacaaggatggattcgatctggacccagaatcggaccagtaaccacaataaaatcagcttgaatggaaccatgagattgcaatacaataaaatcgatcaatcacctggtactttgcatcggcactgggcactggccacctgctcgtcgccacgccttctccacgatgcctccggcccctatgtcttcgtcgtcgagacgcgccacacacgacatcacgagcagcgtcctcaccatcagagtgcctgcctcagtccccgccgccacgtcgcacgcgtcgtccgctctggggatctggctccagatacccagagcgaaataccccttttacaaaacataattaattattttacctgcactaattaattattttaattagtgtgggttgtcgttgaggcacgccacgcacgacatcacgagcagcacccttgccatcagagcgcctgcctcagtcgccgccgccgccacgtcgcacgtgtcgtccgctctgggtatctggctcccgtctccccgataagctggtctcccacctccttctcttacaccgtggcatcagctaactccgcatggaagctttgccgtcatcactccaccaagtcgccctcacatctctcgcttagaccagtgcaacgtgcaacacgagctagctggcttcgctttggtcgtgggtctccatcgtcgccggggctcactagagacacgaacgacatgagtacgtcgctcatggctgtgttgtgatgtcattgctgttgctccgggtggtcgccatcatggactcatggttcactcacttgaatcagaaaagtaagggctaatgggcctttttttttttgacaacttctttaagggctcatatcatgaaaaactaaaatcctaataacctaatatttttgtatttgttatatttttattttacccgttgcatctatttattaaaatgtttaaataataaaaaaattctcgatcggtcccctcttctctgtttttctctttgttcctgtctgctctttttttttaaaattttttttcccctcactgtctaatcgtctttcattttttttcatgtctactaattaatatttgacttcaaatataatttgtaactcaaaacaatactcactctcacaaaaataaaaagattgatttttacgatttgttaaactccacacattttatttcagataacatacacaggtatattcccatagtttcttgtggtgaaaccagtcaatctggattcaaatctttgatttgacacgtgtgcttgaggcttccgtggtgacttcgtcaatctcaatgctcgtgttgtgagagcgtttatgtgtttcttaaaaaaatatatattctcgaaattcaaagtacatcgagtacaaaaattccactcgtattttatcagacttacctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggatgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacaggccgccaggagcaaattaaacacacgcatctgttgatttattaatcaacacgtatatgcagactggaattaatctactaattgctttctattgcatgtacacatgtgccgttcgattcctgtttccatgtatgacggttgatgtgctccgccggctacctccgataatggcgtcataccgaaagaacatcgagttagcagttagttgccggggcttatacatgttgcatggcgcgtcgccggctatcacccacgatccagcctcactgctcgacttgagtttttcgtttcaatttgttatcaataatcaatatatattagattgatttctaaactcagattaatttcttgctattttttgttgttgttcgcatataattacgcggcactactgaggcgaacgatgttggtcatggactcaaggcatctcagctttccggtcaatcggccgcgagtccactccgccggcttgtcctcgccaccgccattgctgatatcaacaacgacttcaccgccggcttgcctccatcgccgccgactggtgtctccgcctacacggctggcctattatgccgccgttgttgggcgtctacgacttcaccgccggcccgcctccgtcgccgccgagtggtgcctccgcctacacggctggcctattatgccgccgctgttgggcgtctacgacttcaccgccggcttgccaccgtcacggccgactggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgagccgattcctagcacccgggggctcgttggatggaccgagtaacgcaaggtgctaagtattattcggaataaatcaaaagcatagagataagataaatttattttctgctcttaataattgcaaaagtacctgagtagtaaattctaatccgtgaaactttgttccattaatgacgaactcatgtcactcatatgcatgtttgggaagtgcctaggccgactcccgatgcttggggactatgactagtcgggcagagtgtttaaacgtaaggagtcatctgctcgaggaaatcacaattgacaagagaagaaatacatatttataaacattttaaaatgcttgattttttctcgagtattatatttatatcagatactactcatcctatatgtttgttctgcaggatccagatccagatatgcataaaagagattcatggctttaagcttatctcttacgctccaggaatggatcagtcagaacatcatcaccggctcgcctcgaccgcggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgtcgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacatcttcactgaccggcttgccttcgccgccgccgactggtgtttccgcctgcacggctggcctttatgccgccgttgttgggcgtctacgtcttcaccgaccggtttgccttcgccgctgccgactggtgtttccgcctgcacggctggcctttatgccgccgttgttgggcgtctacgtcttcaccgaccggccgcctcgtccgccgccgactggtacttccgcctgcacggctgacttattatgccaccgttgttgggcgtctacgtcttcaccgaccggccgcctcgaccgccgccgactggtgtcaccgcctgcacggctggcctgttataacgccagctgatgctatcttcttcacggctggctacatcgctgtcactactaataggcatcagtatcttcaacacaagctgtctacgtctgctgctgactagtgccctcacctctacgtctggtttagacagctaccactactgatgaacatcatcgtcttccgtcgccgactggttatgctgccgccgactagtgcttttatcttcacaactgcgcgtcttcactaccagtttgcttctgtcacttcatcacggcaacacaactttgtcatcatggtggagcgacttcatctttattatcttcggtaccagcaaactctattgctgctacttcgcaagttttgctacttcaccaaccacgacgtctttgtgagcttcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttggacaacaacatcaactctcctccaagtgaagcatctacaacagctataacattaatttgctggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtagtcgtcaactacacaactttatcgctgagcgccttcatattcattgctggctgacttgactgccgccgactggtttcttcgcctccgtggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatctttaatttggatttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatactttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagatcatggcaaagatgattgaagcactcggctttggaataatctagttcgggagaagattatctttttgactgtgaaggtctcaggggctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacacctacctaaaaaataaatatttccgttcgtcatacaaattttcatccgttgccaattgggcaaagacaatcgcattgttcatccatccattttctcccaagctacaaattatccaaactaaacaccatatatattccgcaaatatagagcagattatttatctaaaaacaaataattttttagcagattagttatctaaaccaaacaacactttttgggtcactgtacacatcccgcaatcacccggtgcaacgcacggacacttttgctagtctaacctaacataacctacttacaaaatcttaatcttaactgtaattttctgctcgtcacttgtccatttcgtccgtgtgtaatttcgttcgtctgtccgcgagatcgagagaccacgcgtcgctcccgtcccgcacgcacgtacagaagaacaaatccaatccatatgagccaagaaatatgaacggaaatagagaaactgaatcacaaaatcacaaatacaacaacaatgaatcaaatatccaaaaaactaaatccgaagaactaaatcaccggtgtcactgctcatcggaggccaagcacgcccatgccctgaggctgtggcggcttggcaggcgcaccgccacgtgccgcgaggagggtgctgccacagagccacttctagagaagaggatgatgccaccgagaatagggcgtcgcccgccagggaaggagctccgctagggaaggcgccgtgcgagggcgccatgagtcgtggcagcgggggagggggagcaggagcagtggcgctgccggcaggggtgggacagtgtgaccggaaaagttgccggtgggaaggagctccgctggccgtggggagggcgccgcggctgaagtgcccgctgcaaaggttagtgcgccgctcgccggggaaggcgtcatgcgagggcaccgtgggcccttgcgaaaggggagagggagtgggagcggcggcgcttctagtgtgggtgga

SEQ ID NO: 81849 - DNA, 13983 bp, Oryza sativa
tatttgtgatttttaattttttttaccatggactgctcatttgttgctctatgcaatgaactggacacagagttgctgttgcattttttttttggaacaattcacaaccctgttgtattatccatgtacaactaaatgtggtgttgacctgtagtttaggggttcagagtgaatgcacgtgcttaggccgttcaaagcctcacattataacactcacacaagctgaaaaaaatgggaggcaaaatcacacaaagctgaacaaaatgggggcaaaattacaataaccaccaagggtatatatgtccttttctctacaactaacaccgttagttgtggctgttaggaatgggggtacatggctgcttcagattcaaaaggtgggggtaaaagtgcaaaccctaaaaagtggaggtaaaacagcaattggcttcgaaagtgagggcacggatgcaattgccccaatatatatacctaaagcaatttgatgagtcttaattataaatgtaaatgggaatcaaatctcgggattatttttgataaattatttgaggcttactcagttttgaaggaattttaacgcataggaataggaaaaatgaagaaatagaaatacatgcacactttaactcataggaatttttcaagaagtttgaggggatgaaaaatttcctacgtttacaacttgtagaaaagaaatttttttcctttggttttcctatacttacattcctacaaacagaataatacttataggaatcaattaatccttcagaatccaaatccgcttctcccgttctctgcgactccacctcccgattacctacctcgcatgacagctgtgcgatgcgatcgatcagagaggatcgtagcagccgtgccctcccgggcagctgtccgttcgctcattttctgcaatggaccaatggcgcatccggcaaacacgactctcccctccctgtgcgtgtatgggagcgcagcagcggcggcacgcgggtgcgtcggccggtagggatgcaagtgggtagtcctgctacccgcttgctagttcatttcccacatggtagtacaaaatttagaaaaaaaaagaattagaagtgagataagtgggctaaaataacccgcttgcatccctatcggccggccaacagcgcatcacgcggggctacggcctgttggcaagttacacataagtattagcagggtatttaggtatgttttcaattttctattttaacagtaaattgctgtatcagattgtactgttgtattgtagtgagtgaaaagcattgatgttggtttgatcaatgagttaattcccaacagtaggagatctgacagctagtaaagaaatttgtttgtttccaacaaacaaggaagtatagtgagtggaccatttcagagtgtggagtgagaaaaggagtagttcaatgagttcgttgacaagagtaggagagtgagttgataggtatacaaactcaatactagcaacttgtgtcgtatcgtttgttaccaaagagagatttatgttgtgcagttgactcgagccaatacatacctagcaataagaaagtcaatataccatacctagcaataagaaagtcaatggcggccgtattctgaaatcgttggataagttattgggcttcctcttttgtacatggcgaagcggccgtctaatcgaatttactaggagacttgtatctcatgctaattattcactctttcaatgttgtctttaagacattgagctttcctatgtctgagaagagatgccatactaataggctggccaagcaaagcctaggttaatttaggtgaaataatttttactttgtcactattattttaggagatatgaattttaaaatttatattctagaaagtaccatttattccttaggtagtcgtttgcaatacttttaagagatagttttgtcaaattttactctatagcactaaagagcatagttttctaagatcaacccaactggtctcataatcttttaggcttatacgaatttcttatgcattgtacaaatcgtagtgtacatcaagtgaatggtatgcaatacagaatttcaaatgtgttttctgcacataaggtgccaaattttagtttctagtaatgaagggggtaattttctttgtccattaaaactgcgttcatagtttttggtacttatgtgaatttcctacatatattacaagttatgatccatattacgttgctacataaaattttgaaatgatttatcgtacttcatgtttggctcacccatttcaagacaggattgaaattctatgaattttacagcttatgcagttcattatggtaatatcttaatactaaaaaaaatagtaccattttctgtgcagaaagttgcatgtaaatctactgaaatatggcacacgttagatggatttaatatgaattttctggagggaactacaaatcgggtgcccaattcccttaaaaaaaatatcgggcggtcaaatgtttccgttaactatcgagcgaaacattaagttatataatgtgaaacaaaaaaaatccaattgaaacatttgaaaaaatttgtggaacacagtgaaaacacatgttgaaaaatactgttatcacatatgaaacaatgagttttaacactttgaaacaaatgtatttctttcatgggattatagtcatgcgatatatttttaattacaatagatacgacggtgtgattggatcgtagatcagataatagtttagaagagaagattgctatatgctaattgcatgtatgaatggagtagagaaagcaaatagttttagttcgttagttttatgaaacacattgaaaacacatgctaaaacatatcactatagcttatgaaataatgagttttaacggtttggaacaaatgtttcttttcatcagaacataaccatttgttatcttgttataaaaatttaattataatgaacataatcgtataatcggattgtaatgggattagtttaagagaaaatatattttaaagattgtaaatggaatgaataaagcaagacgatagcttattgttaggttggagctagcggccgataaaattttctccgtcggtctactgatccatagctttctcctattttccgcatatttttgaagtttattctcttttcagttgaacaaataatggtttaacaattttcctcgaattttccagattttaaatctgcggcaacatgtcttcttgcatctaggcccctgggtttccaaagaatagatcccacggtccccacatgtgttaagcaaagttcttgcatgattggccttgagtaaggcctgaaatgggacttgagtgcttacgattgggcttgctttcactcccacttgtacattactagatgtgattaagttaagcttgagtttggtcatgccaagtaattctaaatctcgatgttctctatagaattgccattaatagtaacttttatttagctctagtcattttcgtttttctcctggtcaacaagatttttgatcttaacaaataaaaattgataagattttggtcttgacagagtggcaccacaaaaggagtcctcgcatacgtaatcttacaaaaatgaatgaatccaagatttattacttctcttcagaacattcatcaccggtctgaaaatgtgttaggaactgatgaacatgcatgactaaggtctgcaattatcttttttttttagagaacacaaaccaaaactatctcgacaatagctgtcagactcattctcaaacattcagagttcaggtagactaaacttgtaggctgatttaacaggaaagtctttttcttctcgaggggatgtcccatatgcatttcatcttttttatttttaaaaaatattaatatataatatattactccataaacatataatttcaaattcaatcactacaagttgctttaaaaaataagactgaacatacacgtaccagttatagtttaattcgtctttttacaacttgtagaggttgaaattaatgttacaagtttgtgaagtgatatatttttctatcttactatttttctaaaaaaatcatatgttatttgaatgatatacaagaaatgaggggacattctcttgaggagaaaagtcatctctgcctgaatactgcacctcttgatgtagaggctaaaataatctctattattgaaaaaaagtagactgaaattattttccagaattttccaacatcacattgatcttatttgtagtcttaagaaagaacataatctgcagagtacataaatgcacatggagtctatgcagtggaccttgactggcatggagagtctttaggaaaatgccagaccacttgagtgactcactgcagcaatacacaggcagttatttcctcacctgaaagtaagcatgttgccaatgccactatcctcgagatcacattcaagcctaaccactccgctagaaagacaacctaaaagcaagctaggtaactactactgtctgcacaaatgagaaagatagctgaaccatcaggacagaacacacacacacagagacatacatgtggtgtttggatcagggactaaattttagtccctattacatcggatgtttggacactaattagaagtattaaacgtagactaataataaaactaattgcataaatgagagataattcacgaaacaaatttttaagtctaattaatccataattagtacatgtttactgtagcatcacataggctaatcatggattgattaggctcaatagatccatctcgcaaattagtccagagttatgaatgggttttatcattagtctacgtttaatacttctaattagtgttcaaacattcgatgtgagagggtcatatctacactacaacttattccattcttcaattttgtattttctcggctgtgtttcagaatattctccagtcaccatcttgtatacatgaggccggggactctgttccaatatagtttttttttgtcaattccgaaccttatttcttagcatacatgtagtggtcaccgagtgagatggatggataccagaaccgacatgcatcactatactactcaagtatgtaacttaccatgttttatctctcatgatacataactgggtaaaacacaacgtatgctacactagacctataagatgaatcaggagggaacattgttcatttgtgttggcgtctttttcagccaacaaaaagtcacctaaagatttaaggtgatctagatgatagggaatcaccaaaactggctagcggagccgatttattgattaaaaccggactctaagttgatttagatcgatttgagggtatacacctacaaaatgaacgaattacacccgcaaaatgaacgaattaaaaagtttacgagataaacatataaaggatgtcacactctcgtaaaaaagatgaacgatctaggcgcaaattaacaaagataaactaggattaaaaaactaggtaaaaggtaaagaaagaacggaattggtgttcaccttttaccaaataatttttaatattacagagtcatcttgtttcagccagcaacataagctgcagaggagcaggtggggcatgtgcagtgtgctgcctaattaaaatcacatcttaaagcattgtactaccaagtgtcaaacacaaacatgccgtttatcctaagcgaagcactactgttcactttcaggcctcataactgtgccagtgacgacaacagatgaatttgagcagtgctggttgcaccagatctgaccaccagcgccatttgagccatggaaacaacctcattcctttcaatttggtacacacacgcatacgcgttcagcgttaggggcataagcgtaataagccgatgcgcgtcatcgggccgagcctgacgcctctgggaagataactattgtcagtgacagctggatcattgctcactacacaaagctagcccagatgaaagcagcagcagcagcagcagcagcaggtagcatatctgcagtgtaaagggggagacttgacctgagatcagatgagatgagatgagatgatcttttctctgtgcttaatttatccccccctttggtttgctcttctgtccttccctctcaaagtaagcagcatcagatgcaaggggtgacaccaaaggctggcacacattctcttctctcccctttttttttcctctctgctttctttcttctagcttccttctccaacattccaaatggtgatgctctgatgacctcctggctagcttctacacacactccaagaatcctctccagtgatgtagtatataaacctcatgaggggctaatcccttgtttgcatcaggggatccatctgaataattgatactggctattaagtcagtgattatttctgtactgtgctattactgatcgatgcaaatgcccttctgcccgaagctctggagctcggcggcgccggcgccggtgcagccggggagcgtggtcatcaatggcacggtggtcgtcgccaaccacttcggcctctcggctcccggcaagtccaccaccctccgcctcttcagcggcacggaggtcgatcacggtgagtaagtggcgtatgcaactaatgtctgaaactctgaatccgatcagcgctgaaagtctgaaaagaattgcagagacgaggaaggggaggctgagcgcggaggcggcgttgaggggagggaagaagacgaggcatgggaaggcgagcacgacgatgtaccaggtgacgttcttcgtcgacggcgagttcgggacgccgggcgccgtggccgtcaagaacgggaaccggaacgaccagttcttcctccggcacgtccggctggacctcgccgaggaccggagcatccacttcgactgcaactcctgggtctacccctataagaagaccacctccgaccgcgtcttcttcatcaacacggtaaacacaactaattccctgcaaaccgtaatactccatccgttttatattataatttattttgattttttctataatcaaacttatttaaatttgattaagtttatagaaaaatataatagtaatttcaacataacaaatatattgtcaaaatatttcaatgctaaatttaataaattaatttggtgttttagatgctactaagttttctataagttttgtcaaacttaaaaagtttaattaggaaaaaaaataaaataacttataatatgaaatggagcaagtatactacgatgacagagtctaagttgtttgaccgattttattccctataagatatacggcaaaactcatgcccttctggtttcaaaaaatacaatgagatgtcgcgtacagctaaattgatttttttttcactgaactgataatgatcgaaatgtttttcttttatgatataacgagtttaagttgaactgacctatcattctgcagagctacctgccagataagacgccagaggcgctgcggctgttacgggaggaggagctcagaagcctgagagggaatgggcgcggggagaggaaggactgggagcgcatctatgacttcgactactataacgacctcggcaaccctgacaacgatgaccatgtccgccccgtcctcggtggcaccaagacccacccctaccctcgccgctgccgcaccggccgccccctcagcaagaccggtacttccacacaaaactcatctccaagtctccaaaatttctttcttagctaataaatagtacccgccgatgataatgttgatgagtagtagaatactatcagtagagagtaccatatcagtagagagtatcataaaaggtagtcaactaattgagcatatgaaaatattttgtggaagacggggtgacggagacgcggaagcacaagctgataaacctggactactacatcccgccggacgagcggttcagcccggggaagctggcggaggtgctggcgatgggggtgcaggcggtgacccacttcgtcatcccggaggcccgctccatcttccacggcgacgtcgtcaacttcaagtccacggagcagctgcgcgccgacctctacggcaagccgccgcagccggcggcggacgccagggtcatggacgagctcaagtcctccgtgccgtcgcacaagacgtacaagcaggtttccaggattgtcaaggacaaccccgccaagttccccacccctcaagtcatccactgtacgtactgcgtctgtgccagtacgccatggcattgcagcttcttgatgatctcgcgcgattgaatttttttttttgggggaattttgcagatgacactgaggcgtggaggagcgacgaggagttcgcgagggagatgctggcagggctcaacccggtggtgatcaagcggctggaggtaagaacagctgaaaatgttttgacatgtttgatgagctatgttgatgtgtgattcgtgctttacaagtggatatatgtttttaatcattttttcatagtattaaatatgggttcgtgtctaactcttcgactttcacaaggtgtttcctccaaacaagagcaagataaccacggacgatatcatgacccagattggaggtctgaccattcaacaggtatgtgcatccacgattctagatgaaccgaagatctaccgttccaaaatcatctatagaccgttctttgtaccttttttaagattacaccgtagacacacgcacacacacgcaatgccacactcacacctccgcaaatgaaagcacacctgcatgtatgtaatattcgtgggcatcaggatttgaaccctggtagagtcatacatccacgagtataccaccacaccactagtatgtacgtaatatttgtgggcatcaggatttgaaccctggtagagtcatacacccacgactctaccaccacaccactaatgctgcccctaaaacttagtatcttaacttcttaagtagtagttatttttattagtgtaaaattatattcctcgagatactttctgtcaagtatgtaccgggataccgccaaatttctcttatattatgttctctaatatgtttggtttcatctattttcatttggcaggcgatggagcagaaacggatgtacatcctggaccaccacgactacctgatgccatacctccggcggataaacacggagggggtgtgcgtgtacgcgtcgcgcacgctgctcttcctcagggacgacggcgccctccggcccgtcgccatcgagctcagcttgcccgacggcggcgtcggcggcagcgagatcagcagggtgttcctcccggcgagccagggcaccgatgcgcacctttggcacctcgccaagactcatgtcgccgtcaacgattctgggtaccatcagctcatcagccactggtgagtagggcacacgcctcgatcaatcagttttcagtactgtcggggtgaaatctttgcaaccttatgtcttaaaatttcagttgcaaatttgctatgttatatagactccctcgactttatacagtttgcagttgtgccactaacacgtgggccccactttacaatgacccacgtgttagtggcaaaactataaattgtacgaaatcaggggatttatttccgtggtttatttggttttaaaccattttatgagtttttgagtgcttctgtccaaacatccccttttgtgatcaagttttgcagtgctcggtccaagatttcggccgagtttacttccaaactttttttttttcaaatttttaactttttcatcatattaaaactttcctacacacacaaacttccaacttttcttgtcacatcattccaatttcaaccaaacttccaattttggcgtgaactaaacacacccttcattgtttctgaaagactgaaactccgaattctcatctcaaattcttgttccgaaacaagaaattgctcatctgcaattctttctgtaacaagacatttctctgaatgctgatatggaattattcttgttctgagacgagtcatttgtctgaattctgacatgaaattcttcttgttctgaagcaaggcatttctctgaattctgatatgaaattcttcttgttctgaaacaagacaattctctgaatgcttgctgacatgaaattcttcttgttctgaaaacaaaatatttgacttgaccataaaaatatgcaccgtcttaatccatgaatggaacaggctgttcacgcacgcgacagtggagccgttcatcatcgcgacgaggaggcagctgagcgcgatgcacccgatccacaagctcctggacccgcacttcaaggacaacatgcagatcaacaccttggccaggagcatactgctcaacgccggtggcctcctggagaagaccatgtacccggggaagtactccatggagatgtcctccgatatctatgcccattggaggttcaccgagcagtccctgcctaatgatctcatcaagaggtacaaaatacaatcaattcatcatcccaattcctacattgccaatgaatagaaccacaaattcttaatttactgcatgtctgaatttttagttacttctcggtgagatcaacggctttcgatccgcctagccacttcaattttacaattgcggcgtacacattaatgtcccgtagcaacacacttggtatcatttggtgcattttatgatagccaaatatttgacaacaagattcaaataaaattttaaaaattccatgaatcaactgtatattaataaaaaatcttacataaattctgggaatgttaaaagttcgaatatattgttgttttaaacgtaaaataattttgactagagagagtagaattgatttgagaatttattgttaactaaaacatttccaaccagggggatggcgtccagggaccccaaggcgcgcggcggcgtgtccctccacatcgaggactacccgtacgccgtcgacggcatcgacgtgtggctcgccatcgagggctgggtgcgcagctactgcgaccacttctaccacgccgacgcggcggtggccggcgacgccgagctgcaggcgtggtgggacgacgtccgccgcgtgggccacggcgaccggcagggcgacgccgcgtgctggctggacctcgacaccgtcgcgggcctcgtcgagacgctgtcgacgctcatctggaccgcgtcggcgctgcacgccgccgtcaacttcggccagtacggctacgccgggtacccgccgaaccggccgacgcggtgccggcggttcgtgccgctcccggggtcgccggagatggcgcagctggaggccgacccgggccggttcttcctggagacggtgcccgaccggttcacggcgacgctggggatcgcgctgatcgaggtgctgtccaaccacacctccgacgaggtgtacctcgggcagcgcgcgacgtcgacgtggacggacgacggcgaggtgctgctgctgctggacaggttccgcgacgagctccggcgggtggagaagagggtggaggagaggaacaaggaccccaggctcgtcaaccggaggggccccgtgagggtgccgtacacgctgctctacccggacgccggcgacgtcgccggcaaggagaaggggatcaccgggagagggatacccaacagcgtctccatctgacacgattcatcatccttcttctcttatacttcatctatccgactcgactcgacgcgtgtggaatgtaaagttctctgcttttctttttctttcttttcgtttgagagttttggtgttggggatgtgaaattgagattgattggttggtttggattggagaattgatgagcaaactgtgatgcagaattcaatacatgtaattattgttctaatccaaaagcccggtaaagaaaacacggtcgatggatataggccgatctctcttcagaactgctcagtaaagattctttccaaagtgcttgcaacacggctgcaaagggtactcccgatgatgatacatttagaccaaacgggtttcctcaaagggagatgcatctatgagaatcttatatatgcgacggaattgattcaagcatgctacagaaggaagtgccaaactattattgtaaagcttgatttcgcgaaggcgtttgattccgtcatttggtcaagccttttcaagattcttgctgtcagatgtttcccagaaaactggattagctggattaaggggttgctttcctcctccaagtctgcagtgcttcttaatggagtccctggaagatggattcgctgcaagaagggccttcgacaaggcgaccccctatctccatatttgtttgtcttagttgctgatgtgctacaaagattgcttgaaagaaatactgaaatcagacatgcaatctaccaagacaggctgtgtaccaccatccagtatgcggatgatacattgattatctgttgtgcggaggaggctgatgttcttgctctaaaggagactctgctgcagttctccaaggcaactggactgcaaatcaattttgctaaaagcactatgattactctaaatgtcgatcaaagcaaggaactagttttgtcggattgctacagtgcaagctggagaaatttccgatgtcttatcttggacttcccttatcaattcacaaactgtccgcagctgacttgtagcctctggttaacaaggttgatggtttcttatctggttggtaagcatctctcctattgcaggcggagcgtcttgttctgataaacgcagtcctgagcagcctaccggtgtatgcaatgtgtgccttcaaacttccaccaaaaattatagaagaaattgatagacgaagaagggcttttctctggacaggggatgatgtctgctcgggagcaaaatgtctggtttcttgggaatcagtttgcaagccaaaagaacatgggggacttggtattaagaacttaaagattcagaacgaggcacttcttctcaaacgactccttgctctttacaacttgaagacctcctggactcgatgggtctgggacgaaatttcagattcctcgttactgtgctcaactcgtctagggcatcactgggcatcctttcaaaagttgttgccagaactgcgatctttgacggaagtcgtggtaggaaatggtgagcgaacctccttttggtacgacaaatggttttcgactgaaagcttttcaagtcagttcagcaatctcttctcccatgtgtgtgacagacaaatctaagtaaaggaagctcttcacataggaatttctgaaaatcttgttccacgtttatctgaaactgcatcggcagagctgtgctgcttacaggaattgctgcagaacttctctccgagcgaggagatggatttccgcctcagtgcaaagctaggaaagttgacaactaagaaattctatgaggcaagattacccccaggcatgccatctccgaactgggatcttatttggaagtgcagagcacctctaaaagttaaactcttcgcatggctactggtccgtaatcgcctgtccacaaaagaaaatttgctgaagaaaaccattgttcaggaggcaatctgtgacatctgcaatcaggaagatgaaacagctaatcatatgtgtttctcatgtccgttcgctcaggctttctggacgcagatcaacgttcgaccgcaagctcaagacgtcacgcagttccatcgttcgggtccaactcgcaagtgccggcgctacactggcaggtcttcttccagctttgcatgtgggctatttggaatcatcgacacgatgttgttttccgggggaaaagcccctcactaagagcctgcctacaacgatgcatcaccgaggcagctctctgggcagagaacttaacggaagatgatcgatttgtaatctctgtttggaaacaaatcttctcctcccccttacaatctatcaatcttttgtaatgaacttcttacttctaattgcaatgacaaattcag

SEQ ID NO: 81850 - DNA, 2204 bp, Oryza sativa
ctacgatctgctggctacctatcgggaagagctattgagatcagtgctaggcaaagtatttgaactggacactaaagagtgcaatggtgatgtctgctttaggaggttctttgttgctcttaaaccctgtatcgatgggttttttggaaggatgtaggccttacattgctatggactccactcacttgactggaaggtccagaggccagttggcttcggctgttgcaattgatggtcataacaggctatttccagtggcatatggggtgattgagacagaatctaaggaaagctggacttggtttgttcagaatgtgaagaaagctattggtactccaaaaggtatgtctattcttaaagttgtttcttgcatcctccatcatttcaattcatatttgactaaccacctactatactcgtactgtaggtttggtcattagtacggatgcagacaaaggaatagaaagtgctgtagatgatgtttatccaggagtggaacatagagaatgtatgaggcacctctggaagaccatggaaaagaagttccatggccctctatttgcccaaaatatgtgggcggctgccaaaagcttcacaaatgagaagttcacataccacataggcaagatagaggagaagtgtcttgaagcactttcttggttggatgacaatcatccatacatttggagtagaagcaagttttctaacgagtgcaaggtagattacatcaataataatctttctgaatgtttcaatagttgggtctcaagaaccaaggatcgacggattgtggacatgtatgatgcaataagatagatgatcataaccaagtttgttgcaagaaacaactttgctggtaagatggagggaagaatcattccagctattacaaagtctttgaatgctcaaagcaagaatatcaaggaccatgaggtattgatatgtggagctgggacagctgaagtaactgtgggcaccattaggcatgccgtacatttggagcaacaaacatgttcttgtagggtttggcaagtgactagaatgcctcgcagtcatgctttagcattcattgcaaagcttagcacggatgtccatatggatgattttgtggatgattgcttctccgttgagaagttcaagaaggcatatgcaaggactttcaatccaatgacatcgaaggatagatgggcacatgttgatctaggctacaaaatcaagaagcctagtgtaggatcgagatgtcgactagagggggggtgaataggaaatttaaaactaaataacacctaatcaaatctaacctaagttgctaggcttggtgagggagaactctaactaagcaactaagttatgttttgcaaacctagggtgatagtggctcaaatatatctctaggaaagtaaatcacgctcttatgtcgatgttttgcaatcctagggtgatatgatctcaagtgtgtctctagaaaagtaaatcgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactcggggtagttcttccttcactccgaaggtggtgaactccaaaccactcacaaaccggcgccgggcctcctccacaatcttctcggagaggtcaccgggcaactcctccacaagccgtctaggagacggcaacctccaagagtaacaagcaatgacccggtgtggagatgatcaagtgccacactagctctacaatggaagcaaatgcactagactcttggctaaacaaccctctaacacactagatagatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggccggtcagaccgacatggg

SEQ ID NO: 81851 - DNA, 8176 bp, Oryza sativa
tcatggtttaaaccaaaattcgaatcacacattttgtcagaatggacacgtgtcaactatccgaatggttgggtctaggaacctcatctgcgtttgtatgcatgcgcaatgaacctccattagcacacgtctcaaaccatttgaatggtttgggcccaggaacctcatgcgtgtttgtctgcgtgcggatgagatcgggatgaatgcttatgagagaaaaatccaacaacattgagaatctaaatgataaaaaatggaatgaaaaggaaacacatatggatatggacctatgaattgctcacctctccttcatagtttgtgatgtcaagttgcaaaatatgtccatgctccgattcataatttgtacatgattattctatcaacactccacaagacgaaagcctattctgcgtagttcaaccttcttgtttttaagcaatgcatagtcatgctagattgcaagggatatatatgtgaagggtattttggtaatctcttctagtgttgtaatcaagtatgtgccccattgggctaatttcatttgcaacaattcattcatataatgtaattgatttgtaatattggtatatatttcaattgaatttctatgtatccttaaaatgaataatacgatttgtcaaaaaagacatgtgtcgaccatctaaaggatttgggccagggaacctcacatgcgcttgtatgcgtgcgcaaaccacctttgccaacatggtttgttgatgggtcagtagtcaagtatgggctgataacgggccttttggcatgttttgtgtttttacttcttttgggtttggtttgtctctttgtatttcgaattcaacaactttctgtgcacaaaaacccacaaacttctgtctgtttgcttggctctagcccattttgaagagtttaagccctccaaatatgtctaggttgtgtaccaaaacaagtccatggacattgtgacgaggacatcctccactattaactgctagtaaagacgcaacaaagggccaagtggtccagttgtactcgggcggcgaccgtgtgagtctctgaataatcccaccttgcttagcttgggaggagaaagccaccttaaaaggaagagtcacccttcccctattggactagtctttcaggaagagattaggcctttccccgagtgggtgttcaactgttggggttcgggcaaccttaattttattgggcctcggccaaccctacctaggccggagcgatcatttggtatcagacttaaaaggcaaccttaattttattgggcctcggccaaccctacctgggccggagcgatcatttggtatcagacttaaaagggagagccaccctttctctattagactagtctttcagggagattggttctttggtttgtcacagctaatatgttatgctttagcacaataaaaaatcctaaactttatcagaaaggaaaaggagattgggtagatgtgtgatgtgtctaagaagagaggggtagaaagccaacaacaagagcatctaaatggacaagtaaaaaggaggactagaggtggttcaattatcgattacttaaaatatccgtagtggtgatggtgaagctaacatagacacgtgatctattaaccgtggatcaaaaaatcggacgctgcagagcgacgcactcctcctccgcaccaccatcgcgcgactcctccgtacatgaccccacttttccgttcctactgcagctcgtttttcctattttatagtttccaaccgacgtggtttataattttgatcatacaacagtgaaatttggtaagccccgaggaaactgtcggcctaaaataaatatcggcttcagagttttggaattggccgatgggagttctcaagtcgccaggagtcggattcttggaggattcggttaaggaagtctatccagaagagaccgacttcaagaaggatgcggcatggcggtttatgtattaattatgaagagtttgttagtttccttttatctttaggaaagtgtgtttagtgtccaataaggacttcatgttttccttttatctttatgaaagtttttttcttgtccaataagggctagtatctactcatgggtataaatatatacacccggagtaattgtaaatgatctcacagattaatacaactactctcggtgcatcgccatcctctttaccgagattttacttgacgcggggttgcatcggctttcgatcttcggcgaaggggtaagtcctacgttccgccggccttggcaattgtatcggctacattggtgttgttcaaggctgcatcgctttggtctcttggatcgctctggttcggttgatattttggcctacctatttatcatatatcttagttaatctagtttggtagcttgatttacttgtatcggctgagattcactttagggtttatgccggtattggctaaatcgctttgctagattagattagctaaggtatctaccaccctgaaaatcagtcaagggcttgctggcttgattatctagatattgtgtttgttttcatacttagtgttgtatcagtacattcgacctactatgtcgtgtttagaaccataatctctagcctgcttttttattgccaataaggatttcatcggggtttcagctgatgagatatctggacgttgcatcgatttataaggagtacatacaagttggatttagccgatcgcaacaaaggttatactgtttatctaatcttgcggatttaatgacatcggacctccagccgatatatgctttaacctttggatcagtgcttattctatcatattgttagccgattggtttctactagattttattgttgtttcgttacattatcattagttgattgtctttatttacatcaagtgtcagattctacatcaaccatatagccaatagctcaaaactctatcgctatcggctagtatcgacatcgactggaattactctattggcttgtcagccgatcgactcattgatctactatttgcatattttgtgagttgtagaatcaaactaactggcacgcccgcatctcatcaatctttggacctgcactggagctaagcagatctcccaggctgttgtgttcgtcgacttaattcgcgccaacacatacccgacaccatcggccatgcgcagatttttcgtcaacactatgacatcaaatttattcattttccggagattcacataaaaaaataatcaaaggaaaagaaggagcgtgaaacatcctcgcctcctgcctacccaggccacgtgataaggcccatcaagattaggtccaatataagattagccgatcaagaatcactttccatccattgcagaactcgtcgaataccaaggctcataaacaacgccgacgctgacgccaaattcaccgaaaccaatctacgtggccaccaaacgatgtatgcattgccctcaattccgctttcactgtcactgccgcggactccaccgccactgttgccgtcactgactccgccgtccccgccattgccgtcgccgctaccaccgccccaactgtcatcttcggcgcggccgccgccttcatagatagaagcaacactgtcatcacagagatcaatcctttggtaatgaagttaagcacctagctcaatgagtccatgacatctaaggctctatgctatcttgcaatttgtactacttattgcaggcagtacattagctagctaaggttaatgcatggtactgtagattaatggttggtactgtagattaatacatggtattgtagattaaactagctatttgatcaatctttttttcaaagcatgcatgcgatgcaagaggctcttgtgtgtgtctttgtcaactgcttggacttgcaatcttttgctcatgagtgacccaacataagtatctattggtttttgaaaacaaaggtttgccttaaacagaagtagtaacaccgaactgatttacgtgcttcatagttctgaaacaccatagctggattttgcgtaataattctataacagttagcatatttgagacacaatttattgtaataaattcctgaatttccccaaatttaatcactaagtgcattaactatatcttttcagtgttatataatttccctgtacaatatagatccttgcttaattttatgtggtactcaggtcaatcaagacgccattcatgctgatatgattacaacccaaccctcgaagaaagcaaaagattcggaatgtaaggataatgcatctatttttgtctcaatctatttaataatgccaaatacttatatatatatatatatatatatatatatatatatatatatatatatatatatatatatatatatatatattatttgaatcactaacatttttggtgtttgaaatactaatgtgagctaatgtgtaactgattggcaatttaactttgcttaacaaacaaaataacgtgacagaaaaataaaaattacattctttattttctatctctggtatccgtttgtgatcgacaagctaggccatgcgtgtgtgaatgagggtatatgcacatacactatatcgatataataacaagcacagtaagatgctatactgattaatttatgtgtgcatgctcaaagtttgatgtgtatgtgcatggtatttagaaaatataattgggttctgttttgtcaaatgcgcagcaccacttcagacaatgacgcattcgtccacaacgctcgctatgccaagtggtgaacagagtcggagcaactgtcaaccaaactcaggagtggatgcaaacataatattcttatcatccggctcatattgatagtcaaatattaattaattgtctgattatatatgtaggagaaatacaactagataaaccattacatggaagtgcccgtcaaactacgaatgttttgtaagaacttattaactctacttttagacaatattctatttaatattcttttaatataataataacatctagcagctaacaaatatgtaataaggatacaatacacatatatcggatgcattaattagtgcaaaagtgtcagccatacaataatatttacaatattgtcatttccatttatattgttaattacataattgtcttcatttgtttttcttttgatggaattacatttggagagcttggtatgtaagcaatagtcggtgcatcatcatcagatgaaatatcttctgccatgattggtagtccagcctctgagagcatgttttataacataccctccaagttgagatccctcaaattcccatggaatgtcttaatacaattgttcctatgttcttgcatccaatggtgacaaaactattttttgagagaaaacggtaacaacatatggaccctttcccccctcccccaattctcactcaatccctgcattaagaaaaaaaatggtaagaacagtttatacctagactatacaaaataaatgggaagatcttggtactacaatgtgtccgtgctattttactaaactagaaggtaccccgcggcgttgctacggaacattgtagaaaaaaattagaagaatagtttgtattggaagtaaaaggattctaaagtaagacaatatgtgaatattaatttgattgtatgatagggtacacaaaagttttgttagactgaaagggaactggcatatatcaaaattatgattatttgaaagcacctagagtatttagtttggacatagtcttgacaacggaaacaggatagaccatgattacgaaaatagtaaacaacggatgtgattattcggaagcatctgcagtctttaagctgtatattatgtattgacctgcaaatttcgctggacaatgtattagaataaatcataatcggatttgcttgtatgatgaagcaaggcttccaaacatgggtgattattaatgactaatttgatttgaactattagatggatgatggattgatctaaggtgaccaaacatggtctacaatttttgcttttatctcttaaaacatccgttacaacacacgtgcctttatctagttcttgttaatttcaatcgatatgtatttgttttttccatgtaaaatgtagtgaattggtttttttagataaaaaatgagattttgagggagagacgtccatccaaaaaatttttaagaagaaattataagcgtgttggggattgaacacgggacctcgagttgaaaccatacatcccttgccactgcactatcaagtgcatctctagtaaattggttttgagataaaaaaattgtagtataattgtttttttttgttttggaaaccaatatcactactgattcaccccttgaatcggcatatgatactgaccaacattgccagttgaacaacacacaatattaatgcctaatttgatttgagctattagatggatgatggattgatctagggtgaccaaaatcaggaaatgtgtattccacagtcgtgcttcgcttaaaatttaatcagatagtcatgcattgatgacaacgtggaaagctattatgaaagagaatatttaatgctacatggtgggaggcaattgtatagtaatgcaggattacaatacaaggtaagataatttaagcctcatttagatgggctttattctcagcacttcggcccataaaaacaatgatttagtgaaaaacaatatgcaccataacacatgtaaagtaggaaaagggctcaacatatgacataccacgtttggattgcagcaaacaactttattagttatgttgttacacaaaacaacacaaacaatcccctcctctgcttacttacaactgactatcaatttctcaagccttccagaaggctctttctagcatgcggcaaaatccatcgcttagcatgtacctgtacattgataagcattgagctagaagaatcatccaaggatggcgtggaggcttagaccaccaagtatggaatgatgcataaaattagtggatcgcttgtacatcaattcacaagtgtatggacatgcagtggtgcaaaaggaaagaagcaagaaaggctaacagaaccccgcaacaaacccacaagagaacaattagagacacctaacctcgatgctttttcatgaatcatcgtgtctccagttggcatccacaatatcctttactactttgtactcctatataaactactttgcttggttcccattctctcatcgaccacaccataaattggtcacctgcttcaacatcttgatataagaaaggttgtttattatatcattattatgtacttctactaattcttgagtgttagtgtaaattgtgttagtggctatacttccaacgagaagcaatgtagtttctattcaatttacatatttttactgggaagatgaaataagttgttgtttcaagcaagtacttaactgagttattgttcatgcattacttaaaaatgtaggagtaaagaaatggcgattccaacaaaggaggaggtggagcagaatgaggaggacaatacattttcaaggttgcaattgcttgcacaacaacggcatgccatggaggaattctggaggaggagccaggaacaaatcgaggcatctgcaggcaaccatgagcatatactaccaattgactgcgtgaagaatgtcattcgaccaaagaatgatgctatgatgctatctgctgacacaccaacttttgtgacaaaactttgtgagctcttcgtgcaggagctcaccctccgtgcatgggtatgtgccaactctcacaaccgtgacatcatattaggcacagacattgctgaggcaatcaccaccactgaatcctatcactttcttggtaatgtacttcgtagccacaaggcactaggaagtactgctcctgacatagatacttctgctaggaagcatattaagctagaccaaatgacctcactctaccatcctacccaagaaatgcaggcctcacgtttagctgggtatccaccccatgttcctatatatcctccataggtcaaatgggaactcaacacaagctgtctccattcacttttatgatgcaaggagaatctcttctcaacatgaaaagagaaaaatccctagttaatgaagtgatggtatgcaccaacaagatgagcataaacaactttgatggagctactagtattgg

SEQ ID NO: 81852 - DNA, 2866 bp, Oryza sativa
catcagaaaaaaggtaaattagaggctacctatgaaaagcgattgcacataaacacacgcggcaacactatatgtttactgtaaatcatagggcaaaattatgccactatctaaccaatgaggactttacagtgcctggtatcacttatcaacggttgagttgccaaaaaggtaacttaggaatagaaaatagtaacacgaaaataggataaaagataacttaggaatagaaaatagtaacacgagaataggataaaaggtaacttaggaatagaaaatagtaacacgagaatatgataaagtaacttagggatagaaaatagtaatggttgagttaccaaaggatagcatagggatagaaaataataacacaacaaccgcaattgtattccaagttacaacaaccttttaacttcttcctggttttgtttgcagccagcccactccctcgtccagccattagatgatcacacgagctagttcaattattgctaaataccatgaaaatcaattgctcggggttagatgtgtgttttagtaagttacatcgcaggtataattacatactactttgcaaatttgttcccagcaagtcatggaatatatatggggcaattgcatccatgtccccactttgaaagccaattgttgttttgcccccattttttagggtttgcatttttacccccaccttttgaatttgaagcagccgtctacccccatttatgacagctatttggtgggtcccacattatgtgttaaagaaataccaaaagaaataaaaaaaggttttaggaattatgtaatgacacttctacccctaagggaaagtgaatggacaggattcttctcttcccgtgcgttgggactccttgagtggagtcaactcaaaaccctagctagtagtcagcagcggcagcgcacggcggggagcgcgcgcggctgtgaggcggtggcgagggagcccgcgcggcgcggaggcggcggccgaggagcgcgaggcatgggacgggaggcggcggccgaggcacgcgcgcgagggagctcgcgcggtggggaggcgacgtgcagaggcgcgggcgataggcagcgtcggcggccgtgtgaggaggcggcggcggccgccgccgcgggtgcgggaggccgcggccgagggcgtgtcccggcgcccgctcgcaggaggtatacagccgcggccagttctcttccagcgtggaggcggcctctcacaggccgagggcaagacaaggcagaaaaggggaagttgttggcaatggaggaaatcatatcaatggagctaattttgatggaagagttgcacagataatgcgattggcttgtcttgctatcttatgaaaaatagacatgaaaacttagagctagctaaatctagatgaaacttagagttagatacccagatatacttagatatacttgaactactagctagtatgcattttaatcttggggctgcattcagtacggttgctttttcgtctctctatataactttgctatttaggacgatttacctaaatgtgccacttgtgttgtgatttgtaggcctactcacagcgatttgcaattagttgttagagttgagtcttttttaagtttgccggatggaggtccaaagcaatacctctagggtaaaaccttgccaacccaaaatattgacatgcataagtatgatctgctgcaagttgttaatttcattgctgaacactacacgtggggatctaagcaatatgtgagtttgtgacgttctttggatgatggttttgttgagataaaatgatggttttgttgagataaaatccgatgaacatttgcgggagtggtttcagctcaatatagataagggggttgtgtgcattgatgccaaaatcaatgatttcaatggtccattgcaattttcacccacaaagcgtaggtttcattcttcagtaaggtctagagcatgcataagtgagattgccacaaatgagggagccaaaaaaaaagagagccacaaatgaggaagctactaatgagggagccaaaaaaaaaaaagagagccacaaatgagagagccactaatgagggagccaaaaaaaagagagccaagaattccaaaaaaaaggggtcaaatgataaggatgcagtaggcattgatgatgagggcatatactctgacaatgaattacttgtggtacatagtgatagcagctatgattctgatttgtccgaatcttccgactctgattgttctgaccctaagtttgatcctgatcaagaaattattgatgagggtgatgatgatgatgtacctgtctttgcatatgatgttcaggatccttgtattgatgttggtgtagtgttcccagatgtggatcaatgcaagttagcagttacccatcatgctatcttgaatgatcatgcttttgaaactgtcaagaaagacaagaaaaggtttagagccatttgcaaaagagcagaagagggttgcaagtggtgttttttttttgcatcaacaagccctaagtacattggatgcaaggtacttttatatgtgtatttatgaatggttattctgtttggaatttttgttcaagctgaaacatgagctattaattctttgcttgtaggtcaagacaagtggaccaaagcacacttgtggatctttcaataagtgtggtgaaacaatggtcaccactaagtgggtagctgatcgagtggtggacttgttgcgggataactcctcaaggggagcaaaggatttgcaggaggagttgaataggaagcatcagattgatatcccatatttcaaggtcttcagaggtagagagagcacttgacattataaatggaaagtgggatgacagct

SEQ ID NO: 81853 - DNA, 7162 bp, Oryza sativa
  unsure (1)..(7162): unsure at all n locations
tcacccgagcacccccgcctccagttcgaggtcatccgctgctggccccaactcccacgcaatcggccagacatctgtagctgttgctaattgcttatgttnattnnanatagtnattcatnnnntntnnncnnannagcctntnngtttagttnnnnnnnnnnncnccactgaagccattactctgctgatgctgaaaatatagtagtagttcatcgagcaaataaggtttgttttttcatgtagcttttctcgccaaaacccctcatcattctccaacttccatagccattttcctaggagagacatattcattgtctctggatcaagaatcccaagcccaccctggtcttttggtctacaagtcactggccattgcaccgaataatactttctaatcccctgatctgccacataaatcttgttctataaaaatccatcatcctttttcactcctatagcatgatgagcagtagtatgtcatggtgctctttcattcatgttgaatagagttttttttatgagcgagtcccaacttaagattaagaaaaggccatatacactgtagtatgtgttatactccctctgtttctaaatacttgatactgttaattttttttaaatatgtttgatcgttcgtcttattctaaaaatttaagtaattattaattcttttcctatcatttgattcatcgttaaatatacgtatatgtatacatatagttttacatatttcacaaaagtttttgaataagacaacggtcaaatatgtgctaaaaagtcaacggtatcaaatattttaaaagggagggattatataaataaacatgaggctatgggtcctatcttattgcttagcgaccttaaacattgatggcctgtttagttcgcgaaaagaaaatttttgggtgtcacattggacgtttgaccggatgtcggaaggagttttttttacatgaatgaaaaaactaatttcatgacttgcatggaaaccgtgagacgaatcttttgagcctaattaatccgttattagcacatatgtgttactgtagcactttatggctaatcatggactaattaggctcaaagattcgtctcgcaatttcttctctaactgtgcaattagttttttaatttatctatatttttaatgcttcatacatgtgttcaaagattcgatgtttttttgaaaaagtttttggaactgcctgaagatgcccgagtaccaaacagaaaatttgctgcgtgcatatgacgtgatcgtgcgcaaatactccagttcctaaggacctgtacgccaaagggacgtcccctccgctcccctccccagatcctctctctcgaatcgtctttgggcggccaacgcatcttcctcttcctcttcctccatctcatctcaccatcccatccacgcttctcgactcccagacgacgctgctgctgcctttcgtcaaccccccacttctccttccccgccgccgctcgccgccatggatgaggagtacgacgtgatcgtgctggggacgggcctcaaggagtgcatcctcagcggcctcctctccgtcgacggcctcaaggtacctctctcctacccaatccatccgccgcctcccgtgctcggatcggtgctccccatcgtcgtcgatccgtagatcgccccccacttcatctcatctgggcttgacgctgccgcactcggatgagctgctgccattttgatcgctgatttacttagctatgcgagcgtagcgggatggtaatttgtccgtacatcgtggctgggtaggtggtggcgccatggttgtggtggttgctttgcgtttgggggagggatcgtcagtgcgtgcctgagcttacgacttcccttatcccatttaaaagagtagcggcatagcgattttgggggatttcacaacaagatctaactaaacagatcggatgcacttttcaatgtttttgcaggtcttgcacatggataggaatgactactatggaggagattccacctcgctcaaccttaaccaggtaagcaaactgcaatgaacttaatttgaccagtacagggtctatatcttgtcgtcatatcatgtcaaggaatgcttatgttattacagagtacattatttcttttaattttttgtccttgttcactgacattgttttccacttcgctttttggaatagctgtggaagaggtttagaggggaagacaaacccccggctcatctgggctcaagcaaagattacaatgtagatatggtcccaaaggtgcaactgtcactttcccccatcataatctatcttgcttctatatttagtattagcagctaacgtacgtggctagtgaggtaccatataggtggggaacctcaaaaacagaaatcccgtgatggtgcataagttcatcttgatgagaacatttagatccttttatgttacaaatgtggttattcactggtttagaaaactatgtaatctcatgtgtataatactcaaatggaaaaaaaggtctgaaaagtaatgattgccctgatttttgtagattgtcaattagtcggatggtttattacaagcgctaccactatggttccttgagtagcgtattgctgttgcatgattatctaaagtcctctcttttttttatctccgcagtttatgatggcaaatgggacactggttaggaccctcatacacactgatgtgacaaagtatttgtcattcaaagctgtcgatggaagctatgtcttcagcaaagggaaggtaacatcttcagctcatttcctctgttttcattagcatcacatttcctctagtgttttatacttttatctaagtggttgttggatctatattctgatcttattcctatgctagcagtgtaacatgcacttttctatttttgctgtcaaccagattcacaaggtacctgctactgacatggaggctctgaagtcccctttgatgggtctttttgagaagcgcagagcaaggaacttcttcatttacgtccaagattacaatgaagctgatccaaaaacacatcaagggttggatcttactacaatgacaactagagaactgatagcgtgagtacactagtgtttcttgcactgtattcaaccctttctcagtagtgcatggcttccttttctaaatgaaacaatagatttggggcatatatactatatttatatgggatatattgttgtagacttatacatgccctaatgcatacgtgaaatgtcaaacataatgacagtgtgcgggcaccggcgcatacatgaaaccacgtaatatgaaaaaaagaaaatgtgcacttcatagcaaagagaacatccattgtatcatctgtccattgtgtagaactttagaaagggtacgatagacagacttttgcatggaatccatatgtggcacatggcagtctttacatgcgtagcaacaccctaaaacttactggtcactaatgattgctaaatttaggataactgttgatatgactgaaagatttctctggataaaattaccttggtattagaaaccagcgtacttaaatttattttttcgatctgacacgggagtacttaagatacggatgcagttacattattgaaccaagcaacacatttatgttatatgctgcatgctgtggtactgcattacaagcctactttgtgctgctcatgaaatgtagaaaccttgatatcccttttagggaaaataaagtatgaaagcagaggcatcagagcatgggttgggtatctagtgtgtcacatcaatgagattctcactgcaaaattttaatttgcgttatttttaatttgttgtgtcttgactaatgtggacccacttaaatatagattagcttctattgtaacttgtaagaagacttacatcctgatggatattcttgtcgtcttctagtagttgtgttctgacaaaaaagtagtacaaataattgccgccacagaatatatcatcaatttaccttcagtctttcacatgatgcaaaaggatatatctatgcttcttttaccttttctgcatataaataactctgtttccatttgccctttcttttccagaaaatatggtttaagtgacgataccgtggatttcatcggtcatgcacttgctcttcatagagatgatcgctaccttaatgaaccagcaattgatactgtaaaaaggatgaaagtaagtattgatcaaagctcctgtagattgttcgtagtcttctgctacggatatcctgctgttctctgaatattcatgctttatgaagttcaattacattttagtgctttatctacttgtagctatatgcagagtcccttgcacgttttcaaggaggctcaccttatatttatccactctatgggctgggtgagctgccacaggttagtgaaattttaatgttaagtaaatacctgtcatactgcatgtgcatgtttttaagatggtcatatataacgctttcttattcaaatatttcttattccacagggttttgctcgtttaagtgctgtttatggtggcacttacatgttaaataagccggactgcaaggtgtgattaccatcaaccctgtcattacttgcatctctggatgaccagacaacctaataaaactttttggcatgccatacatgatcttaggttgaatttgatatggaagggaaagtctgtggcgttacttcagaaggtgaaactgcaaaatgcaagaaagttgtttgtgatccttcatacttacctaacaaggttaattttctttcctgtattcaatttatttaccacatgaattttctttcagtatgttcatttaggattcctagatgatgtacttccatcttaacacattcacagcaaatttactattttttcttcttcccttccatttgttgagaagttttattaactacaaccacatttgatgttctgtatacatttattaacaggttaggaagatagggaaagttgcacgagcaattgctataatgagccacccaattgcaagcacaaatgactctcactcagtccagattattttgccacagaaacaacttggacgcaagtcagacatgtgaggcctttctcaatcacaaacaaatactgctcaccttatgaattattacatttgcttgcccattgcttttaacaaagtttatttattcccattttgtaacatttttattggtattctcctgttaggtatgtcttctgttgctcatacacacacaatgtcgctccaaaggggaagtttattgcatttgtatctacagaagcggaaactgacaatccacagtccgagctaaagcctggaattgatctacttggtcaagtagatgagctattttttgatatctatgatagatacgaacctgtgaatgaaccatctcttgataattgttttgtctcaactgtaagttttgcaatatctgatttttgaaatgagcattaagtttgattgtctagactgtaacatatttctggtccacactccctgcagagctatgatgccaccacacattttgagacaacggtgacagatgttcttaacatgtatacattgatcaccggaaaggtagatgtgcttccgcctttcattttctttaatctttaatacatgtaatgcttctatattttgtttgaaacacctttttttggaaaggatgaaaattagccgggaggctatagagaggactagagtaccacatatgttgtaatagcttgacttttgtgtcaccttaaattctaaatccaaatccattctgttggctattgtttgttttacaattatgtattctacccttttcctaattcttttctcattgcactattgcaggctgttgatctcagtgttgatttgagtgctgccagtgccgctgaagaatattagatttcacaaccaaagctcaatcatttcacaaagatatgctttttcttggtgggtaccgcaggacagatcgtaacgagtgactggtatagttattcaaactccacgttataccgagtgttctggccaatatggcttgttgctagcagtaatatgcacaactgttggccaagatgactgaaatgatggtggtttaatttgatacttcagtaatgcaatggtgtaaacagtgtacacactacacaatgacggtcgggcgttttgtgactgatgtatcataactgctggataattttgcatgtctacttctgcagtgttgtgttctttaccttgcattttcaggtttcagttgggtgtgcctgcctccggtatcagccggtagggtagcatgagtagattttaccgagtcatgcgaatgaaaattataatttaacagcttaacctacccagaatatcttattcctggttggattaaccaaaacttcaggacaaatttaaatgtgtttgacgtttctatttgttcttccggttctacctgggatacattctcaccgtttggttggttaccgatgaaatttgaaggcccattgtccgcttgcaaggaccgggaaatttaaactatttgccacttttacgaatggcaactcttcaaatgctatccttatggttgttcttacacaattgtcatcggagagacgtttttaataatttgctacttttgctgatgtggcatgcccctcatactgccagcgtggttttgctgtgtaaattttccgttttacccctgatgggccctacaaatcggggaaatgggaaaaggagcaagagagagaggttcaactgccgtctcatcgtcgtcgattcgctcctgtgctcgccgccgtcgcagcagtggagggaggagagcgcggtgaggtcgggtgcctggggatccgttcgtagccgctcactgcctcacgcgacgcgtaatagtggcctagaagcggaagaggacgccgtcgttggggttcagcttggccgcatcgaggaagtgctcggccaccgccgcacggagcagccttttcgtggcatccgtctcattcggtgatgcattgtccggccgatgcgccggggctagtcgactccggcgctgcacggcagtcatatatggcgctatatatgcaaaaaaaaaagaaagaaaaaaaaaggaagaagtttttgttttctctctgacgatggccgctttagtctcacaggacattgacgacatcgatggatctgatcaaa

SEQ ID NO: 81854 - DNA, 8472 bp, Oryza sativa
ggcccatctccattccgggtctctctctctctctccctctctctctttccctcgttatgccggcgcgtgccggaaccgcgcagagcgcctcctccctccagtcgctcccccctccccgcttttatcctggcgagcaccccgcccgcgaaatcggcccccgcgccccgttgttcgcgcgcgcgcgcccgcgtggtcgccgcccgtcccgcgcttgcgccgtttgagtcatccggccccgctgccttgccgcgcctgcagccgcgcagccgctcggccccgcgagccagcacgcgtgcccgagccgcgccgctcaaatcgccgcgccgcccgttgcttcccgcgcgcgcacgccgtggtggccgaccgcctggtcgctgccgccgtcagcgcttgccgcgcctgcccgcgcctgtcgcccgtgtcgccgcttcgctccacaccgcccccgccgtcatcgccgtcgtcatcgccctgcccccgccactccacgcgctcgctccatcgccgtcgtcacgcatgattatgagctataaggaggtgaatggatgattagctagcttcttgatccaatggcttaaaattgttgatgatgtggcttcttacatgtcttgttttatatgagcaaatgcttcttagtgggtaccaactatataggaagataggagtgaacccaattaattaaacaacatgcagcgagccacattatttacaaaagagtggccattggattaccattacttctaatcacagccgtgggatcagctctatgtttaacgacagccataaatgtattaattgtagcttaacatacattgagaattttattaattgtcttgctttgatttaatgtttttttcctggtgttttagaaggatttctattgcttcgggatattctgtagcgcccgttccgtcgtggcgcctagcgggaaaactatctcttaaaaaccctatttgcgaaagctgtttctttgcttgtggtctagtgtccgtgccatctcagatctcaaatccccgatctatcatcgaattcaatcccgaatccaaatccttccaaattaatccctccacaaaagtctatttcgcctcccccgggttcgatgggccgaatccctctcggcccatctcccttcccggctctctctctctctctccctctctctctctccctcgctctgcccgcgcgtgccggaaccgcgccgagcgcctcctccctcccgtcgctcccccctccccgcctctatcctggcgagcaccccgcccgcgaaatcggcccccgcgcgccgttgttcgcgcgcgcgcgcccgcgtggtcgccgcccgtgccgcgcttgcgccgtctgcgtcatccggccccgctgccctgccgcgcctgcagccgcgcagccgctcggccccgcgagccagcacgcgtgcccgagccgcgccgctcaaatcgccgcgccgcccgttgcttcccgcgcgcgcacgccgtggtggccgaccgcctggtcgctgccgccgtcagcgcctgccgcgcctgcccgcgcctgtcgcccgtgtcgccgcttcgctccacaccgcccccgccgtcatcgccgtcgtcatcgccctgcccccgccactccacgcgctagcctccaagggacggaggcagagctcctcctccctctgccgcgtcgcccccgctcccctcctccttttcccaaagaggcaaggggcaagccccctttctctccctccttttccccttttcctcccgccggcgtcatcctccctccgccctgtcgccgatttggccgctagccggagcgccagctcgctggcttgaccgtccaaagtcggttcccctctcccaaaccgacattgccatcctataaagcccaagcgccctccctctcttctcctctcgtttgtcccatcgcctccactccattgtcgccgcctcccgtgctctgttcgccgtcgccgtttgtcgtcgcgcgtgtcggaggagccggcacgagcgaggacgcagaaggggactccgggcgcgccctcttcttcctcttcctcggcccgaggccgaaacgatcacgtttcgcgtcgtcggctctcgtcactgcgcccgcccgcacggtagcgcatttccccgttctccctcttcgctccatctcctccccttagactcgggtagtagcatgagtagcctccccgtagctagccggcgccgccctgacggctgccgtcgttcgccgtgtgctcgccaccgtcgccgcccgagctcggaagcgccgctcgtcgccggcctcgctcgacgccgctccgcccaatccaacgctagcatcggattcccgtagccgcgtagatgctctcgccgccgggaatcggcccctcgtgacctcgtcaccgtttcccccttcttccgccgccggttgccgccgccacaatccgccgccgtcgagcatcccccggcaaatccaagccgttggctcgactcccctcgtcccgtgcaacttcccggtgtgctcgctttcgcctagatcgccgtgtttcgctccgccgctcgccaccgccgtccgccgtccgttccggccggcgtcttcttcaacctcccgccggcccgcgtggctgccacgtagccgccacgtcggcgccagctcggccaagaccgggtcgagccgaccccggtcagccactccctctggccccgctcgcgggcgcggtccaccgtgagccgtgaggctgcgcgtgggcccgccgcatccgcgtccaccgcgaaccacgcgcatgcaccgcgccccgctccacaccctagcgccgcgccgcgtgctccctccgcacggtgagccgagccgctaacaagcgggtcccaccccggaccacgcgagatggactcggtccaccggcgccctctctctcccctcctgcgccctattgggctgtgtcctcttgggccggccgacccatttagctcggccgagccgccccttttctctcgggccgcgccctagccgcccgagggaagtctacttcccctccctcttccttttcttttttccaaaagggtttaattaaatcctttttcctttagaccaaaaatccattaatcttagaaaattcaatatcttctcaaccgtaagtccgtttgactccgttcaacttccaaatttcctcaaatctcgagatctatctaatggcacgcttagggggtcattaatggggctttattttcgccgtttgttgagtcgtcccgttttgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcacacttaatctgcttgtcccgtctgcaaggcagattggcggacctacctaacttgttgcatctgatccttccattgttaattgttgtatcatgtccccttgtaaccatctagttgcgcctcgatattcgtgcactatgtactcctactctataataaagagacctctgttgctgtgatattctgtcttcctgtggtaccagcactgtattcctgggactggtatcgattaacaggttaatttggagcgtcacgggctagtctcgctcggggctagttcggggcgtgacatattcattctataatcaattcgatccccggccgggccaatccgcctgaaaaaaggttgtttgggtttacgtaaaggttgtttgaatttacgaaatgtttgcttggatttatgaaaagttttttttagatgtatacatgattttttttccaccgccctaaacaaaggacgggaagaagatagtgaacatatcctctaaattgatcatccgtaaaaattaggagtaaagtattgataccaatttttttagataatggaatgaaacatcccggcctttactccaaagagctatagccaattattacaaatagtaacacacttatataaagtcttaatccaaaataaaacgatcaaaccaaccaaaattaaaagaaagacctaacatgacaaggaaaacattattccagcctattagagaatctccatccatgattagcaaaagattgcataaccgttgactcaagagtacgacatgcaacattcaggaaaactccctcttcctcacacttttgtagttgaccccagagctgaagtcaatatgttgtcctgaaaattacctacacataggaaacagatggtgatttgtcaataaccctatcaaccaattatgaggaaagttttaataatgagtgtttgcagaacgccgccggttcattttgttttttcaacagaatcttcaggtgtatttggtttttaagagtgatgaaatctgtttcgtagtcataagaggttcacaggtcggctgtttggttttaaaaagaacaggggtatttggttttaaaagaacaggttctttatttttctttttttaaaatacagtacaaacacaggtaccctatcttaacgtgcggcaaccactgaaaatccatctggatcccatctctcaacgtgtggcaaccactgatccatctggatccattggtggtcgttcatcctgctgatcagttgagtcgccagaatgaaacaaaaatggtttgatgttttttagttagtggccggctgcggacactagttcatgcttgcataaattattatccttaatgcttccatgaccagctaatcctaactctctactttagggcacccacaatgattatctataggctctctacaagagatccatgtcagcatattttcctacttggaatgtattaaatgaagagagagagcaaaactatctactaacttagagatagtctatagagaaaaacgaggcaatgcatgagagagctatagataccaatgtagacatactattaaggtggtttactattaatcgagtctattgctgagatgtacatgttttatagatagcaccttactttaccattgcgggtactcttatataagcctcgcactgtcgcccatacagcgagttggttgtggcatgtgtaccttcacttcagagggagcttgaaggaggcacactttgaaccttgagcctagaggtatgcaatgttgttaatactcttttttttaccacagggaagtgtgttatcctatcttagtataaagttatcccccactaactccttaaacttaacatgtaaagatgtcacatcatcatccactaacaagatgccacatcatcatccactaacaagatgctacatcatcatccactaatccactaattaacaagatgtcacatcatcattcactaacaaccatcacatttaaacatcatacaaacatgctatatctctatagtttttataatttaagaacttttcaaatacaaacatgttaaattatcatccaacataattcacataacgtttcaatgtatatttttattatgttttatgatatcctatatacttatatatttcatccttacttagtgcttaaatggttaatctatggtccaaattatctttcttcttttttttctctcattaaggcatatcatatcaattgtttttagcctttagatgattaatctacggtccaaactatctccctactttttaagtcatatcacatcaagtgtttttagcctttagatgattaatctacggtccaaactatctccctacttttcttcttccataaagtcataccaccttactttttacatttggatcaccattctacatactatttaaatttaaattatcataaaccacattaatttacttaatctgatgttatctagctatcttacacgttattttgttattgttatcatactaaattcccgcagcaatgcgcggggtttcacctagttatatatatcacaaacactttgggagtaataattaaagaagaagttagcatacataattgatagagaagaaaatgatgagaaaacctgtgctcaagaggatttgagcttaggccaatgcattactgctagcagctgcctatcagttgagctaggcaccgttctcaacagagttatactaaacggatcatactaccagaaacttgttaatccgtaacggattcttggtgatggattcataaaccgtcgctgacagcggcaatccgtgacgataatcttttttccgtcatggacgtgcaccagtggttattcttggcccgctaactcatgatggttttatccagatcgtcacagtgtgtgattttaaaatcttcacagtgtgaagataatcaaaaggcatttcaaaacttgttttgcttgaaaaggatttgaatttgaggttcaaatgaattttttaaaaaatgaaaaactacactctctcttgggccatttctggctgtcctgcagccccacatggccacacccacactctctccttctcttgggctcggcccagcctccctcttacgctttcccccttcagctgggcccggcccattttccgcatgggctagccgcaggccacctgcgccttgtaaaaaaaaagagacaaaattgtgtagctctttaggggattcgaacaccctcaaccaaaagcacaatatccctaaggatccaccactgaaacacaagtgtttggccataggacaagcactttgctttatatatatcaaacgttagcaggtaatggactcctgctcgtgggattcatcataaaattcacaagaaaaccagcaggttttttcttttcaatcgctggctaaaacttgtaggtagtctttctccctcgtactaacttcaaattagattattattttttctaaaattttctaaattaatgatctatcaatttattgtgttattacaactattattttttttcatactttcatgtgactttgttttatcaattgaagatctaaatttcaaaagtgtcaacttcaaacgatattttgaagcagtaaatgatttcatttgaaaaagtcatgaacacaaaagttgtagaactgatcgagatctacaatttttattttggtcatttattcatttgacaaaatgatagtaacattgtttacacaatttacacatctatcttataatttatgaaaccatatgggagatatgtaaaatttatgaacaatgttactattactttgtcggatgaacaaatgaccaaaataaattttgtagatttagatggattatacaactttgttattgattacttttttagttgaagtcattcactaataaaaaattctatttgaattctcaaactttgaatttcaaatttcaaattattcaaatagagtcagatggagaaatgaccaaaataaaaattttgcatctcgatgagttctacaactttggttttggtgacttttccatttgaaatcatttattaacaccaatttttgttcatgtggttatgctagttcaatgaccgcatgttactagaaaatatttttatcaatggtagtaagtatcggtgcatttacatgggctattaatattgtatccatcctaaaatatacggtgtattagttttgtacaatatcttctacattatactttgaatattaatttcttcaataatatattatcaacaactacgaaattaacatcatcataagtatgaaagattatggaaaacaaatataaagatatgacatgcatatgcatatttccttttctgctacttcctatatactatcaatttcatatttgtaaatttagaattcgtaaataaaaggttgtattacgatgaggttttttcttgttctaaccatttggagattatattctaattagcaaattcaaatttgtattctcaattataggttttcatgttttagttgttctgaaatttgaaataagtatcatgttgtacgtacttaactacttatctagtcccagttagtttcttttctattttaatatttctcaaaatcaacataaataattagcaggttataaatgacatggactcataacaaagaaatataaatttatttttcttgataacataatttctaaaattgtgcaaatttataaatataatgttatgctctatgtatgtagagtatcaattttagttttcaaggtttagcaattccaaaaattcagaagtaaaaatactaagttgtacccatcttggattataatctttctcatttaattctgaaatcctaaaataataattagtaggccgtaacttacatcgacgatcctttttatttaggccgttatatttcggtccaccaaaatagatggccagatttattctagttctaacattcaaaactaacaattatcaagttgtaactgtcacattcccctcttaatttaagttattataattcagtcatacaaaggtggattgtcagatttattcactatttatcctgttaacgtgagaattttctcggagtaccctagtatatgtataatcttgagaaatatatccatttatttgtctgcagagctagcatg

SEQ ID NO: 81855 - DNA, 2888 bp, Oryza sativa
acggcgttctgcgagcggagggccggctcgtcgtcgctgtcgccgccccgctccagatcccggagggtcgaggggaagacgaagggcggcgccatctcgtcgcggcctcggcggagtcgcgacggcagcaggacgacggcggcggcactgggtggatggggtggcgggcagggaggaagccgagacgggatggggaaagggggagagagagaggagagagggggtgggacccacaccagatggccagccgtcctggctggccaactttggctagtgaggtggggaatttagccagccggatggcttggagagccatttagctagtctgttggagtagatttttttgtccaagttagctaaattttggcttggagagccatttagctaggctcttggaggtgctctcagtgaagtcactttcccgaccattccttctacatgctagaggtctctgtctcaaaatataatataaaatgtaatagaatctaaaatacccgtaagaattggtttggtaatctaaaatacccgtaagaaccaaccgacaggtttggaactcgtttttttggacggaaggagtaaaacaattagaaaatctagaactttgattattgcaaggttgaaaaaaaagaccaggatgtacagtagtgcagtcaagtcagaggagtgttctctagctctagccggcaatgaaatgtgttccgagtcatagcagtaatttgctccgaaatgggagtacgtagatcggaataaaatagctaggaatatcatttgttccttcgtgaaaatcttgagcaaaattaagtccatggcggcgaccacgcttgcttgctgtttctcttcctccatggatctctcctgcagcgcacggctgatgccgttgaggatacgatcacggcgagccggccgctatcaggcaaccagaagttggtatctcggggtgaaaagttcgcgctaggattcttccggtcaggtaagctaattaacactgaaacgctgcgcgttactgcagaagtttagtactccagaagtaagtaataagtagacataatgagtaagatagatatatggtagtataagtttacatgagttgatatggtttatgttaatttaaatagtatagagaataatgatttaaatgtaaaaataaggtgatgtgattgtataagataaaaaaaggtgaaagataatttgaaccatagattatctaagagataaaaacaattgaggtgatatggttcagtgagagaagaaaataaggaagaaaatttggaccatatattaatcatcgaagagttaaaaacaattgatatggtattgcttaatggggaacatgaggaagacaatttggattataaattaatcatttaagagataaaaacaattgatgtgatatggcttaacgagagaagagagaaataacatcaactaagtgaggatgcactatatatgtatcaatataggatattataaaaaatagagtgatatattaaaatattatgtgaattatgtgagatgatgtaacatgctagtattttaaagctttaaaatttaataaattgtagaattaatagataatatagcatgttgcatgatgtttaagatgcatgctataaaagtgtttcaattaggaatataattataatatatttttttcatttgaaatataattatatgatatcttattgtgaaaatttaattgcagcggatacaatgatacaatcaaatcatgtatctaataaatagtttagaagaaaatatattataaaatttgcttacaactttgttaattagatgtagaaaaaaaatacaaaatacatagtacattgttagagcacgtgcactacgtgagggaaacagcacgtcagcacatccatttttcttttgtcatccatcgaatgtccgacttgtagccatccccatgaacttgcattcaacgggccaaggcctaacccatgctggttctttctttttttttaatatgtccgcttgttgtcccctaactttacgtcgagtttgtttaacatcctttatcgccaataccaaaaatcttcacctctaaactattcaaaatcatgcgatttagatcccatagtagtatggatgcctggtttcgctaatgtggtgtcctagttcaaaaaaaatgtgggactcacatttaagtaaaaaatagggggctcgcgtatcagtgtcctcttcttcattctcttttcttcccaagcttagaagggagggggaggtggctgatgggagattgagagggaggggcagttggtgagcctggaaggaaggaggaggcggccggcggaagagcggggctctgcgtccctagaagcctgcaagtccaccagctctacgtcctcggccattgcgcctttgtcatccctgagcgggaacagcaggtccgtgatccggagtttcctcacaagtgccgaagttcggccgaagctggtgcgccacagcgtcggagacggcatcgctgactccgcgagacacggcggcaaggggaggagccacctgctgggaagagctaccaccaacatcacccacaagctggtctcagctattgaggatctcgaagacgcgagcgatgttgtaccactagggctcgccgccgttcgtgttgtgcccccggcaatgtccactgcggttgttgttgtggtggcggcgcttggttaggatgagatggaacaaggtaggaaggggttgctgtaactgaactccacctcacggtcggcaccgcgcaagtcatagacagcgagcactgggtcgaaagcacggcacaagaacggtgggggaaacgcttgatgcagcctccccctccctcccaggctcgctagccgcctctcccccatcccccatctcccgtcggtctcttccccctccccaat

SEQ ID NO: 81856 - DNA, 2610 bp, Oryza sativa
aaggaatggcttcaggtccttttgcataaagctaattttacaattcttttcacaagcctaaaacctagcatagactgatcaaattttagtaccagtgttcactttaaacaacgacggttctgtcaaccatccattgtgatcccaaggatagcttcccgccattgaatcgtcatggttttctgaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcaaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgcagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcgtgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcactcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttataaacaaaacaatttcgcaattgggatcaacatgttcaaggaatagtgatgacttgccttgctcaggataatccttattattgctataatcttgatcaaccttcacctcctggaagttgcagacgttgcctcacgactaaccgatacacaaggtctataatacgcgagaaaaaccaatattcaaacaacaatcaaatatgcgcaataaaatgtactattcgtgtttgctaatggatcccaatcatgctaaggctaaagtttcttaatctttctattgtcatcgtggcctatttaggagttaaccaacatagcatttatgggatacatatatatttggctaatcagtggtttagtctatcaaatggctatggaaggattttggctatgtatgcatctatctaaataggacggttatatactagaggttctgttgctagatggatttaggatcaatcaaacaattacagtgaatcatttgtattatttattttattaatggaagctttactttaattatgaacatattttacttgccattataaattataaaagggctaataattatccatgctctatatgttaaattcgggaagtttataatattatatttacagattatctcttaatgaacaatccggatttacaattgactatgaacatatgaggtcaagatttataattagtacttatctactattcatgtttgttatatactccccagtttaatatatgaaaaagataaattgattgtataactataatgggatgtacaatatgtgtgcaacaacgtataaggttttggtcgcctactgtacatgagcttatttagaaagtgtactacccaatgctccaagtgattcctaaatatattgtagtttaattatacattagctagtttctatgagtgatattgtatatgtgatgcgacaagtttaagcactggttctattgggttactaataagtggtaatcaatttaggcgtatatatgctattctatatggtattgcatcgattaatttacttagcgattcctccacatctagctctgttatgattctcctgaacaggttaaagagtcatctatgtgtgtttatattttagttagataatcataaggctatacttgatttaaataacctataagccatggatttaattatatggccatcgaatattaaataagtactagtattttcctatacatccattaatttgaaggattgattataactaaattactaccaatattaatctaatctgatcaagaaacatatttttataattaactcggaacttcgaccgaaatactattacgctcgaggaatttccaaaaataatctatgattaatcccgaccatttttatttcctaaatcctcctaatttcttatttatttccttttcctttttttttccttcttttttt

SEQ ID NO: 81857 - DNA, 1807 bp, Oryza sativa
ggctttgagggttccaaaattaattaaaatatcctaatgtggccattattattacaatagcacattgaatgaacttatttgtataataatgtattttacgtggatctagtaattcggtaaatataaattgagactcggtacaatattaatctaattgtctaattaaacactcacatattcttatttatatataaagcttaatttatttatgaccattattttatatgagtgattttcatgtcatgagtaactcggtgaaatgttctaagtatcaatctatatatattccggtgaattacttatttataaacacgatcattatagtggtgatcatcatttcatgtgttcttatatttcatgtgagattcgattcaaatgaataagatttaatcttactatttctttagctaattgtgacatcaagctatcaatcatggttcgaatatttaatacctgatttgtaatttgtaatagaaattaatatttgacttaactatcttgtgcataattatttgtaggattaacgatattatattctcgtaaatttatctattacttaaattttagacccttactttactttctttgtgatcatttacggtttggcaagcaatagcaatcataacaaccagcatgatgcaaaagttttaaaaagttcaaaattttagtgatttttattgtcttgaattttcaggatgttacagcaccattcctggatcataatcaccccctcaaaaaccagaggcatggactccccagcgacccccgtgggcttatctccgccacttctcggtctggtgctccgcaatgaaccatgttattcaaaaggtaaaagccgttgcccacggtggcttgtggttggcccgattaatgtttctctatagtagctcgatcaccggttcttaattgtcataagcactactatccaaaccatgggttcaatacccaccattatccagttttagttggcaagtatattaattagccaatcacgattgaccatcgtgaactatcattaagccatcattaaatagtaatgagtcataagttatcccaatagtgtgctaatgtttttaagcatggctaagcaactataaataacatctagctgaaccaatccaatatataaggtccatgctagtcaaattataacccataggaaaataaagtcatcttcggccataattaaatgggaaaggctcaccacccaatgatattcgaaaatgtcacaccctgaaaattcaaaatatataaattgttgtttaattggaatttttagaaataattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggctgaaagtcggcccaaaatcccttctctctctcctcggcccagccggcccagtccgcagccgcagccgcccgcccgcgcgagcgcgctgtcgctgacaggtgggtcccacctgtcaggatcgtcgtcctcctccggccgtaaccctagtttcgcgccgccgccgccgctttccaatccggccgttcctttccgtttccggccaaatcaattgaggggaaacaatctccgggatctcctctaccttttctcctttggaaacttcggctaaatcggtttggaatgagtttgattcgagttcgaatcg

SEQ ID NO: 81858 - DNA, 6631 bp, Oryza sativa
cccacgagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttattctaagcataattttgaggatgtgttttagagtcgttttgggacgcgacactgcttcagaaagatgtgaagtacaagtggtcggaagaatgtgagcagagtttccaagagttgaagaatcacttaatattagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtaattcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggttattgcaatgctacagaaggacgacagttgccattggaattatgcaaggaatttgaaagattaaatttgggaattgtcagtagaggtttcgttgccgccttagaagcgaagcccactctaattgatcaagttagagaagcccaaattaatgatcctgatattcaagagatcaagaagaatatgagaagaggaaaagctatcggtttcttgaaggatgagcaaggaactgtatggttgggcgagagaatctgtgtccccgacaacaaagatttaaaagatgcaattctgaaaaaagctcatgataccttatactctattcaccctggtagtacaaaaatgtaccaggatctcaaggaaagattttggtgtgcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggccatgactctatttgggtgatagtcgatagacttacaaaagtagctcatttcattccggtaaagacaacctattccggaagtcggttagcggaattgtatatggcaaggatcgtgtgtttgcatggcgtccctaagaaaatagtgtctgatcgaggcagtcagtttacttcaaatttttggaagaaactttaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtctacagatggctccgtacgaagcactgtatggtcggaagtgtcgcactccgtacgaggttgcctatcagttagagttacctcaatctttggcaggagtccataatgtgttccatgtgtcgcaattgaagaagtgtttaagggtacctaccgaagaagctaatcttgaacagatagaagtccaagaggatctgacctatgttgaaaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcaccagttcttccgaatctcgaggacgagattctgtttaaggggggtaggtttgtcacaccctgaaaattcaaaatatataaattgttgtttaattggaatttttagaaataattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaaccctcctgtcaggatcgtcgtcctcctccggccgtacacctagtttcgcgccgccgccgccgctttccaatccggccgttcctttccgtttccggccgaatcaattgaggggaaacaatctccgggatctcctctaccttttctcctttggaaacttcggctaaatcggtttggaatgagtttgattcgagttcgaatcggatcggctttcctctcttcgagcccgatctttccttctcgtcgccggccgccgtgggccttcgccgctgccttcgagcccctttaaaaggacccccgagctcttctctacccgccgccacccttgccttcgcctctcgtcgtcggaaacgctctagcgccgtgtgccctagctttgccgtcgtcgccgccgctccagccgtgcgccgccgtcgtttcagccgtcgctgtcgctcgggaagaccgccgttgtgctcgccaagtcgtcgccgtcctcgtccgccgcttcgccaccgccgaagaccgccggagcatcgccgtcaccgtcgacccgaaggttgccgccgcttcctcctcgtcgccgtcgtcgtccgttgttcttccgccgccgttttggtcaccggtgagttcgccacgtcgtcctctacatgctggtgccctccgtttgtgccgaagtgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaacctgacgcccgtgcgcccggttcatatgaaaccctaagctgcgctgacgcaataaaccttcttttccttttcaaaaataattcattattgcgtcataattcaatttaaaccgatataagtgttttaatccgatttaatccttaacaattcataactaattcatcttagctccgatttagttggttcaagtctctattgggataacttatgattcattattgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcgtttgtatagcatagttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtatagtggtacatctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagaagcggcggcgaccttcggcttgacgacggcgacggtgctccggcggtcaacagcgacggcggaggggcggacgagaacggcggtgacttggcgaccacgatggcgacctccccgagcgacggcgacggctggagcgacggcgaagcacggctggaccgacggcgacgacggcggctcgaggttacacggcgctagggctcttccgatggcgagaggcgaaagcaaaggtggcgacgggtagaggagacaccggggatccttttataggggttgaaagacgacggcgaaggcccacggcgaccggcgacgcgaaggaaacctcgggctcggagagagagaccgatccgaatcgacctcgaatcaaacactttccaagcgattttagccgatgattccaaaagagaaaaggtagaggagatcccgaagattgtttcccctcaattgatttcaccggagaaggaaagatgcaaccaaatttggaaggagacgacggcgcggctcggctagggtttcgggcggcggccgctggaggttgacgacgaccccgacaggcgggacccacctgtcagcgaccagacgcgcgcgcgaggcggctgcggactggactgggccgacttgggccggggagagagagagagagggttttgggccgactttcggcccaaagccaaaagagactttttaaaaacattttttaatttaaattattcctgaaatgcaattccatttattaaaaatacttccttagctcaaataaatcctagaaaaatctaggaattatagaattaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtaggcgacggaggagagagagagcgacggcgcgagctcgattccggcagggagacggtgcggcaagggcggaaacgggcgagggaggcgcggggagggtttatatagggttggaagggggagagggcggccggaggggaaggaaaccggcgcggcgctctcgggctccatcaatggcgccggcgggattaggggagggtttccaaacgaatccaagggagagagggggggaa

SEQ ID NO: 81859 - DNA, 18890 bp, Oryza sativa
aggtttcgttgcagccttagaagagaagcccactctaattgatcaagttagacaagcccaaattaatgatcctgatattcaagaaatcaagaagaatatgagaagaggaaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagtatgaagcgtgaaatcgcggaatacgtagcagtatgtgatgtttgtcagcgagtcaaggcagaacatcagaaacccgccggtttgctacagcctttgaagattcccgaatggaagtgggaggaaatcggtatggatttcatcactggtctacccagaacgtcatcaggccatgactctatttgggtgatagtcgacagacttaccaaagtggctcatttcatcccagtaaagacaacttattctggaaatcggttggcggaattgtatatggcaaggattgtgtgtttgcatggcgtccctaagaaaatagtgtctgatcgaggcagtcagtttacttcaaagttttggaagaagcttcaggaagagatgggttctaagctgaactttagtactgcttatcattcgcagacagacggacaaaccgaaagggtaaatcagattttggaagacatgttgagagcttgtgctttagacttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggatggatatcctgatggaagcagaagaaaaggtgaaaatcattcaagaaagattgcgtgtggcccagtctcgtcataagagttatgccgacaatcgccgcagagatttgagttttgaagaaggagattatgtgtatcttcgtgtcacgcctcttcgaggagttcatcgtttccacactaaaggaaaattggcaccgcattttgtgggaccttataaggttgtcagtagaagaggagaggtcgcttatcagttggagttacctcaatctttggcaggagtccataatgtgttccatgtgtcgcaattgaaaaagtgtttaagggtacctactgaagaagctaatcttgaacagatagaagtccaagaggatctgacctatattgagaaaccaatccgtattttggaaatagatgagagaagaaccaggaatcgagttatccgtttttgcaaagtccaatggagtaatcactcggaagaagaatcaacttgggaacgagaagatgaattgaagtcagctcatccgcatccgttcgccagttcttccgaatttcgaggacgagattctgtttaagggggtaggtttgtcacaccctgaaaatcctaaatatacaaattgttgtttaaatggaattttcagaatttattttaaaagcctagaagagaagatctaattttaattaataaattacaatataaaatggggccagataaaatttcattaaatactttgcttaattctataattcctagatttttctgggatttatttgaactaaagaagtatttttaataaatggaattgcatttcatgaataatttaattgaaaaagttttttttaaaagtctcttttggctttgggccgaaagtcggcccagtccacagccgcagccgcccgcgcgagcgctcgctgtcgctgacaggtgggtcccacctgtcggactcgtcgtcttcctccggccgccgccgcccgaaccctagccgaaccgcgccgtcgtctccttccaaattcggccgcgcctttccttctccggtgaaatcaattgaggggaaatgtttcccgagatctcctctaccttttctcttttggaatcatcctctaaaacgctttggaaatccgtggattcgagttcgattcggatcggtctctttcctccgagccttaactttccttctcgtcgccggtcaccgtgggccttcgccgcagccttccaacccctataaaaggatccccaagcccgccgctacccgtcgccaccctcgccttcatctctcgtcgctggtagagtcctagcctcgtgagaccttgtgccgcagtcgtcgccgtcgctccagccgtgcttcgtcgttgttccagtcatcgccgtcgctcgggaaggtcgccatcgtggtcgccgtcgcgtcgccttcctcgtccaccccttcgccgtcgcggaagaccgccggagcatcgccgtcgtcgtcaagccaaaggactccgccgccttttcctcgacgccgccgccgtccgttcattttccgccgctgttttggtcatcggtgagttcgccgcgtcgctctctacgtgctggtgccctccgttcgcgtcctcgcgctgtcgttcgccggtgagcatgcgcgcccgagccgccgccggaggtgacgtcaccgctgacgtcatcgtggccgtctgccgtggcccggtcatggaccgttcgatctcggccgtccgttttggataggatcgatctcggtcgttcgtttccgtgagccgccgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcgaatttagtgggttcaagtctctaaatttttctaaaatcgagatctacatgttaaaaatacccacatgtactgttcatgcttgtttatgtgctgtttggtgattttgctcctttctgtttagattccgacgtttccggagagtccgttttcgcaggggaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataacttgactagttgggctatatatatattggttcagctagatattagatatgattgcttagccatgcttagaaacattagcacacttttgggttaacttatgattcactattatttaatgatggcttaatgatagttcacgatggtcaatcgtgattggttaattaattacttgccaactaaaacttgataatagtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggttgctggggagtccatgccttgtttataagggggtgattatgatccaggaaaggtgccctgtggtggattgtgttgtgcgaggggtattgtcacagctcctttccgaggtactgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctatacaacagggtatgttatatagcgttggattaatattgtttaattattacttaactgttttattaaattctgaaatgtttattaaatgctgtttatgcaaatgaaaccctactatgccatcctttgttatcctgtgcacttgcatatttgatgcgtgacttgctgagtatgtcatatactcaccttgcaatcattcatcagaggaagagttctacagtaaagccgatagtgtggaggattaggtgtagccctggtcaagctgtctgtggagtggagccgtctgcgccgtttatcttttttttccgctgcttagatcataattgattgagaggaattatctacctctgtaatgacattttattcgcttattaattagagtaataattgtactctattatcaatttgttattgtgtgtctcggctgattcctggacgagggttcacacacatgtaagcgtttggaattttggatagaaattccgggcgtgacagtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttttaattcttaaaacctgcttaacaactaaaatgtagaatggttggcctgggttggcttgggacgagctgggacccagggtcgggttgccagttcggtctgaatcatcgtaggccttgggttaaggcaggttcgtgtgagttcacggccttgattaataatcttgtatagctctaggactgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatgggactagggccaccagatggcgaaataatctgccagaccccttcaacaaagggaccgatctccggtcggggaggtgaagtcggcagagacaaactggggcgcggtgagtgtcatatcagacactgtcatttagatcgccactgcctggccctctcgctggcgactcgccgaaggcaatgtcacagccccaccagcgccagaggctttcgccgtcgccagttgcaatgcctggtccgaagcaacagcgttggccgaagtgctgcccccggttggcgcgtcggcatcactagcaggcagtggagacaggagcctcttttgtggaggtgggtgtcgtggcgccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttggccactcgccgagttcaaacctggcttctcttggccacgtcgcgcttccacttttttgacgtcccaacgtcgtgatcgactctcgcagggttcgcccggctggctagcgtgccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttgtcgatgtagaaccatttttgcatcgaattgcggtcccactttgccatcgacacaaggacaggccatgcatccgagcgctttggccgaagcatgaagtttacactgccaaaaacagtcttctttggccccgccagagtgttgtcgtccttggtcgccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaaggcggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctaaccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggccgaagctccctacttacccttgcccgtgaggggcttgttggaggtataccacgagggccttcggccagacctgccgaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttgctaaatctcaatataaaattgggttagataaaattttattaaatactttgcttgttcctctattttctagaattttctgggaattgtttgagcaagggaagtatttttaataaatgaaacatcatttcacgaattattttaattggaaaagtttttaaatcctcccctaagtcgttgggccgatttcggcccaactcttctcttccccgcgcggccgaatcggcccaagccggcccagccgacgccgaccgcccctcctcctcgggtcaccgacatgtggggcccacatgtcggacccatcttcctcctccagccggccggctgcaagccgagcccaagccgtcgcccgagccgccaccttgcgccctcaaatccgcatccaatccggccctttttcttccgtttgtttgaggggtttttatccccacatcctcttctatctttcccctcaagaatcggagcaaatcgttgggtattttgcccgaatcaaactcgttttcgagtttatccccaaaaaccgagtttagattttcccggagcgatttcttgcgggtggagtccgatctcttcaatccaaggctataaataggaccacctcgtcgccctctttcgtttgccccctctcccgtggtctcccgtgcatcgtagctcgccgtcgacgtcgcttagtccgccgccgccgccggccgggttgcagccgcgccgccgcgtcgctttcgccgttgccgccgcttgccgtcgccgcccgtaggtgcgccaaggggtggagaagcctggccgcccgtcccccttcgccgccggccaccggagagccgtcgccgccgttcaaccgagccgccgccgcctcttgcgtcgtcgccggccgtcgtcggttgtcgtgggacgttttggtgagtaccatcgggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatctatttaattctttttaaatgggctttaattagatttaatcttgtaaaatctataataaattcacttggagtcagaataaggccgttcaagtctcataattcatctaaaatcatgatctacatgtttgttacctttatatgtattgtttatttgggtttttattagccttttacttcgttttgcgtgttagcttgtcgtttccgtcgttgagaaggtttgtgagtgcgtcggaagtgatcaagaagattaattgaagatcgattattgcaaggcaagtcacagatcctaaacacaatcctttgagcatgttgatcctatatttaaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattatgatggatttgtatattaaattgtcagtttgtgtacctcgactgattcctggacgaggattttatgcacaaattagttcggaaattactagtgaatttccgggcgtaacaaccgtccacccaatgaaggatcaagccagaggcgtcaacttcgacaaaggcgaaggcacacggcgaaggctatgcggcgaagcatgtgggcgaagatcaagggcctggctccgagcttcgcagttcgaaagaccacatgggcaaagggtatatggcgaagggcatttagcgaagcatatggacatcacccaagacgggccctgggcggagaaggcccaatgggccactatgcgcccgggggccctttcgccatggctaggccaagcttgttggcccgttaagagcccatatatgtaaaggacacagtatgccctcaataatgtccctatcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccgccagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccggaagagttttggtatggctctagcagctcttgtattctcttctgtaatactttccgaattaatgaaatactcatttttatacatcttcggtattttgttcagtctgagtactggtcttacattatatctgtgttatattaattatgtgggtagcctaccagagaggtgtaatggtgcgggtttaatgtctggtttaccagttgctctatgtcgtgtgcgcgggtatagagtagtatttagtaatgtaagtgtggtacttagattattaaatatcattaattgggcatatatgctgcgggacagtagaggtgggccgctgatggtgatagctcagtactggtattcctccacgttagtatatattcctaagacaaattcctggggagggtactcctccgtatttagccccggttggacggccatgataggttgtcgtaaggaactgggcaacccggggtggtctctcgatgtaccaggaggacactgtaggggggtattggccatatgattgtatattagcagatgtaaactaggaattgagtgtatgttagaagtatagtaattgagtgctttctattttttcttccacttagttagaattattttattatgaggagttgaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaataggagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagcccttcgggctacccgttaccaacaaagcctgcggcgctaccatcagtgcaacgtccgggcctggtcactgcaagtcaaagaactcgtcttgtgccacgtcccaacgcgtgcaagattgagcaaactctcacccatttgggatgatgttgagggtcgttagcgatcaatttcgaccatcaatattatcaaaataaaggagaactagttatgcttgcactgcatatccatgttagaataacaatattccacaagtgttaggttcattaaccttttgcagagaacaaccataaagtggaagagaaccgatatcaactcaaacgataaattaattggacgatgtcgagaatcagacttatgtccgaatgggccaagaactcagaattgacacgatcaattgggccaaaattcacaagtctgcgaagagaagcaacagaggaggcagccagccaaaacctgggctggttgggccggcacctggttcggccgaacccccctggcgccgttggatgcagggtttcttctagacggcgtggatcactccccaatgatggttggagggcagttccgaccattccaactgccacaaccgtcattggcagcctatttaaggagctcctcttctctctccacacacgcacctcaagcaagagttctctcatattcactcaagatagtttagtagtcttaagctagtggagtaggaatagagtagaaatcggagtccggaagccttcagaagagttcgggtatggctttagtagctcttctcttctctttagtaagctttgtacttttattagaatactcttctttatacatttatggtattgaaatactttccgagtacatggatgccaactttacattatgttcatgttatactgattatactattagcttatctcggagatgcatcggtacaggtatagtgtttggttatgcaattactctatgtcatgacaatgatattagagtagtatctgttagtttaggcgtggtatctagattgggggatatcattatttggggttatatgctgcagatgagcggtgggccgctgatggtgatagctcagtacgggtattcctccgcgcgtgaatatagtcctaagttaatttcctggggagggtactcctccgtattttgccccggttgtatggtcatgatgggctgtcgtaacgaacttggcagttaggggtggcttctcgaagtactaggagggcatcggttcgagggtattagctagtatgtcagataactagaatgtatgtatactatgtatactagaagtataggaatagatttcctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctacaaaatatcctggtgaagttcatgcaaaatttcctggaaaaggaaaccacgtttcccaggaaccgttattggaacacactggtaaaacctagtgttccggccaagaagctagagcagccggcttagaagaagttgtctcccgcaccaaagccaaagaaggtgtggaagaaaaagccaaaggcgcccgctccatgacctctagagataggttgaaaatccgcgaactgaactgaaaggaggtacgatcttgcacatcggacctaaaatgacgcgaccttcgccaacaggtaaattggtatgtatctgcacatttattttcatcaacttgaatttttgcattaacacatgtttggatttcaaaaaaaaaatcgcatttaggatttttgaatttttgagcaaaccaaaataaaattttcaacgaaaatttattgtgccacgaccacattgaccgttgaaacccaacggccaaaagtgcggccggttgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaagttttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcgatggaggacgccgacgctccgcgacgtctcctgaacgacgccgacctcgatcttgtcgacgatcgggaaaga

SEQ ID NO: 81860 - DNA, 860 bp, Oryza sativa
ctggtaccctccgtttgtgccgaagtgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttcgcgtgaaccgccgcccgtgcgcccggtccaccgaaaccctagcccgctgacgcaataaaccttcttttccttttcaaaaataattcattattgcgtcataattcaatttaaaccgatataagtgttttaatccgatttaatctgtaaaaattcataactaattcatcttagctccgatttagttggttcaagtctctaattttttctaaaattgagatctacacattaaaaatatccacatgtactgttcatgcttgtttatgtgctgttttggtgattttgctcttttctgcttagattccgtcgtttttggagagtccgttttcgccggagaagagtttgaagagttccaaggccagcaaggcaagtcacacagattccaaacaacccttggagcatgttgatcccgtttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctacttagaaacattaccacactattgggataacttatgattcactattatttcatgatggcttattgataagtcacgatgggtcaatcctga

SEQ ID NO: 81861 - DNA, 15623 bp, Oryza sativa
cagtggtacacctctggccagagtaaaactattcgaatagccgtgcccgcggttatggcgagggtctaccaatgttattcgtgattagtctcacacctctcatcatgataccaaatgctataaatggtaataatttgtttagctcctggtttggaatggtatattcctggtttggtgataggactgtgcagccgggatggttgttcagaatggttgggcctatacaaattgtatagcgttggattaatattgcttaattattaactgctttattaaaatctgaaatgtttattaaatgctgtttatgcaaatgaaaccctactatgccatcctttgttatcctgtgcacttgcatatttgctgcgtgacttgctgagtatgtcatatactcaccttgcaatcaatcatcagaggaagagttctaccgtgaagccgatggggtggaggattaggtgtagccctggtcaagctgcctgtggagtggagtcgtctgcgccgtttatcttttctttccgctgcttagatctttattgattgagaggaactatctacctctgtaatgacattttattcgtttattaattagagtaagaattgtactctattatcaatttgttattgtgtgcctcggatgattcctggatgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgtatttcataatatttttttagtggttctcattcaaaatttattccagtgttattagtactgtactactggctcatttaccagcaaaagttttacaatattgttttatttaatcttgctgcaatgaaataaatttagcatgttgattttataactttcttttatttcttttgaaacctgttgttcaaaagtacaaaatttgtgaccttatttccaactatttcaacttatcctgcaagcttggtttactttatttacttaccttttactttgattttctaactttactcaaattaatccaaaaacttgtgctattaattggataaatgtcttaactccctcctttcacttgtctttagatgccgcgctacaagcctgagtacctgtttggtgttgagggttttgtccaggagttgcgtacgatgtcctttgtcattggatttgggactgcccctttttatgcccagattcctcatgatcgtcatgaagagaagtgtcgagtcaaagtcactttgaacagtaatagtgaagaggtcccctcagtaatgttcgaagctggaggaagaaactacatccatgcatgtcaggaggtggcaaggatcgccataggagagctccgcgatcgctacagtgatcagttggccgacactgagtatcgctaccatcctcgtcaaccacagggaagtgaccgtggcagttaccttgagactgaaggaattgaaaatgatgctaccacaaggcatttggttgagatgttgtgggctatggatgaaagtcgtgcggagactgtgttagcagctcaagatcgtgaagaccggaatcgtggtaagatttgcaagctcgaagacaaggtggatcgtttggagaaggaactagccgcattgaagggagaagcaccgccgcagaaggccaggattcgtctcaccgcaaggaagagagctctatttgtccctcgctaccaattggcgccaaaggttcgtgtggtggagaaagaagttgccccaaccttagcagatcctccgatcatcatcataagtgatgatgaagaagaagaatccaagcgcacccattccaagattgagtgggtagcaactcaagatgatgaagacgagcagaacgagccttcaatcgacctccgatgctcggaagaactagagtgacttgttaaatcgtggtcttagatcgttgtgttagtttgcttgctttaagtttgcttgtgtgtgggtcgcatgtgatttacatcagtggtgggatgtaattgcatgtgtttgtttgtttttgagtgttaggtgcttttgagtgttaggaagttggtgagtttagtggtgtgggagtcttcagtttgtaataataaaactcagttaagatcaataaaagttaaagtaattctctatcctaagtagtttcccccgatttctcttcttgtgccctgccagatggtgaacactcgcagcaacgggaatggccccagtaacaataacaatggagagaatcccactcttgctcaagttcttgctcaacagacacagctaatgaacatgatgatgcaacaactccagaaccagcagaaccaaggaaataatcatgtacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtctcatttgcatcacatcagttgcaaggccctgcctctgaatggtgggatcacttccgcctgaataggattactgctgaacctatcacttggcttgaattcaccgctgctttccagaagacgcatataccatcgggagtggtgtctctgaagaagaaggagttcaggtcgcttacccagggatctcgctctgttacggagtatctgcacgagttcaatcgtctggctcgttatgctccggaagatgtgcgcaatggtgaagagcgtcaggagaagtttttggaaggacttaatgatgagctttcttacccactcatgactggagattatcatgatttccagaagctagtggataaggctattcgtcaggaggacaaatacaatcgcatggagcagaagaaacgtcggattgctcaattcaagacacaacaggggaataatcagaagccgcgtcttactttaagaccccagtccatgccacatggaggttcttcgtttgttgttcgtccgcagcgtcagttcttcaacaacaatgctggcaacaacatccgcaatcaagctccacgtcctgttgcagctccaacacagcaacaacctgccaagagggagcaaggcagcaagcccgtggtgtgtttcaactgtggagacccaggacattatgctgacaagtgtccgaagccccgacgcgtgaaggttgtccctacccagagcaactctacggtaccagcatcaaaggcccgtgtcaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcatcgtagcccctctgtcagaatagaaattcaaggagtaccatttctggccaatcttatcctgttagaatccaaagacctagatgtcatcctagggatggactggttagccagacataaaggtgtgatagactgtgctaacagaaaagtaactctcaccagcaatgatggtcgagttgtgactgtttatgcattgtcttctgagtctttaaggtcaagattaaaccaaataactttggaagagattcctatagtccgggagtatcccgatgtgttcccagatgatttacctggtatgccgcctaaaagggatatagagttcagaatagatctggtaccaggaacaactccgatccataagagaccttatagaatggcagccaatgagttggcagaagtcaagaggcacgtagatgatttgcttcagaagggatacatcagaccgagttcatcaccatggggagctccagttatttttgtggaaaagaaagaccatacccagagaatgtgtgtggattatcgtgcattaaacgatgtgactatcaagaataagtatccgctacccagaattgatgatttgtttgatcagcttaaaggtgccactgttttctccaagatcgatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattccagttttctaggcctcgcaggatattatcgaaggtttatagagaatttttctaagattgctaagcccatgacacgactgcttgtcacgaccggaaataacccaacgggcgttcttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagtggaagactagggcgacgaccacaggcacttgacggtaggcacgagctagacaccaaagccttcatcttctaggggctcctcttccggggttgggaaaaattgagcaagactgagtacaaccaccgtactcaacaagacacacccacaagtgcagaataaatgcaagggagtacaaaggagttatactataaagggttagggtttgcagtaaacagcatttaaaggtatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccatggtatacagacggaagacgtgacatagtttccaacccatcctagccatagacaagagtaccgacccgatcccacctacggccggaacccccgggacaggcaggcaggactgagcccctagcagcaggacaccggccctgtgccatgacatctcgactaccgggccgcagctcgtgtagccttcatttgccctagagatgtcacccccgacttcgtccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaagccaattccacaacaaccaaaccattccaaagtgtccaggtgatatgaatattcccaaagtctagagttgtaaaccgcctaatgttacctaattaaattgcgaagcatctacctaaaattatactagtggtactatgagtagagtgtccactagttggggttttgtttattctagggtgaataaggtaataataacaataacaataataataaggtcataacaaaggtaaataggcatggctaaataaaacagtgataacgcgggaatttaaataaagcgataatgcaataatttaaatcaacctaattttgtaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaaccccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcagcagccccacggtccacggtggaccgggtgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggagcgcccgcgcccctatggtcgccggcggcggccataggcacggcggagcggcggccgagagaggggagggaagggggaagcgaaacagcggtccacggctcaccccgggtcgacggcgacgacgggaatggcgaccggagcggaggaaggcggcggcgcggctcgggttgccggggacgccggcgttccggtggtcggcgggcgaaacggagggggtgacgaggtcggcgaggtcgcggcgaacccgaaggaggcgacgccgaagcgggagaaggtccggagcgacgacggcggcggaccggagctcggcggcgacggcggagagagagagcgacggcgcgggctcgattccgacggggagagagagcggcgagtggcggaaacggtggaggaggcacggggagtgtttatatagggttgggagtgagagagggcggccggaggagaaggaaaccggcgcggcgctctcgggctccatcaatggcgccggcgagatttgcgggagcaaatccgcccgtttgaacgagagagagagagggaaaaatggggggaaagggagagggaatcacggggagtgatttccccctctttattgcgcgcggggacggcgggaggcggcgggattcgcggcggcagcggcgctagggcacgggcgaggcggcgggagcggcgcgaggtaggggatgacgggtgggccccacccgtcagcgagggtggcgggcgggcccgcccgtcagcggcgcgcgcgcgggggaaggcccgatgggcctcgggggacaggacagagacggagggagctgggccgatccggcccaataggcggagggggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttcttctaagcataattttgaggatgtgttttagagtcgttttgggacgcgacaaacctacccccgttaaacggaatctcgaccccgagattcggaagaactggcgaagagatcgggatgggctgccttcagctcgtcttcacgctcccaggtagcttcttcctcggcgtggttgctccactggaccttgcaaaaacggattacccggttcctggtcctgcgttccatggtgtccaggattttcactggcttctccacgtaggtcaagtcttcgcgaacttcaatttgctctgagtcggcctgctcggatggcactcgaaggcatttcttgagttgcaacacatggaacacatcatgcacgttgcccaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccatacaacgcttcatagggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgccacgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggttctcttcccgggcggcttcccctgccgtgctatatattcgatccccgtgcttcgctcttccgtttccgccgctcgccgctcgctctcgccgtcggtttcgtgcccgcgccgtgctcctctctctccgccgtcgccgccgacctttggttcgccgcagacgtcgctccggtcctccgcccgactcggcgacacctcaatcggcttcgcagagtggttgccgaccccgtccgccgctccgcttcgcccgccgaccgtcggagcgccgccgtcatcgtcatcacgagccgcgccgcagtctccctccgctccggccgccgttctcgtcgtcgtcgttgtcccggggtgagccgaggaccgccgttcgccttcccccttccctcctctctctcgggcgccgctccgccggccgatggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgtgggacccacggcgccggccgccgccagccgcgtgctcccggtccaccgtggaccgagaggctgacgcgtgggccccacccccgtggacccggtccgcgcgtcccctccctcggctgacgcaataaataggatttttaattaaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagccttttcttttccgttggccgtgtagacgctgcagcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcagctttgcgaagaagaagatgtcgtcaattgtttgccgaagctccggaagactgcaggatccgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacatcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattcctcccgaggtgcacaacagttgacagagcatcttttagctaatggaggtagagtgtctggtagtgaagattcagatcaagtctcctcagatgatgaagatgcgaagtctccccaaggctttaaccagaataaaatagaacttaaggcatgctctcgttgtggagaaatcggtcatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaaggtcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagctaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcagacaatgtatttccctgaaggtagtcagtgcagcttttgacgaaccacatcaaggtttcaccgaaaggcagcaagccaaaggacctcatcatccccagaagcgtccgcaatccacattcaagaataccacctgttagagataagccgaaagatgattgataaaagagattggcaaagatgttctctagcataaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcaggttaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagtta

SEQ ID NO: 81862 - DNA, 958 bp, Oryza sativa
cttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagcaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttctagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgata

SEQ ID NO: 81863 - DNA, 10136 bp, Oryza sativa
tatacatggtggcggcggcatccaaggctgatatggcggtggatttggcgaccgcgcaggcagtaaacagagagagaaaaagagatggaggatgaaggaaagaggctgacacgtggggtccacttgagggcaaaattgataattcacaccatccatcatccatgcttggcaatcggattattctgcttacgtggacaaaaaaatggtataaaattaagatttcttctctctccaatggtaaattagtatgtgtaaacttaagagaagtacttggataattgccaaacgaaaaaatggcaaatagttaagttttctaccatgggcaatggttctgacctcaataaggcttgagcgacaccacttcgtctcctttctcctccacagccgcccatttgtgcacctggcctacaccaccacttgatccatccttcctctcctctcttctcttctcttccctttgtctcctctatgctaacggcgaagtttggcctcttctccgacaaaggccgagggagctcaagcttagacggctcgccagtcgcctccctcactatcaactcgtaaacggcgcgaggtggaaaagaaagagaagaaagaagtttgacactgatatgtgggcttcacatatatttctttattttttacttctcactttacacgtgggtcatgttttttattttctttttattgattaggatgccacgtcagcgaaaccaaccatccataccaccacattcattctgccatgagatctaatttaacttggtttagggatatgattttaacttcattgcatgtggacttattcccggtcgatatcccattcgaaacatgtgttgatgcgaaaacacacacactggcctgggagatctgcttagctccagtgcagatccaagggttgatgagatgcgggtatgtcagtcagtttgatcctgcaactaacaagatatgtaaacagcagatcaagtagccgatcggttgtcaagccgatgaagtgattccagccgatgccgataccagccgatagtgatagggttttgagatatcggctatatgtttgatgtagagtctgacactagatataaataaagacaatcggctgatgataatataatataacaataataatatctagtggaaaccaatcggttaacaatatgatatgatagaacaagcactgatccgatggttaaagcatatatcggctggaggtccgatgtcataaaatccacaagattagattaaacagtgaaacctctgttgcgatcggctgaaccctacttgtatgtaatccttataagccgatgcgacgtccagataacttatcggcttgcaccccgataaaacactaacatgaacctatcggcttaacaagatttatattatcaacaacagtctagtaggttgaacctaaccgatgcagcacaagattgtatatgataatctaatactcgatgagccgatagatctgtctaatgtgatggatataacaaatctatttacaacagcattgtgattgtagagatatatcggctaagacagaagatcagacctaactgagacagttccaactaaaccgatgcgtctctaaacacaatgcagttagagatagaattgagatatcaggtaggcaaatatatcaaccaaaccagagcgatccaagagatcaatgcgatgcagccttgaacaacaccaacttagccaatagattcacctggcccggtggaacgtaggacttaccccttcgctggagatcgaactgaaccgatgcagccccacgtcaggtgccaaattccgctggttgataagtaaaacctcagaaaaaagggtggcgatgcgctgagaatagttgtattgatcgaaagattgattcacaatgaccctgggtgtacatatttatacccatggggagatactagtccttgtaggacaagaaagaaactttcctaaagataaaaggaaaagataaagtccttatcggacattgaacacaccttcctaaagacaaaaggaaaagataaactattcctaattaatagataaactgccatgccatatcctccttgaatttggactcttttagataaattttctttagttgatcgaactccatcgagaacacaacttctggcgatttgacgactctcatcggctaatgccaggactctgaagccaatactgactctaagccgatgattactctgggcttaccaaatttcactgatagcaacatgttagaccttgtttggctaattccacccacaaaggtctcaatcccctccttgtgggaataaccgaacaagaccttatatatgccataaaagagtcgcaattagggatggcaacgggactgggcagggctgagttgggctggaatggccccagccccactcctccgcgggtccatccagcccctacccccagagtggagggagatttgaaatcgatccccgccccaccctctctggggacccgccacacgacgggggcttgctgcactcgcatgcaaggatgcttggaggaggcggtgcgaccgcacgtcacgttgacgagaggagatggcgaggctgaccggcggcgggtagaggcatgcctgcgtggaggtggagtgagatggaggccgcgcgatggcggttggaggcacggtgacgggcgaaggtggcgcgacgtgggccaaccgatggcggctgtgggggatgggtgacaggagtgggggtagaggatgggggatcgaggaatttgggtttagtaaatatggctcacttattgggtcaactaagcttctattgttggaatggactactttttaagacatatctcatatccagagcccccatcggtttactcgtgtatgactaatgatcttcatccccgtccctagaaatttgcggggccccatccccagtcacccatgggtgagaacccccaccactgccccgtaggggcggcccccacgggatccctggccccaatgtgaaatttgtcaccccaagtatcaatcccgttctggcccatgggccgcacgcgactgtaatcccaagcccacaagggcccatcaggccttcttaagagctccccgcgagtccaaacccgaaacgcgaaaaaacaaaacagaaaaaaaacaaaaaaaaaacatattatttatcgagcaaatgacacaagtttatattggtggcaaccgattactttatcaagtgggtagaggcgattcctttgaagaaagttgattcgggggatgctatacaatttgtccaggagcatattatttatcgatttggtattcctcagatcattacaaccgatcaaggctcgatcttagtgtccgatgagtttgttcaagttgccaatagcatgggtattaaattgttgaattcttcaccatattatgcacaagctaatgggcaagccgaggcgtctaacaagagtttgatcaaattgattcagaggaagatttctgattatcataggcagtggcatactagattggccgaagcattgtggtcctattggatggcttgtcacggttcgatccaagttcctccttataaacttgtttatggacatgaggcggttttaccatgggaagttcgaatcagctcgaggaagacagacttacaaaatgagttggcagccgatgaatattacaatctcatggccgatgagagggcgaacttggttcaatcaagattgagagcccttgcaaaagttaccaaagataacgatagaattgctcgacattacaacaaaaaagtggtggccaagtctttttcggaaggtgaacttacgtggaaattgattttgctgataggaacttgtcacgcccagaaattcacgaaccagaatttctaagctgaatgtgtattaaacccctgtccaggaccagccagggtacacaaacgacaattgttgacatacagatccacgtcttacaaaaatacaaaagattacaaatgcagcgaaaaaggtaaaagcgagctaagccaagacttgactcctgcagcgggcgattccattccacaggcaacccttgacggcagcgacgaaccaaccttttcaagacatctccaactgagaagaacttcaactctggtgtgggggaaaagagcaagactgagtactacccactatactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttaattaagctaaactaggggtgagactaatcatggtgaatctggtcgaccacccataaccgcgggcatggctattcgaatagttttactctgatcagaggtgtacaactgcacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcatgccgcggtgaatccggaagccgatcaaccggacaccccggccgacccaactccatcacgcccaccctcgcctgggtacatcggctagagaaaagctacactacaagcccagccgttacccacgctggcttgtggtaagtacgataagttcttccagggcatcccgcgaaccggtccttaatcgccatgggcacgactagcaaaaccatgcacccacagcccaccatgtagtgtattttaattaaccaacaccattgcggtggcactaatccaaagctattgccaataatcaaagtctatgctttaatgtgatccccttttgtgcactagttgaactaagcttggctaagcatctcctaaaccaatatctagtcattttaatacccaagttatcaatggcgtaagggaaacaacatatagctgagtaaaaggacccatcccacatgatattgtaaaacaatgcaatatttaatagaaatgcgggacatttgtaaattgggtacaatatgatcaattgcaatgtatgacttgccttgctctcgcactgatggaaccacagtaacgtcttcgagaaaccacgaatcgacaaaacgggcgaaatctacgcaacaaacaaaacacacaagcaaaacatgctataagactactgaaacaggaaacaaaaccatttttaatggattctatacatttttatgaatttactgagacttgaatggactttatcggagctcggatgaattagttatgatttttagaagattatctgtgtttttactaataaagaaaaagccttaatgtatttattgcgcaataattcatcccaggactgacgtcagcaaggggtggggcggcgccgacatgcgggccccactggtcaacggctcaagggggagggaggggtactggcaggcggggcccaccgggcggcgactcatggggaaagaaggaaggcggcctggctcggctcggcttcaagccggctggccggttaaggcgagggcggcggcggcaagcggccaccgacggcggcggccggcgacgcgggcgacagtgcatcgcggcgacgagcatgcggggagcggcggcgcgcgcgggaggaagagagagggagttctgaccggggttcggccggcgcgggaggagacgacggcaaacggcgacggtgagtgaccggagggcgacggcgaacggcggccgagctccgggacaccctaagagaggaagtgtgagaggttatagggagagagggtgcccacgacgagcgagagccatggccgacggcggcggctatggtggtactcaccggcgcgcggggagaagcgggccccgacggcgggattggatggggatgcggcggccggggtagctttggcggcggcgaagctaatggcggcggcagattggctcggcggcggctccagcggcggcgagcggcgatcggaggagtggaaaaggcggcggcggcaggagcgatagagggcacgggagggagcggtggaaataggaaagggtggaggggattggagggatggtttatatgggctcgggaggggcggacgaggctgggaggcagccggatttctcgccaacgtggggaatagagagaaagagagagagagagagattcgaattcgaatctctctgttgcggggtgcacgcgctagtgggaggagtggggatggtgggcggcgacgtgggcgcggggcgcggagtggggcgcggaaggcgggggaggcgagcggcgtgggcggctcggtggttgccggcttggggagcggcggcgggaggtggaagaaggagccgacaggtgggccccacctgtcggtgacccggaggggttagggaggagggaggagccggcttgggccggcccagccaagggaaggccggcgcgggaggcgaatggactgggtcgacggcccaggaagagaggaaaaaggaggaaaaagaaaaagaaaaagaagaaaggatttttccagggatttaatattgccctttgctcattttaattggttaaaattattttcaaggctctgagaattccactaaaaatcgtgttagcatattttgacatgtagaatccaagaaaaattccacatgtcgattccgattattatttgcatttattaattagggattcatctctaggttaaattaaacaattacttcggacgatttattttatgaatttagagcaagggaggggaacttcagggcgtgacagaactcgagataacaagttcggcaagtggtcaccgaattgggaagggccgtttcaaattcataaggttgtgtccaaatgggcttatatgttgcaaggacttaatggagaagtctatggacgagcgctcaatggcaaatacttgaagaaatattacccaagtgtttgggtgaatgcatgatcggctggatgttgccgatgcatgttagccgatgtgtttacatcgccttcagatggccgatattgttatatcgcccttagctgttttcatactgtaatcagttgtgttttgccgatgtacaatggccgatattgttatatcgcccttagtttttttcatattgtaatcagttgtgttttgccgatgtacaatgaccgatatggttatatcacccttagtccaaattttaattttatcaatgccttcatcattataaaattaggggccacatatatacaagaagttgcaaatttttgagaattttttagcacattaagatctattaatcggcatagcagttcaattgcaaaaagggggtttcaaagtttcttagcgaactacaaaataagttatcctattacaagaccaattatccagacaagtaacgctggatagccgacacagcgcgttgtctaatttgatctacttcttcgatggcttggatgtcttgggcgttggttccagagatgactttaagggacttggtcatgtcagccacatttgtgatagccgatctcaatttagacttctgttcttcaacagcacttctgttcttcaacagcacttgggagattggctaacttttgcttttcaagatccaactcggcattgcattcttcaagttgagctataagatcaatcttgcgggcttaaagccgatctatgtttgactgaatcggcccaatagaaggatgatcaagcttggctttctcctcatgcatgagttgccgattggcttggatggtggcttcgatatctttccgctcccgccaatcggctatccgttacttagccttttccagcttgaattgatgttgttcgaggaatacagctagagtaatggtgtttgccagatcgtctgggattagggcttggatttctgcaaatcgtgcccgaattaaaccacagtcagccaccagattatccaatgatgactctagccgaagggatatatcttcaagtgttttcttgacagtttcatctagaggggctagagccttgcttgtggtttcttcctctatctcatcaaagtaatccttgatatcgaaagagaacagatcggctaagacctacaagagagaaattcgaagaaattaaatattaaatagatatagccgatctaaaatcttatgttaaggagagacttactgggatagcaggagcaattggttgttcttcttccccgacattatgacttcctgtagccgatggagtgtgatcacttgatgtttgttgtacaggaggtgaaggaggaggaggctgcaaaaaagacaagggataagtaaatatcagctatgatcagataagtgaaaggatttgtataggaaaatcttatcagtggagctggtttaagtgttgttgttgccgatttcttcttcacagcagtcttctttttctgaaaaaaggggatttataagtgatcggctatgaataaaatgattgcaaaaagaaatcatgagagatgtttacccttgaaaaatgagctggagcagcaggaatgggaggagtttgcttgggcgaagccgatggtgttttttctcctatatcactcaattcggctgctgcttgatcgatatcttcttcgatttcttcttcatccagagcttgctcgatggatggatctaaggtgggcaagtcatcggctggcttgggtttgtgcttcttcacgttcttcttaggagccagagccgatggatcaatggccgatgccttggtcttcctcttcctgccaacatcggttggttctctcatttgtccttgaagcagacttgaggtactgggggcatgatagccgatgactagaggagctaatccacctccgttaggtagaaggcctgcagcatattctatgtccctgccgctattgctcttgcgaggaggagaagattctgttgtctgcaagataaagagagaagttagtcaagattcaaatcggctaacaattattcaaacaaaattggctaagtaaagatgtacctgagggacaacatcaggaaataggtctgtcatgtacatagaagctaactgatggaatatatgttgcttccattctccccaccatcggtcaaagtttctgctcctaaaccttgccagctctatgttgtcaatgctccccaaagggggtcctgggatattgagtagccgatccatcatcagtgtggatgagatctaccctctgcattggattttatcggcaaagaataagccgattggtagctaccccattccaaattgcctagctaagctcatttggtgatagaactcataagacacctgtatgtttcttccttgatggatgccaacaggaagaatgcatggactaatggcagtcgagaagacttctctggatttttgatgcttttcagagttgatgtcctcaaacctaaagtctgccgggaggtcaaaattcactgagtcctcataagggaaccaaatccgagcatctctctggaatccctcgtagaaactacaaaaccagtctttgagtagttcggccgataactttgctctagaatcggctggtgttgatgcagcttcaccatatgacatacatcggcggtgagtgagttcttctccatcatcacctgtgatcggctccagcctcgggaattgtgcatctatcagaagtggccgattcacaaccttcatgacaacaaggttgagccatgtttgcagcagccaccatggtccacctgcacccactactgagcctatggctatcttggccgatgcattgctcaacatttcgtattgatagccaagaaggattttgcccaagagaaattgccttttggtttcaagggcttcggctaagaattgccagttggtagtcggaccacagctcgatccacaaaagagaaacttcttgagccacataatgagaaaggcagtgtgttctcgaggggtgacagatcccttgcccatgtatgctgctacatagccagacccgccccctatgctcttggtcctgaagtcaaactggttcttggtgtttaggcttatggggttagccgatgaagtcacatctaacacagtaatcatagtgatgtcgatcagagttggggtcattggcccttggttgaac

SEQ ID NO: 81864 - DNA, 4345 bp, Oryza sativa
gaacttgcttgctagccgatatatgcttataccacacagtccaactcttctcgggggaagttttctcaagagagggccaagacttgaacatgttcttccagtgacctagattcgggttggccaatctaaaaggaatcctattggtttcagcgatgatgaactcaataggatcagggttgccaatcggaccaagaaaatagtgatgctcatgcgacaggctaggaatcgcgaccagattggacagatgctacagatgcaaacaagaatagagaagaagaaaacaagatgagacaaagaagaaccaatctattgcgaaaggagaggatctagccgatggatacttacctctgtgtatttggccgatggcgcgatagacgggctggcggaagttgacatcgccacaggcggagatttggccagaagggaaaatcgccttggggtcatgtggtgcgccgaggggatcgccggagagagaaaagatgagtttggcttaagcggtgaaaacggaggtgacggtgtgaagtttcttaggggtgacggttagtatttaaagcgctgcggtaacggtcggaaaaacagcaacgagcgatattcttggagaagcagatatggcaaatccgaaacattaccaaatattccggacttggggggcatgtgttaacaaccaaatttggtaatttcagtatcagagacaaagataaaactgaggtggaatccaagatggaaatcgtttcggaaatagagaaaggatcggctaaagtccgattcggctgcgaccgtgatcggcagggtccgagttggacaaggttagtcgattaagccgaatccgacaatgtgacacggtacacgttgtcgggttgagttaatgtgcttcatgaagattgccacgcacggattgagtcctgagaaggcaattgtatctattaattaggatatttcatgtaatttctttagagatatatttgggcaaaagtctgccgcaaagacttatggtattttagagttcgttagagataagagtcgtgtctgacatggacatattttgtaatctcggggataaatagaccccgagccccatgtaatcaatctaacacacgttcaatacaatctcggcgcatcgccaccgttttactttcgtttgtttcgacgagttcttacttctgggtcgagctgcatcggttttgatcttcaactagaggtaaaacttgttatggcggcttgcgttctcgggattagtgcttccatctttatgatactctaatcctgtttatgtaattcgtcgagttatcatgtattctatataatcctgtgcaatattgttatttaaccttcaatcggctaacatctgttgttagaaggcgaccgatcaagttaaatatcaacgttgacttagattatataggatatccaccaccctatgagacaatcaacggcttgattatctagatattgtccttcttttcatacttatagctgcatcagttgagtttgatcttataagtcgtgattagaatctcaatctctagcctacttttggttgccaattagggtagcatcggggtttcagcctatcttacctgatttagcctcatattttatgtgcttaattgacatgctagatctgccctttatgttaagatcttgttgctcttaggtatattaagctccatgtttgatatattttacttgtgttaattaatatcttaatatagagtggtatcggagtattaggtgatacatgctagatctatctgatcggctatgctataaatatctataatctcgttgttgatatatatttcgatcaaagtgatttatactgtctcggcatggcgaccgatctatcccaatcactgacttaaatacatatcaacataaggattatataatgttaatatctacagccgatcgaatagatttagttctttcttacttatttatatctgccgatcgatttaaatatgacatcggctcggagataaatgatatctcatcggcaactggccgatcggctatcatttatggatttatccgcggtttctttatctttattccttgttgattgcaggatcaaatcaactggcacgctcgcgaacctaaaagcaagatttttggacctgcactgaaattaagcagaggcctcgtgttttcgcatcaacacatgcccgtcctgagcccccacctccaccgctcaggggacggacgaggtcgccacgaccctcacttcacgcgcatcggcctccaccctggccagccgccgtgcgagccaaccgtagtttgtaaaatggatttaaaaccttgtttaactgctatgacactaacatgtgggccccagatccttgatagtcaaattttgaccaagtcaagttgaccatagacccacctatcaatagtttagtgtttttccttctaaaaataaatgttctctaaataaaatactgtggtataacgctgtcactgaaaaaaaaaggttttcttccgaaaaataactcttacaaaacatagaataactgaacagggaatttttgcaattaatctgatttatttcaaatttaaatatttgaaatgccataactcactcgttttaaatcggatttcgataaaactttcactggaattcttctaaaacaagacattcccgatggcattggttggagtgccatggagtgcgagattaaaagcatacatacactgcagtgtgagcgtcgggacgtgtactagtcttgactagcctcataagttttaattctacttagaatagtattggaaacgattgtgtgacctctcctgacgtgtaggaaggtcagaatggtgagaaatgtgggaacctagatacgagggtaaaccgaaccaagtgaagcttggagaaggtggatgaaccttccttaattaacaacaacttcaacttttttatttaaaactgccaagtgataggtttgtgaaatctagctttatgttaataaaccaagctattctttgaaccccttatgtgtactaatgcattatgtagtattggcttactgagtacaggtaggattccacccgtacaaatgctacatggacgaggaggagccgaagaagatagagtagggacctaggtttctccagtcatcgcctgtggaataagatggaccatcgcagcttcttttccactatgtcatctactccttttggtgtttggtatggtaatcaaccatgtttggtcttttttatttgagttctactcgggcaactctagtattattaatgtatagtgagacctttataacgatgtcagttaaacatgatatgtaattttccatgtgtgtgcaatctactgatttataaaatagtattataaatacatgaggtctccgatgtacaaaacctagggcccacgttacgttcctatttctggcatctaattgcatcaccgtgattccctactagttaaacaatatcagatcgattaacaacacggtgcaattggcaaagcggcacatgtctggagctgtacttaactacttaatcgcgtgaacccaaattttttactactgacgaagaactaacttgatggggttgatccgtgagatgcaaccatgtacagtcacatgaacagggcacatgggtgattcatcaatattctgaacttttttgctgtttctttgacttcttgttgaaagtggatgtgaagctcgtcatattgtttgttgcttaggaagctcctcccgtatatagctctcaatcaggcgcagccttgacattgtatgacggttctttgtttctgcactatactaattcgagcatcatatagctaggctaggctccttacatgctttttccattcatgttgctaattaacagtgtcacacgcagacatctctcaatttcgtactagtgcagttctgttgcaggatctcctgaagattgatcgcaacaatggcacgagggccgatggatttgtggaaccagtgggcgacccagatcctggtgctcttgagcctcacgttgcaggttgtcctccacatcttcgccggggtacgccggcgcgaagctacgccggtggagaggttcatcctctggctggcgtaccagctggccgactcgaccgcaatatacgccgtcggtaatctttccctgagcagcaccgcacgagagcacaacctggttgcgttctgggcaccattcctcctgctgcaccttggcggcccagacaacatcaccgcctactccctcgaggacaacaagctctggaagcgtcacctcgtgactcttgtcgtacaggtcctcggagtagggtatgtcctctacaagaacatcgccggcaacgggatgatgatcgtggtggctgccatcctgatgtccg

SEQ ID NO: 81865 - DNA, 12276 bp, Oryza sativa
agcttgtacagcgtgacaagcaccagcatttctatatcaagtatgagcatcctcgccacgttggtgacaatcatggttccaatgatgagttgcttctgcatcgagctcactccttgttccacgtatgcgagcgtgggatagttgattctgtgatcatcaatgatgatgatgattcagataatcctgacagtaaagtaattggggaccttcttatgcaagataaagatcacaagagcatgtggacagtgatggagatggagctctccctcatgtatgacatcttgtacaccaaggcatatgtgattcacactagcttaggatacatcatccgcatcatggcgccgatcaccatcattgcctcactcttactgtttcatttcagtggcaaaggtggccacaaccgaatcgatgtcatgatcacatatgtcttgttgggcggcgctctcgtcctagagacgaggtcgctgttgagatcactttggtctacttgggggctagtgttcctctgtgacacacgctggagctggcttcgacatgtagctctctgcagcggaagatggcatcggcttcggtacacagttctctctttccgcagagcaatcaagattgttttttcaagaaattcaaggaggtggtcgggaaggatggggcagtacaacatgctgcactcatgctatcataagatcaccaaagcgacagcaagtcaccattggttcaagacgctcaacgatttgtccactctggtgggcttcgctgactggttggatatgcagcattgctgtcaaatctcgaaattccagacaaggtcaagacaactttgcaagatatgcatgagagatttgcaccaaatgatttgaacactatgggcttactgaggcataactgggggatgctggcaatgggtgaggacatgggcagcgggactcgccctgagcagttcaagaacctgaagaggtttcatggtgttgacttccatgagagcatccttatttggcacatcgccacagacttattcctcgctaaaatagggaaggaagggccaactgtagaggcaatcagggcgatgtccaactatatgatgttcctctttgtggatcgcccagaaatgctaccgggactcccacataaatggctgtacgagatgacaaaaaaaaacataatcgaatcatgcagagcatctaatggtttcactaatgaagtgaagcatggtgggcaaagatcccttaggctcaaacagacagagcaggtagctggcaaactactcaatattgacaaaagggaagtacaacctggccctaaagttcctcgtctcaggtatgcaagaattgttgctgacacactgtacaaatggaaggatgaagatccaattgatgtgttgtttgacctgtggatagattttctgatgtatgcagccaaccgctgcaatagggaatcacatgccaagaagctcaacgctggcggtgagtttttgaccatcgtctggctaatgattgagcactttcaacaattagcaaaagcaaaaaaggagcacggcaatgaataatgcaggttaatgtctatattggcatatgactatgagtaatattttactttttgagattttctaaggtcttagaaaaggtacggggacttatcatattgttagagtttaatcatactttattactttgtatgttagcctaaacatgatcatctctgtttaatgcgaaaattaatctaactgaccttgtttgtaaagccattgaagccaatttgctgaattcatttgcttgccgttcttgctttccttttctttcttcttctgcttttcttctgttcttcctctttttgctctactttgccctgagcttcctgctgatgcaaaaaaaaaaaaaaaagaaaattgtagagatacctcatgaaccctttacaacgtcgaatcgatagagcgacttaggtttagggttttagagtgaagagagagagagagagagagcgggtaacccctctgcctctcctccacttttaatggttttaataaatatattattagaaacaatctgaggtcaaacatgtgtttggagatgttgtctgaccatgcaagaggtaaagtaaagcacgattatatttttccaaagacaaatatacctatcatacttgtatgaaggaagtcaacgcaactcagtcggtttcgttactacatagtccctccattttttattagataacgttgttgacttttaaacacatgtttaattattcgtcttattcaaaaattttatgcaaatgcataagatataaattgcgaattgcgcttaaaatacttgaagtaataaaacaactcacaataaaataaatgataatttcataattattttgatgagatcacggtcaaacgtgtactatatgataaacgacattatctattaaaaaacagtaattaaattaagttacatcgtttttcaagacatcaaattagtactccctccgttttatattataaatcatttgactttttttagtcaaatttatttaagtttgaccaagtttatagcaaaatatactaacattttcaataaaaaacatattatctaaatatattcaatgttaaatttaataaaactaatttgatgttataaaatgttgctaatttttcctataaacttgatcaaactaaaaaaataactaaaaaaaagtaaagcaacttataatatgaaacggaggaagtacattgcaatacgtcgtctcatagtcatacacggtgtctacaaagcccaacatcataccatgtctcatataacagatttagcaaccattttcagagatggacgtgacttggcccagggataatccttacattattattataagatactttttccattgtatattataagtcgtttagttttcttgactaagtttataaaagaaattagtaataacaccaaatagttttattaaatttaaaattaaatatattttgataatatgtttatttaatcaaacttaaaaaaatttttaaaaaaattaaactacttataatatgatatgagtagaaattggagccgtttgttcaacccatctggtctgcttaattgaagaactagagccgttgacgagctttagtccacgcaagttctctgctcaccaaacctccttccatttgatatttttccaaagaagaccgccatccacttgactccctatagtctccgtcataccctgccataacactattcctttaattaatatttaatatcttcccctcctcttaatattataaatggtttaaatctttatcaaacttatttatgtttgatcaattttacagaaaaatatagctagcaaaatttttaatacaaaacaaatatactatcaaaatatatttaataaaaactaatttcaggtcatagttgttgctatatttttcgtaagttagttgaacttaaagaaaactagatttagaaaaaagaaaaacgcaacattagttaatagatttatatttggagatactttgatgtcataatattttaatggttttaataaatatatcattagaaacaaaactaaggtcagacacatgtgctttggatatgttgcttgtctgcccacgaaagatgttaagtaaaacatgaatatattttccaaaggcaaatatagcttcatacgtacttttctggtggaacttaacggaacccggccggttggcctctggccaacaacgacacgaaagacaacgacgcacacatgatagaaactgaattcattaactaatccccccttctccaatttattcattgacaatagttataaacttaggatgatgatcacatggtcacttgctgctgatcacgtgaagcagtgagaaatggtagtaataaaatctgcaaatgacaaatgaaagattattattctgtttttaatttatacatgtcgaatttgaacttggttatggagagttatattgtcaaaacttaaaacttggatatggagtatttaagaagacatacaacaatatagggatattttcttaattaagggagaaaaacatgtttacaccaaagtaggaagataactactcctagttgatacatggagttgaccgaatattttcacgtcttcctttaccatgtctatgaagtattgaaggtactgctcttgtccttttgtccaatatctaaaatccgtagtccacacttctttgttcattcaacgtacacttcaaccatctatatttcttttaaaaatttaaaccactatttgggttgctataaatattacatctcagataaattaagtaatactccatctacttctaaatataaaaacacttattagacatatgtttgacaattcatactattgaaaaaagttaagtattatttatttttttgtggtatattttattatttaagatatttttagcatgattatattttttttgtatttacacagatttttatcaataagttgaatagtggaacatacgtcgaaacatcatatatttatataaaaaatgaaataatggtcaaagctatatctccactatcaaaaaaagaagggaaaaaacaagaatagagatggagcagtacttcacgtcagaataatgtgtgactatgatgtgtgggcctataagaatggacttcatctgattaggtactcacgtagctgcttccataaagtaccaaccacatcggatgtggattaatatattcctcgaggggacatcacttgttgtttatatgttatataaaatagttattaaaccaataaaaaaaattaccaacatagatgaatatgaaatatatcactccgcaaacatgcataaccaaattcaacttgtacaagttgcaacaaaaagaacaagtttatcgcacgttcacaactatatttattatttttgttacaacttgtataagttaaatttaaacttgcatatttgtggagtgatatatttcatattaatatatgttgctaatttttttctaattttttaatacctatttagtggcatgaatgaaacgagaggatatctcatctagagatgaaatcactttctcaaccacggcaccctcaaccacatcaacttgatacagtcctttttcttactgctgtacatgtatgaaacttgcaagttttttgggattacacgatggacacttgtgagcaacttggttgttaaccatgtccatgtagacattgaattgaagctggcgcagccagcaacaatggcgggaggaggggtgatgcacctcctgaacgaatgggcgatcgagatcctgctgctggtcagcttctccctccagctcgccctcctcttattcgccgggttccgccgcgtgggcgcctccgccgggctcgggagctggtggaacaggcacgtcaacgccggcagcatcgtcatctccgacgaggtcaagagcacgtgttcggatacatccagaacatgttgaggggcgtggactccatgtcgaccaccgagctcgacgccatcaggacgacgagaggccagcgcgcgctccggcgccacggactccacggcgacctcgccgccagcctcggcgaggagttccaccaaggcatcctcacctggcacgtcgccacggacatctacctcgccgtcagcggcggcggtgaccgatcttctgcagccatagccaacgccggagacagggcggcggcggcgcggcggctcgcggaggccgtccgcgcgctgtccaactacatgatgttcctcgtcgccatccgccccgacatgctcccgggcctcgtgctccggaggctgtaccaggtgacatgcgaagacatggccagaatatggcgggaacgcaaggacacccacgaatcatcgtcttcttcctccagcggccgcttcatcgacgtcctaagcatggtcaccaagctgttccagctgcacgtcgacgacccgacctccgcctccaggacgccggagaggaagaagctggcggcgatgctacgtgacaacgcctacaatggcgatcagaatgtgaggagccatggcgtcttcgccggcgctctgctcgccgacgagctgctgctgaaggagaaggagcggcggatgtcgtcggacggcggcggcggcgggttgttgttgccggtgatcttcgaggtgtgggtggagatgctgctgtacgccggcaaccggtgcagcagggagtcgcatgcgaagcagctcaacagtggtggtgagctcatcacgctggtgtggctgttggctgaacacgctgggctgtatcgtataaacaaaactaagcagcattttaagtgtgctgaatatgctactgttatggtatagtttactgaggtagactctgtctcatttttgtttttttgggcctacaagtctgcaacaccggaacatcccaatggatggatgatttggcaggtatatatggaaaagtgatttcatctcttgagagcatatcctctaaaaaaattaaaaaaaaatacaagatagcttaatatgaaattaatatatcactccacaaaaatgcaaaggcaaattcaacttctagaagttataacaaaaataacaaatataactgcaaacgtatgataactatcagtttaatttgttctttttgttgtaactagtagaaatcgaatttggtcttgcatgtttttcttaatttttttataattatttagatgatatgcaatcaacgaggggacatactccggtatatatacatgggttaaactgggagtcaaatcaactccgttgattttttttccgtatatttatcctcatttttgcatgtcaattagataggtatcaaaaatttcaaaaaaaatattgatacgatatatcaatataaaatatatattatcaaatatgaaaaattcaaattcaaaaaataacaaatatgcatataaacagtacgtactatttacagtaaaatttgttatttttgtttctacttatatacgtagaatttgaatttacatgtttatgaaatgatatatttcatatcgatctatcacgtcaatcttttttaggcaacatgcacaaaaggaggggtgtgttggcaacttttttgacaagtcgacaagcacgatcgcaacacctaaacgctttgcggtgctatggagtcgccaaccacctcgatcttgccaatcggtcaaatcaagatgggtttttttagaaaaacagctaaaccggctagcggagccgatttagatatcaaaatcagcctctagaccaatttagatcaatatgaggataactatccgtctcatgggcaaaacggaaggtttccaggacaaacctacagagaggtgtcgcactctcgcagcggcggcagatgatttacagtgcaaatcgacaaagatggactaaaactagggtaaaatagaaaacatggtaaaagaacgatttaagtagattgtattcgggggattacaattgaaccggccttttctcttaaataggggttggtcttgccctttacaggccctcctccatgtctaactcgggatagaaaccaaaggaaacccgaaacatgccttcccaagcaaggaaactcgagacccgatgaaaacagacttgggctgggaccctgacggtctgaccggccatatatctgcggccagaccggccatatacctgcggtcagaccggccctactatctggtcagaccactcacatacctgcggtctaaccgaccctgtgaaggaaacccggcattttccaaacttttgcaattttcccctatttcgtccataggtgctaaatttgggtctaaacacatgccccccttttttatgaacatcgtgaatctaaaagcatagagcatattgtcttagggacgatctttttgctgaactgagccgccaaggtcgctagttccggttttttccagttcaaccgttggcccggtctgattttttcgtactatggcgtatataaggctcagagatttttctggtatgggtactcctctgtatctattaccagttggatggccatggcagattatcgtaaagaacttggcaataagtgatggtttctcgatatactaggagggcatagttatgggctattggctgcataattatacaatagcaagtgtagactaaaatgactatatattatatattataagtacataaatgattcttttcttattctttctccacttagcttagattattattttagtgagaatatttttgtttagttccttgtgtgtcaatctatctttatccctaaaatgattaatccctacattagactttatctatacaagagatatatattattagtatagtactctcttaccatatcttcccatggcattaaataaatatgttaccttggaatactttcaggtaaaatgctacagcggtatatccgagcgcttgcggattatatctgtaaccgtaaagaataccgagtaatatttcgagcatcattgctggaaattatatttctattaacgttgttaagaaatatcaacaaccatctcatagtgacttcgcttcaccagtactccattccttccctctgcttcttttctcttcctcaccgacactccatcctcttcttcacaggcactcaacgcattccacccgtcaatcttatgcctcttccctcaatatatacccaaggcagcttcattccattgacacgggaaggcgtctttgacctccaacaagtccttgacaacagcagctgcaatttgtcatcaacttctctcctccaaatgtctacaacatttcatggaacatgtattcgagtggacatcatttttattttttcaaatcgatccaattcccatgcacatacgtagcatggtcgtcccatctctcttctctaataccctctcaaacattcgctgcagggtctggtggtggcactaccacagggtgctggagttggagagacaaaaaagccagttggagaaccaaaactggcagttggagcaacaaaactctagactgtccagtgagaagcgtgacctggagagcagggtgaggaggttgggttatgaaaacaccaatctattagatgagaagatgagggtggctcatgagtcctcaagaaaggtctccgcactggagtaccgggtgcgggagttagagcaccaaaacaccaaactgtccagtgagctagtgaagcaacgggagaacacgaggaaggcgggccagctgttcatgaatgctgccgatacgtaccaacaagtagcagagaagcaaattagaacaaagaaagaggaattggcaaacacgagaaaggcaggcctcctgttaataaacgctgctgatacgtaccaagaagtagcaaggaagcaaattaaaacaatggtggaggacctggaggatgcgaggatggcggttttggtggtcatgaatgctgccgatacataccaactagaagcggagaagaaaattaaggataagatggaggaattgagggtccttggggtccagaaggcagaaatggatgcgagggccgcatctttggaatctgggcttaagacagctctagcaaagattcaggaattggaggctgactgtgataaggtgatgattgaaaataataagctttggttggaggttgagaggctcatgatggaactgagggtaatggcacacaagaaagaggtagctgcaaatgcatttggtgctgaaaaggcagaaactatgaaggaattggaaaaccatttgatgaatgtggaggaaattccgactagcatggatttgatgaaggatgaaaatgataagattcagttggagatcttgacagcaggcagaaacattgcttgcttgaattagatgtgttagtagaggagaataaagcatgctaaatcaagaaggaatccggggacatgaagggggaattgatggaaatcaagggtgcagatttcatgaaggctgaaaatgaaagctttggttagaggttttcactgcagaacaaaaacatagtctgccaggagcagaagttgagaggctcaaggagaatatttggatgatatactttcttgaaacatttatatctctatggatcgtccagaagctagggtggcccttttggtgcgacctgtttctatccacttgaaaacaataaaataaattggtcctttggaatgggtttacaatttttagaaataaactgtaaatgtgagattccttatcgtaatacatggagcaaatttatcttttcaattatatatgcatggctctctcacttgggtagtataaatacatgcatattatacctggtgaggattggtgtcctggtctattgatagaaggtcatgatcagcaaaagcatggacatcaaacaaaacagtacacgaggattttatacacgtttgggctctcaacatcctgttggttactatatacttcttccatctcataataagttcatttttaatttctttcatttgtcccaaaataaaagttcatttttagagtaatcgtagcatcggagtttgtgaaagtatattggagtttgtgaaagtagagaataattgtattgtgaatagataaagtgagaaatagttgtattggaatttgataaagtaaggatattctagtctttttgttttgtattggtatgttaagatagttgtattgtattgtgtgggacgcactatgaatacccttatgttcaccgctcacgaccccgtcgtcattagacctgcacgtacaccacatggttcctgtcacgcccggaaattcactagtaatttccgaacttatttgtgcataagatcctcgtccaggaatcaaccgaggtacacaaactgacaatttaatatacagattcatcaaattaactaaaacgataaatacttacttataaggcacttagtcctcatcttgaagaaaactgcagcggaaaataaaatctagcgaagctccggctccactcccacaggcagctcaactggggtttaagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtggagtaattaattagaaattttaatcaacactgaacaacacacccgtgctgcacaggcccaaccatcctgaacaaccatacccggctgtacagatctaactccaaaccaggagctaagcaaattattaccaggtataacatctataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccatagtgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaacaacagtgagtcatgagttatcccaatagtgtgctaatgtttctaagcatggctaagcaattatatctaatatctagttgaaccaatatatataaagctcaattagtcaaattataataacccaaggtatcaaggattaaagtaatcaatgcaaacaggccataacaaaggaatagattcacaccacccagtgacattcgaaaataaatgcacagttgaaataaatagagaatttaaatatatgatcaacatgtttaaaggattgtgtttaggatctgtgtgacttgccttgcaataatcggtcttcaattaatcttcttgaatacttccggcgcactcgcgaaccttcgcaacgatggaaacgacaagctaacacgcaaaacgaagaaaaagactaataaaaaccaaataaacaatacataaaaagtaaacaaacatgtagatcataattttagatgaattatgagacttgaacggcctcattctg

SEQ ID NO: 81866 - DNA, 16612 bp, Oryza sativa
ccacttacacccctagtgacggctgcacatgttctttttttactccatatatattgtatgtccaacttgttgacagaaaatgtatggcactattgctgatatggtttaggagtgtctattgctcacacaaacttactagatgggatctggccaatccaccaagtataaagcaacattccaaggcaaattgtagcatcctcaatgtttgttgcaaaattagagaccaagttgaacctatgtcagctgacaatactaggtaggagagacatcacaatgtataaatacgtagatgagtaatataaggtggaacctgccttaaataaaatccccaaacatgagtcatgccataattttaaaaagagaagcggaacccaccataaatagtttatacctagtagtaagcttatgccctggaagtggtagttactacctccacggtgtatcttacatgataacaagaatgtgtttactacttattatcttctattccactatattgtggaggaccttacgactacatcaatcatagtgagttaatggcatagtgggaggcaacaaatgaagtagtacatcaatgaaaaaagaaacagaggcttgtttgaaaaatcatattaagtagcgacaataaagtacatcatccatttttctccactatccagtctgtgtggccgtgctcgtgctcgcctctgagctagttggtgatatggactttccaactaggaacttggggcgcttgacatgcgtactgagctggctttgcaatagctgcaccagtttctccttaggaccacatttcttcagaacaagctcgttaaggttgaggagatgtaacactccagacaagccattatcatcatcgctcaatttctggcacctgttcacccaaagttgttgaagttcaggcatcgcacccttctcaatgttaactgtttcaataatctccaatccatcgatatcgaggaatatgagctttcggaatgtgccatcattgaatatcagtgacttctctttgtaggacttctcccacaagcctagtgaagctaggatgcgcaggtccttgaggcgatgaatgtcatcctgctttagttgtgtccctattagcttcaccttcgtcagatcattgagtgacttgatccatacaggaagttcgtccaacagaccgcacaacctgagtgacactagatactttggtggtgttgcatctatgtccttgttgttgacaagaaaatcaagtgactcggagcgcacctcaagccgttgcaacctattgaggttctttatcgagttccatagctccttgccttcctcctgaccaagacctgtgacccctagcctttgcaagttcgtcagcctctccagcttcccagccacatctttgctcttgcgcacattgaccacactcaacatgtgcaagttccttaacttctcgattccttcaggaaccattacactgaattgatccatgccagatatctcacaagattgggtgttgtaacaatataggcaggatgccaagttccccaacaggttggaattgtggttttccatcccaaactgcggcatcttttgtagcaaatctcttgagaaattgactccggcgagaaggtaacggagcttctcaagtttagcaatgccatctgggagctgggtgacttgcgtgtcttggatgtcaagcgtctctaggtacagaaggttctgaagagaagatggaagcttggaaatatctgttcctctaagacccagatatcttaggtgtctcagctttcctatgtgcttaaggtcttcgttcttcagattggccatatcttccaggtcgagaacacgaagcattcgcatctcaagggtaatgagagatgctgggcactctccaaataccgttagcgatcgaatcaatgacaggtttatgttctccaacttttcatccctcttcttccatctgttcacaaccaagtggcgtatcttactttgtggaacctcgttacagtgcttcttgatgacaaagagctggttctcatcgatggacttggacaggattatatggagcatcatgccatgaactcgacagcgatcgactttcaggccatggctgaccttggaagattggatcatgcttctgttgataagctcattgaagaagcgctctcccactacttcaacgggcatgtcgcggttattcgctatgtaaccttctgcgatccatctcctcaacaagcgggtgcgccggatctcgttgttctcggggaagatactaaggtataagaagattggcttcaggtgatatggcaggccatggtaacttgagacaagtaccttcgtgatgtcctggagctggtcggactccagctctactccaaggtgttcgtgcaacttcttccattccattcctgttttaggcctattggcaaggagacctccgattgtggatatagcaagaggaagcccccagcatcccttcaagatgcgactgatgtgcggtttcatgtcctccggcaaggtatagtttggtgttctgtagacctttaaatgatggaaatggaatgaaataattaaattaatgagacgagcagtgcgtaggccagcgtttgttaatgtttgaaaaatgaaaatgactatagaatgaaattgaaattatgaaagccaaatgtaggtgcatgaaggaatcttgaaaaaaaaatttactatttcggaatacatagttatacccgggtcactgaaatttcaggggaaaaaaggggaaattttcaacaatttcaaaatcttgataatttttgcataatatgaatataattttgttaatataaaaaaacatactttgcacagtagaacatccttcttttagaaaatggattaaaattgagcttctacagccggtagaacatcctaccaacacaccgaaattttggaatttcggatccaaaattgttaaccctgtctagaagtgagttatatgtatgggtgtcgttcttgccaatttcccactgaaatcggtcaggtgatttctggaaagttcccatttctggtttcctccaaaacttcacttcctatatgcaagggaactttatgagttccttttgtccgaataagatcctcgactctatttatccccaatcccctcaattttacacatgtcataatttttttaaaattttttaacaaaatagatcaatatgtgatatatcactttatacaagttgaagtccaacttatacatgtagaaacaatatcaacaaatttgactctgaacagaacatgtaattcctagtcaaatttattatttttgtttctaattatattggtcaaattcaattgtgcagtaaatatcacatgttgatctatcttaccattttttaaaaaaataatgattttttaatgacatgcacgaaaaaagtggacgtccccttgagagacgaaaatccatatgtggtggtgataaattcagtccgaccaaccatgccccactatgcataaaagttttttaaaacaccttgagggatgtccctatatttgtttgccatgcaaatatttatgaaacagtatgtttaaaaaatatcaataaggattacagtctctattactgcatacagtcgttaatctatgattttcacattaactatgttttacttaaaaaaggagtgattttatggtcattgagaaagtatccgtaggtacaatattattttaaatgtaaaatttagtacctccgatattaggagctatggaaatttgcactataaattttagtaacactcttggtgcctcttagagactttaaaatttctcaaagaaaataaatataaatgttactccctccatttcaagttataagatgttttgacttacaatgttaatagacaaatatagtaatatttatattactaaattagttttattaaattagtaattaaatacttttttataataaatttataataaacttagtcgaacttaaagttgtttcactttgataaaggttaaaaacatcttataacctagaactggaacggaggagggagtatcaactatcaagcaaagacatgcatgtacctttcgacaaaggagatccttggattgcttatcatccagacgtttcagctcgtagacatggccatgctcctcaggcgcgaggcccgcgcagtgcccggcgacgtccttacggcgcgtcgtgacgatgacgacgctgcccttgttgttcaacggcttgaggacttgccagatctgatcccactcctcctggctgagcaggtcgtccaccatgatgatgtacctcttctcccgcaggtagtcctggatgacgttctggtcgtctccggctgcggcgcccaagccgaggccgagctgcttcctcagccgccgcctgaactcgtcggcgccgtcgagcgggtgcggcaccgtcacccacgcgctgcagtcgaacacgtcgagcaccgccgggttgttgtgcaccatcctcaccagcgacgacttccccatgccgcccatcccccacaccgccaccacgctcggcgacggcgagccactgcagcgggagatcagatccttcagctgctccttctcgcctgcgcggccgatgatctccgactcctggaacgcgagctcgtcggagctcgagccatggccgccggggagcatggcgacgacgcgctcatggtacgtgcggctcgggtggtggtggtcgtcgacgacgatatggtaacgcagcctaagctggttgagctcctcgacgctggccttgagctcgcggatccggtcggcgatgcggccgcgcgccgcgagggggcctggccggagccaggagctgcccgtcggcgacgacgagatcctggcggcgtagagggcgaagtcgaggaggcagtcctcgatgtcataggccaggtcgcgcacctgcttcacccacgtcctcaagatgtcgttgtccccgcctccggcggtggcggcggcgtcggggtgcaaggaagaggaggccgtcttgatgaaggcctgcatcatctcaagctcgttgcggatgaacttcacttccttggggacgccgaggaagcgcgcgacctcgtcggcgacggcaggcccaacgctgctcaggacgacgtcgaggacggacctcgccaagctcaccgccgtcgcttccatcgtctctctgccctctcacgattagagcctttttcctggtttaatttgcttgcagagtgcgcacgacagagcgagatttatctgcttcttgttgatgcaattgagggatcattttatacaaaaactttggcgggaacgtgcgcgatatatatgcgtacccgccatttctttttgactgcctatatgtaatttgacaggaatctaggatctaaatcttgcaaattttataccgttggttcaaatttaaaccaaaggcctagattttgtcatagtcccatatatatttgcccctaggcgtcacggctagggatgaaaatggtgcgggtatttctcgaccactcgcccaactcaaggctcgtgggaggaatataggagaaaaaaataggataccagatactatccgagttcgaatccgaattcattcgaattttattgttgggttggaggtttgctccagaaaaatttggaacaaaacgtctaccgcgttgaagcccatagccccatggagttccacgaaagtatgattcttatcatcaggagccttttgaacgtctctacgatgagtccagattctatagcagtccaatctgaaatgaaagacttctcactcttgatcggagtcgtaaactaaaactacctcttcatcaaggttatagaaaaacttcgtcatctagttctaccattttgaaaatcaattctcttttcttacgggcatttcgagttacttgttgactcacgattgtgcctattaaaagtttcaaaatgtcctctataggatacgggatgacatgtatccgtctatatgtcccatattataaaacatgtatgaaaatctattacctataaacatgataaaagatcggctaatcactattttatgagctcacatgtaatattatataatttgtctcttgatgtatctcttttagtactttaattaccttagtatatttaatatctatgaattagatatacaaatagatatccgtttctgaatctgattcaaaggaaataatatgggatatgatacaccttaatatatataatttcaatgaattagatatacaaatagatatccatttccgaatctaattcaaaggaaataatatgggataggatacgagatgagtgatatgttatccggcactacccgtatccggttccgaacttaaagggaaatataggtttggatatggaaaatgttataattcgaccgtacccacccattttcacccctagtcgcagcttcttccctcctggcccctccccctcccccaagcactgccggcgagaccagccgaccagcaccaacaccaccatcatgtcctctggtgcccagcgccgccacttagggttcagaatttcggaaatttttttttctattggaccttggccccccgcgcggtcttcggctcaagttgtatgaggcagaaactcgtcccatacatgaaattatttcaaacagatttggattttttttttcattttttatgaatttggtcaattttgtactactttgacaaaattttattcaaatggtggaaattttctaaatttttatcaaatcggtaccccgaaatacattccgaaaacggtaaattaaaccctaccaccacctccctgtcattccccctctccccaaataccccgacgccaaccctgaaatctagtttgtcgaggtcgccggagttcatgactctgtgcacgaatcttcaaccgaatcagttggatcggaatcaaaatatgaaagattgttatagcaattccggtttttttaattagaacggcaacccgctaagttcgttgacatttgcttgcctcccatgcttaagcttccttggtaagctgtggaaatttcatgtacgcaatgatttaacaatttaaaactgaggtttaaactagggtactcaactttgatttctccccatattatagtaatttaatatgtcaagttgtcaacatgttagttcttgttaaggcgaaactgcatttttactcttttttttttgcggggaaaactgcatttttacttacctaaacatagcgtatagttctagtatttggttgttcaacctatgatggagtgctcagtggtggacgcagacatgggacggatatactcgataaaaacagctaattgcaacatatacttcctccgtattttaatgtatgatgccattgacttttcgaccaacgtttgaccattcgttttattcaaaatttttacgcaaatatggaaatattaatgtcatgcttaaagaacatttgataacgaatcaagtcacaataaaataaatgataattacataaactttttaaataagacgaatagtcaaacgttgaataaaaagtcaacggcgtcatccattaaaatatgaatgtagtattatataaggttttgggatttataccgaatgctctgaaattcgtctatttccatgaggcccaagacatgacctcctgttcattgatattgtttgacttgtatgctcatgcttccttgcaaatggcggaatattcatttttgctatatatagtttaaattgaggtttaataaagctaggatgccctccatattataatatataggaggctaacatgcatgtcaacacggttgttcttgttaagataaaaataacggcatcaccttaacgaagtttagttttagtatttgttgttgaacaaattaaagagtacccgacgagttagttgacattgtttacattgcatgctcacgcttccttgccaaatggtgggaattttttttctttagtttaaagtgagtttaaattaaattagggtatatataatcgggttggggtttctcttcatattataataatataggtgggaatgtggctaacatgtcaacattttttttacgtaatacctccttccgcgctaacataggaacatggctgttcttgctaagataaaactgcatgtacttaccttaattaatatactagtttagttttaaaatttgattgacgaaccaattaaaggtacttgacgagttagttgacattgtttgcattccgagctcaagcttctcggcaactggtggaaagttcattaatttttctatagtttaaactgaggtctaaattaatctgggcataaagttgggatttctctccacacagaggctaacatgtcaacatgttcgttcttgttaagataaatactactacaaaacagcgtatatatatgccacccttatcgatgccggttggaccaaagccggttctgataaggtttcctgccctctcatactcacgcgctctcaatcagtgttggttccttaaattaatgcctagctgcactgacactacgctggattagaccatctctgacgggttcaaacccttacctttgacaatgccataataactctgttcacctttgttgggtggacagtcacattttatatatgggcctgtatttttcgtcccatcagaggtgaggatcttcacaagcccacgtatgcttgtaacccgtcagaggtgagacacctgtgacgggtgcaaagtttacgacccgtcagaggcatccccttatctgacatacctactttggagccatcacaggtgactcacctctgacggactgatataccaacgctgttagagcttaggtcatctgtgacggtgtttgtttatgacccgtcaataatgaggtactttcaaaaaaaatttaaaatattagctagcttcaggatttgcttgccatgccctctaagaaatagatacatcacagatattccagccaatccccaatttcacagttttccacaattcagcacagatacatcacagaattaacatcatacacatgcattccaaaatcccacaaaaattacattgccagtcacatattcacaatgcacatgcctacctcacatttcttttgagcctatgaaggcacaaacttacccatttttatgagcacatgaagctgcaaacgaaacatggcagcctgagagatctgcttaactccagtgcgctaagggcgtgccagttggtttgatcctgcaaccagcaaggaaacaacaaacaaagtgagtgagccggtagccgattggccgatgacgtgtcgttagtgatcctagccgatatagttagaccagatcagctatggattgatgtgtaaattaagcacaaaccctaaatatgccacatcggctgtaatatcatctccttagttttgataaaatagatttaagacaatatcataaaaattgtcgatgtaacattatttagagcaagataggtaaataaaaataatgtactagctaatactctagtacaaacttatataaacaaattaatctataaaaatatatcaaataacgatcaactaccaggtttgataacctagccgatgttgatctaaacttgatatatttatatgaagtgatctgtctatataagtggcaaatatacataaaacatgtaaagtagcatctatattacgtaagatcggctgaaactccgatactatctctaattataattaattccaggttagtttttagggttctagacaatactatcataaagtaagtaatgaaacctaaagtctaaacggtcaagaaattaattacttttcaagatggtagatgccttagttaatctaatctagtaaggcaatttatccgatatcggcaagaaccctaaaacgagaaccaaccgatagagctaaattgagatactaagactagattaactaatacatatgataacagatggtcatgataaaaggattagaacatctaagatgatatattggaccaaccgatatagccccgatagctcaagccatcgagacgggttacttcttttcgagagaactcgccgaaaagaagaacaaaaagggtggcgatgcgccgaagatgtattggattgtctctctcttttacaatgatctggggtctatatttgtaccggagtacaaatttagtccattataggcacgactcaaactttcctaaagataagatacaaacaaagactacatcgcgatctcttaccaaatctctaacaaaccgacctaaatatcatagataatgcagcaaataggagttgttctaccaaggtcccacattttgcaaacattgcatgcaatttttaaacataataaaacatttgcgaaaatatagaattcaacatgttcgaaggaggaattgaataggacttgccttgctcaggagttactcaaatatctcttggtcgtgcacactctcatcaacagcaacaatcaatttgtcctctatttaaatttaaacatatattcaaacgaaaatccaatagaactccaagataaaatgtgatgcagggtgcatgaacatattcagtgtatagagggtgatttaatataaatttaggagaaataatcgcctaaatacgatgtcaaatgtgcaagttatcgtgtttctaagattttaaaatacactactattcaaatttaaattagtgaaaattttcacaacagtgatgctatgtttgagtgcgcagtattaaagagagagctattatgaaactaatccctcagggttgataatacttgttgttttggacaagggcattgtcttcaacaaacaactttaaccattattttttattataatatgtatataaatgttaacaaatatatgattttattgaagtattttttaagactaatatgtgaatatagtcaccatatttcaaagataaatattttagaaattattcataactaaagattttaaagtttgacctcacccttatccaaaacgacaagtattatcagcccggagggagtaacaaaatttggttcacgtcaatcggatctaaaatgaattttctatgattttccaaattttcagcattttatagtgcataaataattaacagaaaaccttttctcagatttaataatttgtttataaaagaaactaaagcaaactgtcttcaatacgttttcctacagggaaggcgcattttcgttctgtgtaatcattttaaaaccgtggggtccaactaaactaaagtttgcataaattacatgtaagtcctaggccaacctgtcagtgtctggcattgttcggaaagaaccctatattttatcctaattacagaacaaggtccttcttgttcaacctgggcacaggcagctcggtaggcagaggcgcggcggctcgggaagggcagcgtcgcggcttttgcgcggctttgcagtagcgcgcgcagctttgcaggcgtggtcggggtcgttgtgctgctgcgtcgccgcacgggcagaaggagagagagagaccggcggcattggagtggtggcgaggggcggcggcttcgggttggccgcggcgggctgcgaggtcagcgcctgggcgcggcagggcatcgggcagggaagcaccagccttgcctcagctttgccagcgggaatcgcgggcagaggttgcttggtcggcttggaaacgatgacctcgatctcgcacgctaggtgctcgatgaattgcctgaaaggaatagagggagaggagggagaaagagagctgggagatggggatggtggctggcaggtggggccaatggtccttaggcccactgatcagagagagagagaaagggagaagggatgaggtgaggggatttttctgggaatttccaagaaggctgagagtttgattaatttttggatatgctacagtgctcaaatgcttgcgcaaaaattactggaggttagtgtggtcaagaactccacttggtgaatttttgggatttttctcaagtcctgtttatttttgaaaattaaaacaagtttactaatttgaatcaaattttggatgttttcatccttttaattgagttgcaaaacttttgagatttatggaagtttatttcaagtgtctaccacttattttaattctttttatttgttaatatttattgcatgcaaaagtgttatgagatgcaaatcggttgtttttttcgtccacacttaatgctccatacatgtgtctaaacatttgatgtggtggaaattttggaagtttgaagggagctaaacacagcctctatctataaatagctgatgcatgccagcttcagtttctcacatccctcacagccacagccatagaccatagtactacaccacatcttctcccctacccaccagcagttcccagccatgtctgctagcaagctgcaattcaccccatgcagcacacccattcagggcaatgagatcaactttagcaaactctacctgcaccacacgccggctggtccaagaccaaaccagtccggggtcacaagcacaaacaaggaaaccgggttgggttccttggttgttaacaactggcaggtatacgacggaatcggctgtgacgccaaggttgttgcccatgcacaaggcctgcacgtttatgccggtaactggcacaactccttcaccctagtgtttgaggatgaaaggtaagcatatatttgtgtttcagtgtttgtgtctgtatatatgtgtatgcatgcgtgcgtgcatccttcggtatcaatggatgggttacacatacactctagcccctttaatcacactacaaaaataagttctacacttgcattttagaagcacatgaacattagttttttctcaatcaattgtaacgtggtagattaacattatgtatatgctacaggttcaagggttccactcttgaggtgatgggaatagttgttgaacaaggtgaatgggctattgtcgggggcacgggacaatttgctatggcaaatggtgtaatctttaaaaagttccatgaacaaaaaaaagaaggaaatattatggaactcactatcaagggattttgccctgtcttgaaagggtcaccgtcacaggtaagaacattaatctattttctatagctttgttaaatgttaagaagcacttgagataccatatcattatgggatatgtaagatgtacaacatatctatgcagggccttgtcaccaagattgggccttggggtggaattgatggaggcagagctcaagacattacagctactccaaagcgtctagaatccattacaatacacagcggctggactattgattcgatctcatttatttactttgaccaagctggagagaagcacagagcaggtccatggggtggtcctggtggggatccttgcacggttagtgaacttccattgcaatttttatttaacgacagtcatctaggagtacctcacagcccacaccacacacccacaattaatgaaaagaacagaacatatttggtgttaaattacttatacagtagttatcctttttttatgtagattgaatttggcagttcagagtttctcaaggaggtttctggaacgtttggcccatatgaaggctggaaagttataagatctattaaatttgtcaccaataagaaaacatatggtccatttggacgacaggaaggaaccccttttagcgtcccggtgcagaataactccactatagtgggcttctttggacgcagcgggaagtacctcgacacagttggcatctacgtgcatccgagataacatgtcaaaatcagtttcccatgtttgactttgaagtgtgttttctataataaataaatatgatgggatcctccctttcattccagtagtgatgagggatcctttctagctgaagtgtgtttacttctgaatttgcagtccttctgtcggtggtttcagtttgcaatgcattgtatgcatcaataaggatcttcgttgaaggttggtttggtgaataaagtcgtcattcagttagcaatgtgttgtatgcatcaataaaaatcttcattaaaagtttggtttggtgaatagttttcatccaatgagtatatcgatcatctaagctgaaatatttgtagtgcccttctttttgaagcaaatagtaccctatctaaggttggttttatatcaaccttatgaagtatgaaagcgaccgagttgtgtatgttaacttggctgctatttctcacatcacgacatcttggtatttgaaacggatggagtaatttatattcttatatttagtaaaggtatgttataagaaagagttcaatcatttatggcatcaaataaaaactaaaaattaactactaggattgcatgaaaactcttaaccacttcgaggggcaagatggggcatggtgaaaggcctcgttttcttttagtactagattcagcttatagaattgaaagaaaaacagatggcttaattctataggcggtttttcaacaaatggtaagatggcttgatgttgggtgctccaataacgtcggaccgggagcacatgtatactgaagattaacattggattatttgtaggaacacacaatataggcaaatacagtatactgaagattaacactgggttatttgtaggaacacacgatataggcaaacacaggaatagaaacaaaaccttatacgtacacacacgagctagcagctctcttattacccttataagaccacgttgctttatacatatagctacttatctatctattatatactaaaagtacattaaacatcctataaacgctcttaatccgtcatatcgcacttctgcaaacgcttctatgatgctacatggcactctaataaattagagaaattcctacaaattttaaggaaaacaaaacatctagttaatttaatttcccattgaaatagtattgaaatatccaaataacaccatatgaaacattaaataaagattaattacaacataaaaacttaaaatgtgtaacatactcgaattctcattgaaacattaacttctcatactattataaatgagttactcaccatttatcaaatgtagcatactatacatgcacgcgtgaaaatcgcggcttagcttcgtttgggattaattgtctgacgagttgctattgctagcctaatttcttccgcatcacaaacacaggagtagtacaagaattacttctttcccgatgaggaagggtgatcagtcaaacggattaatcgatcgtcctctcgtccattcaattcgataggagtacaggaccaatagcctctgagacaattaatcatacattaattggcatatgtcatccattgtgacgtcatccatgggtacgtcatcaaaattctcatgtgatgggcgtcatgacatcagggtctcacgagtaatttgtacctcagtcaaagagaaatttgcatatatgccatccttaaaaaccggtttcgctagaatgtcatcgttaaaatagaattcgctcgaatgccactctcaagctgtgggcattcgttacaatgcaattttctctatttcttacatttggagatcatttttcatccatttaatttttttctcagatgctttatcctctagctgcacgggttgaaccaaaccacatccactcgctctaagcaagcacgaggaaaggcaaccacgatgacgctgatgccacccaccacttgctccagtaccttcccatgaccgcgctggcgacaaccaccacctactctaccaccttccccaaccacccctttccccgagccgcaccgcctcccccgcggagccgcgtagcttcctcccgcggaacagcgccgtctcctggcactagagcgaggcgggcaagttgctagagttgagggaggtggagtggcgggctagtcgctggagtcgagggaggcggagcgtggcgggcaagtgatcggagtcgagggaggcggtggtgcgaatgcgacggagggagagggagcgcggctccgtgtggggaagctgcgtggctcggtggggcaggcggagcaggtggtaggcggctctggcgtggttgcaatcgccccttctcgcgcttgttcggttcttgaaaacgtagttacgattcacgagagagagaggatgttgtttcgttcaaaccatgcaggcaggagcaaaaacatccaagaaaaaattaactggatgaaaaatgatttacaaatgcaagaaacaacaaaaattacattgtaggaaatacccacagcttaagagtagcattcaaacgaattccattttaactatggctttctagcgaagccgtttttcctaaggatggcacacatgcaaatttctcccttgcctccacttcctccccttgctcgtgcctccgacctccgatgcatccatctcttccgccactgccgctgctacgggaatcgccaactcttccgccctcactggcaccgcagcaacttcctccctaatcaacatgctctcgcagaccgcgtcatcagtatatgcttcgtaacctctttcttcctcatggttgcattggttttgttattcttatgttgctttggcctaaatttatttgcgttactccattcaacagtgcattttgttgtttatttggggatttgatttgcatgccatatattaatatataagcgagcaatttgccttctagctatagggcttatttgggggacccc

SEQ ID NO: 81867 - DNA, 9849 bp, Oryza sativa
ttctctatgccaattgaagaacttgaggcacttgtacttttcccgtactgacatacgtagcctgccagatggcatcggcaagatgaaattcttggagtacattgggattacatgctgtgaacaaatacaacaacttcctggtagcattataaaactagagcggctaagatctcttaaccttatgggcacaaacataaaaagtatacctaggggttttggtcgccttacaagtttgagaacattatactcgtttccagctcagatgggtagcagttcatcaaaagatgagtggtgtagtttggaggagctgggacctctttctcagctcagggatctccatataaagggtttggagaatgtatctgccagctcttccgctgcaaaggccatgcttggtgccaagaaacatcttgccatatggtggttagagtgcactgataggcagagagatgatggattcttgaaagaggaaggaatcatttctatagacgagcagcgacgaatcaaggaggtttttgatgagttgtgcccttcatactgcttagaacaactttacatcagaggatattttggttggcagctcccaaagtggatgacatcaaaagcatctgtgaggcttgatagattgacgagtcttaagttggatggcctgccttgctgcaccaaactccctgatggcttgtgtcagctttcctgtttgaagcttctacagatcaggcgtgccccagccattgagcgcatcgggcatgaattcctgcagatacagcaacacaatggtgattgccatccttcccgagcagcggttgcatttcctatattagagacgctagagtttacagtagtgctggagttggaggaatgggtgtgggaggaacacattcaagccatgccactcctgcatgagcttacactagacaggtgcaaattgcgacaacttcctcttggacttgctgagaacatgccagggctttgagtgttctcaaattgttcatggtccataacctcaagtctttacagaatttgccttcagttgtggagcttcacctgtataaaaaccctgacatggagagcatcagaggtgtcccaaaactgcaagtgcttagcattaattactgcccaaagctcaaactattggagggaatacctgcgctgcaaaagctctatctgctagacttcagcatgaaaacactcccaggatatctacaagatgtaaagccaaagagtttggtgctggactgtagtttgccactgcttggtaacatatcaatgggggcctcttgctctgactgggacaagatcagccatatccagcaaatcagtggatatgcaggtgaaatgcgcatcaggagaaggtggtatgtgttttacacacgggagcccttcaaattggacacaaatatcgtctgctcttccatatctagaggtaaacattactcattggtgtatacttttgtcgacgtattctcttcctatacattatggagtattttggtattcttttcttatgttttggaatctgtatgtgcatagccaagaatagaatctagaagcttaaactgcatattatagttttgcctcctctaattaatccatcactgtatgtgcaaactaaaatatagtttccctggagttagtgtttatgtagagtatatggttagcctctttcttttttctcaagctccgttgtcatataactaccaatatagtgttcacttgataattatttgcccactagaataaaatttactacagtaaattaacgtctactgacgaaaagagagatatggatggaacggtttggatgcaaggcaaagcacatgatgcgattcatcaccttatcttgcacatcatctctatgaaacgtgattattgatagaagatttttccttcaagcattacatacagagctagattatttttgtctgcttgaaaatttcctagagtgatatgataaggaacaacagattgtttttcaccaagtagctcttcggatgagcttgcttaattagaccacaactaaattttactgccacaggtctaaatcgtagtttgagacggaagcccttcatcagtagcagtgtgtggatattcctaattaacctgagttgtatcgcaggcattatcgatggtttgttgaaggacaaagagaggcgcgccaaggagttgaggatggtgaagcttctgtgtgccctcctcgccgtcgttggatttgtttccattctgccacattgttatggattattgttgtaagataagacgacgttgccgccgacggatctcgccgggctgcgtaggctccttgccaccgcctcgccacagtgaggcgtagagatcagcactagaagagaagacgtacgggaacaactgtggaggccatgcagccaccgccgtggtctcccacatcgccgtttggtttctctgtagctcaccggcatgacatcttcactggctgcctcctccccacgcagcagctgttagcccaatctgcctccgatccttgtcattgtcattacctgtgattattaattgttgattgatctgatatccgcctggtctgggatatggcctctagcgttactcgcttgtcgtgcttcctgattgttgatgtaatttctgatttgtagggatgcctaattgtgaggttgatgatgttatgttatcagtgaataattcttttatgaatactcattcatcgtaacaatacacgagtaaaatttatttttacgtcaaggtgtctaccaacaactcgattgacatgataaacgggtcgggagatcctacaagagagtcaacagcttctgccgccatcctcctttaggaaagatatgaaccttgagtccttgatgtactcatctttttttttttgagaagggtataactcaagacgcacacttacacacaccgcactcacaccatgacacacttacacacatcctccttcaggaaagatatgaaccttgagtccttaacgcactcatctttgaaaggtaaaacaaagggtatatataaattaacgatctacaacaaagatatatagaagaagctcctcgctcgcatgttcagtagtactccttgctgcaatagcccatagccaccacactattacatatgtaataggaaaaatgagatgacactatatgtgccggaaagtctagaactgacacctataatattttttccacccgaacacacgcctgcagggttctattcaacacaaacagcacctatgtggcaacatatgtatgctggatgttaataggaaccggcacctatatatattcctcctaaaatataggtgccggtttttttcttctaatcaacatatttaaaattagctatcattctagttttttgaaaaccggtacctattgagcggtaggtgaagctgagcggggtgggataagaaaccgaccttaaccattcacctctctcactctccctgtccttatccatttggcttcctctctccctctcccatctccctactctcaatccatcagcatattctatgatgtgaatttgtgactctttttttaaaaggattttgtgatttattttatggagcatcacctccgcttgaattaagacgagcctgttttgttttttcagaaatgtagtacaactcataggtgcagattttcaatctggcatcgatgagtccctctcatcaataccatctccgtggtgccggctgaaaaatctagctcctatatgggattccctactggcaccgaagtgagttccgatagtagtatgtgccacccactctctccaataggagtgaaaacggtacgaaaatcttcgagatttcaggctgctgtttctggtttgcaccgatcatttcagtcggtgcaggcaatagttggtgttggaaatggaaatggtaatatgttccaaaaatggtagcaaaatgggatggaggttttttcgaccgttttgttgataaccctatttgtctaataatttctatcaaaattccaaaacattcctagtgtcccagccagcccaacccatcggaagcccatgaattgaggaagcctaataagcttttagcctattagaaaggagaagtgtccaggggaaaacgtgttaaccctagagtgtggcatgtggactttgctgaactttggtcttttcaacttatcgatgttgaagaactgttgacctttgtaattatattgttcgtcggacttattattatatcatcaatcatcacatcatggtgttacgtgaagtgtgatggttcaataatgaagttataaatttatcttcatgcatagttaaatgtgtggttatgtcacactccgttatttccgacatgaattttcgacttccgaccaatatcggtagatttcattccgacagtcccgttttcaatatatcgttattattgatattgttatcgttttcgggtctactgttctgattccattttcgagaaaaaaatataaaaataaaaatggcagagggtttcaaaagaaaaaaaaagatcgatgaagcttgcacacagaagcaacaagcaacacaggcacagccttcaacaccaaagcacaaaggtaaaacaaatccacaccgatcgagaagcatatatacgcagatcaacacggccacagaaccttagaacacacaagccacgcacagaaactacctcgccccgttaccacacatgcacaaaagcaaacgacaaacgcgtagttcttacgcgctctctctcttctagttttaattaagccctaacacagcgtacgtataaacgtgcacttatcgatcgtgtggcggccttatctataaaagatttgcttcggtccaataaaaataccccgaggtaccagtacctcacgcggtaacaaattgttttcgatcgttggatctaacaatatccatcttactcagctagatccaacgatcagaaataatttaatactgtaaggcaccgatacctcgaggtatttttttttcaccggaacaaatctctatctataaataccacatacacgccagcttcagtctatcgcatcgctcacagccacagccacagtagcacacaccaattctgatctgccaccagcagctagctagctctcagccatgtcggccagcaacaacaagctgcaattcaccccacgtagctcgctatttcagggcaacgagatcaacttcagcatgctctacctgcaccacacgccggctggtccaagaccagaccagtccgggcttacaggcaataacagagaaaccggcttgggccccttggtcgtcaacaactggccggtgtatgacggcatcggccgcgacgccaaggtcgttgcccgtgcacaaggcctgcacatttacgccggtaactggcataactcctttagccttgtgtttaaggatgaaaggagcgtaatgtataccgttaactttttttaaacatatttgaccgtttgtctattcaaaatatttaattaattattaattcttttcctatcatttgattcatggttgaatatagttgtatgtatacatatagtttttgatagaagtttttgaataagacaaacagtcaaacatgtttaaaaaagtcaacggcgtccaatatttagggacggagggagtatattgatctgtatgtatatatgtgtatgcgtatgtatgcatgcatgcacgaggatggatacactactctagctcttttaatcacactataatgaaagctaagttctacacttgtattttggccattagtttttttctcaatcaattataacgtggcagtaacctattggtcgatgtggtgttttatgtatgtgctacacgttcaagggatccacacttgaggtgatggggatagtcgttgaacgaggtgagtgggctattgttgggggcacgggacagtttgctatggcaaatggtgttatcttcaaaaaattccacgaacagaaacaagaaggcaatattatggaactcactatccagggattttgtcctgtcttgaaagggtcacaggtaattaaggacaaaataatctatttttagctttgttaaatgttatgaatcacttgacgtgcaatatcaatatatatggaatatgcaagatttacatatatgcagagccttgtcaccaagattgggccttgcggcggaattgatggagggagagctcaagacatcacagcaattccaaagcggtctagaatccattacaatacatagcagctggaatgttgattctgttaggaaacgataggcgaacaaacgataaagaataataaatcaatcacaaaagacacgagatttaacgtggaaaaccctcccaaaacaggagagaaaaaaccacgggcgccagccagcaaaatatcttcactatatctgaggtgaggttacatcgtcgcacggcggcttacaagaggtatatatatagtggaaccctaaaagggatgatgatccgtacggcagaagctggcctttattaagtgcaaatgaatttggatcacaactcaacaaactccaccttgagacaaattccttcttgtagcatgaatcaatcctttaccctgaacacaacaaagacaaaaaaaaacactttcggcgccaaatagcctctcgggctaaaccactataccaactaagcttgagcaaagctcaaacttagcaacaggaacaggttttgtcattatatcagcaggattatcatgagtacttatcttgcatacctttagcttaccttgcgcgactacatcgtgaacataatggtacttgatatcaatgtgctttgtcctctaatgaaacatctgatctttggtgaggcatatagcactttgactgtcacaaaacaagttaatgcaagaatcaactccacaaagctcagcaaacaatcctttcagccaaactgattatttacatgctggcctttattaagtacaaatgaatttggatcacaactcaacagattcgatatcgtttatttacttggaccaagctggacagaagcacagagcaggtccatggggtggtcctggtggggatccctacatggttagtgaacttccaatacgatctgtatttgatactccctccgtttcacaatgtaagtcattctagcatttcccatattcatattgatgctaatgaatctagacatatatatctatctaaattcattaacatcaatatgaatgtgaaaaatgctagaatgacttacattataaaacggagggagtactatattttggagtaacaatcatctatccctttgttcaaaaatatataaacctagtaatttactactatattttggatagacgctcgcccagctcacaccagacactcacaattaatgaaaagaaaatactaatatattgggtagtaaatttcttaccatacttttatatttttccttttctttgtgtagattgaatttggcagttcagagcttctcaaggaagtttctggaacgtatggcctatatgaaggatggaaagttataagatctattaaatttgtcaccaataagaaaccatatgggccatttggacggtaggaaggaacccctttcagcgtcccggtgcagaacaactccagtatagtgggcttctttgggcgcagcgggaaatacctcgatgcagctggtacctacgtgcatcctatctaaacagtcaaaatcagcttcccgtgtttgagtttgaagtgtattttcagctacaaataaatatgctgatgggggttcgtccctttcatttctgtattgtgatgagtgatgctatgtagctggagtactgtcagcggtttcagtttgcagtgtgttgtatgcatcaataatgatcttcattgaaggttggtttggtgaatcaagttgtcattcaatgagtatatctatcaagctgaaattaatatttgtaatgccatactgaagattggttttagagagaatctattattctatacaactaagtttacttcaactcaacggttagccatcaactttgtcttccttagtaatatgccaccgattttgtcaatgttttctacaatataccattggggtggatatttttcaaaaaaatgcctaaaatgccctttaatacatagagggtttataattgattgacctactagaaaagtattgaaaaaatatgaaaatttttacatagcctccttaaatattatgaagtgtgcgtatattttaagactttcaatttgcatgtattgattttttttttgaaaatatcatttatgttcaatatgctaatagaatactcatgcgttgatgttattttatataaatcatctttcatatgacacataaaattatttttctaatccggctatgttttgtgtatgtgattcatctttcatatgccataaaaatagttttaaaaaaacattgaagaaaatcctaaaatatatacataaacttctacattctgtaagaagcctacacaaaaactttcatattttttcaaaacttctaatgagtcaatcaattatcaactcttgtatggcttgaaggatattttaggcatttttaaaaagtatccacctcagtgtggtacattatagaaaaaattgacaaagtcaatggtatattatagaggaagacaaaatcaatagcaaattatcgaagtagagtaaactcagtagaataaaatagattctctcttagttttataccatcgttgtgaagtacacgaggaatattatgcatgttgtcatgaatatgcatgtacacgaggaacactgcaggaataaccactaaaataataaaaaaagattagcaacattagttagtattatctgaatttcagatttatttatctatagctaaaataaaccagcacgtgatcagcagaaatttgtaacctcttctcttgctactgcatgctcctccatactcctattgtcttgttgtgaagttgatcatcttctaaggtttaatgttgaatgtgactggtatttctaagcatttctcttagttttgacattatacagtttttcggcactcccataaaaagaaaattcaaaaagaacttcttgcttctttaattcgcaacaacggctgaatctaattgtgcttgtggttggctgaaaagtaaacaagatgatatatccaacaacgcctgcttctctttttaatttaaccaaggtagatctcatgcctttctactaaaaagaagttgttgtggcaaagatgaaggatataaatcaaactaaaatggggactacctagatatcactcgaaagattttctttaataaaaatcacactaatataattaaagcataagtatggtgtaattacaattacatcatttgtatataaatcataacaagattgatagcttgctcatttggttacaaccacacggcatcaaccaagaggttgtggcgtttgccttcaattttttcatctcaatgcacgcatcatatggtcaggaattgcgtgtgatggctatggaaaaaaagaaaatctttcgagtgatttatagtaaaactgaacaaaatgggagtggacatagcgcagatgacaagatgcaggcagtgtgctgcccgtggcccatgtttgactctccaaaacatattttttttactcaataaggagagagtatggggaacatttttttttaccatgttcgataatggggaacatgatgacaagatgcaggcagtgtgctacccgtggcccatgttgaacctttttttttatggttgggattaacattgcgctgggagtgggttcattccgattatgggactgagtgacaaatcaatacctataactctaatataagtgttttgatttattaaaaaaaattggcccctataattataagggatccaaggtggcagtttttaattttaaacacgtcca

SEQ ID NO: 81868 - DNA, 785 bp, Oryza sativa
aactggtgttgctcaaggtagacggctggagtaagagcgtcagctagttcatctgggagaagagcttggatgtctgtgaacctttcccggatcggtccacagttggttaccaggttatccaatgatgcttctagccgatgagagatgtctttgagcgttctctttacatcatcgggcagaagagctgttgctttactggtgatgtcttgttctgtttcatcaaggtaatcttttatgtcgaaagagaacagatcggctaaaacctgcaaaaggtaatatcgtggatgattaaggatcaagacataattgcccgatttcaagtttatatcaacagaacttactggaataacaggagcagctagttgttcttctccttcaacatgatgactgtctgcagccgatggagtgcggccacctgattccacctgcacaagaggagaagaagagggaggaggctgcaaaaaggataaatgttagacatagttggttcagattagctagagagacgatgaaaagtatcttactggtgcagccggtttaggagttgatgtagccgatttcttccttacagcggttttctttttctgtagttattaaaactatgaggaatcggctataaagtaaaacgaatacaaaaggaagtcgagagaagctgcttacacttaggaagtgaactggagcagaaggagttgaaggggtatgcttgggtgaagccgatggtgttctttctgtgtcacttatttcggctgcggcttgatcgacatcatctccaatcacttcttcat

SEQ ID NO: 81869 - DNA, 4609 bp, Oryza sativa
acgacgcgaacggagggcaccaacgggtagagggcgacgaggcgaactcaccggtgaccaaagcggcggcggaagagcacggacggcgccggcgacgaggaaaaaacggcggcgaagatcgggtcgacggcggcgacggtgctccggcggtcttcggcggcggtgaagcgacagacgaggacggcgacgacttggcgatcccgacggtggccttcccgagtgacgacgacgaccgaagcgacggcggcgcacggctggacgaacggcggcgatggcggcgcaaaagctcacggggctagggcgctacacatggcgagagacgaaggcgagggaggcggcgggtagaggagacaccgggggtccttttaaaggggctaagaggcggcggcgaaggcccatggcggccggcggcgagaaggaaacttcgggttcgggagagagagaggaatccgattcgatctcgaatccatcgacttccatatcgaattaggcgacgattccaaaagagaaaaggaagaggagatcgaggagattatttcccatctatcgattcggccggagaaggaaagacgcggccgaatttggaaggagacggcggcgcttgcgctagggtttcgggcggcggcggcggcgcgaggaggaagacaggcctgacagacgggccccacctgtcagcggctgagagagagaggagagcggcggctcggcggattgggccggactgggccgagggaaagagagagagagagggttttgggccggctttcggcccaaagccaaaagaagacttttaaaaacttttttcaatttaaattattcatgaaatgcaattccatttattaaaaatacttccttagctcaaataaatcccagaaaaatctaggaattatagaattaagcaaagtatttaacaaaattttatctagcccaattttatgttgagatttaacaaattaaaattagatcttctcttttaggcttttaaaatcatttctaataattccttttaaacaacaatttataatttaaggattttaaacaagaaaagcacttaacaattataattagatcattattgatcaaataattactgaactgttctttgtatcatttaggaattgagctctgaaaaatccgagaaaatctcagagagttgacttaaacatggagaatttaataaaaattaaatccatccatgctttatatttaggaaattttatttcccacatttaacttcacttgtaaattaaagatcatttaatatgaattctaataataatttattaaataatttataaatcctgaaacgaaaatcaggatgtgacagttccacactcgttggttgtgccctgccgctgcagcctccctgtcaccacagatccgcgatcaccgcgtacgctaagcgtgccatccatggatctatcactcgatctctctagtcgttttcggccacgctcggtctcgtctttcggccacgttccatcatagcaggtctaatcatcagtgaggtcatcgcctctacaacttccttgttgtcgccatcaatctcattgccatgactgatgattttctgtcaatgcacgaccgcacttcatgtttcttccttcgcatgtcttcttgatctgatgaaaccttcggctctattactacttgttataaaagttagttgatatagcggaacgacgactaaccttctcaatagcttcgtctattcatcacccaagacatgccagatgacgatataggaacacaagatatttgttaacgaggttagccgaaacctaatcccaggggctctgattatgggcgttcctccccaataaatatagcaccttagctgccacgagtacatggcctcgtcatcatcatctccctgcatgtttatcctacgttgtagtctacatggttatattgtggtgcccccctctctatttaagaaagatttttgggttacagagtgtgactctaactatacccctaccacctattacaactataaatccatttgtaaccaaatagaactagtatattcgatacttattctaacaatacgaactaatgatcataacataattgggtggtatagtctttttagtcttcttttttgaaatagaccgttaacatgtcatatgggtaacgctagtccaaaattggtgaccaatcgacttatggattgaatagagataattgaattgagggaataaaagcaagtgttacactgaaacaatctgaaccgaccaagttaaatcgaatgggcagtggccaataacaaaggtactttggagcgctaaattttgatctaatagataaaatttattgacttgatgttgtgcaattaaaagaaaggaaaatagctttaattgcatccaatggagatgaactttatacatatacatataggatatgcaaaaagaatgatagatgcaagaatttccattttgcctttctttaaaagaaagggaggtactagctagtacaataccttgggtggaatataatcattatggctttgatttcttgcaatcgaagcaataagaataatgagatcgagctatgtcgcggaacggaaagaaaataaaagaaaacaaaaaaatatgccagcatcaaaatagcaaaacatttgatgccatgcgattgcagtcattgatgaacgatcgatatatctctgctgatttaatttccaatgagaattcatttgtttctttcttccttctgcatatattgtttttttttctggtgatttttctcctttgttgaattactagcactcctctgtccttgtttaattttctttgtacaaaacaaaacgtatattcactcatcactcttccccatcgacactccatacctttgctgaacccacacttcttctcttctctcccttgattcttccctcttcttcaagggagtcatagatacttcatcctctagttctccttctcttgtataaattttcacgatgcaacttcggcagaggcaggaaaacattcatcatccttcagcgggtgcacagcaagacagcgaggcatcttccacctgcacctttgtgacaacaacgaccgacaatgtcgtcgtcgagcgcatcatggtttgcgggtgggcaaagacaacatcttttttttccttctgcgttgtgtggtggtcatatctctcttctctcctcgaattacttttacggtgatctcaaaaggttgccaacaaatacgttgcacgggctttttagtactattatacaaaccgtatgattttaattatgtgtcgggtgtattggttaaaaattttattttctgtggaaagattaataaattttattagtcatttaacataaataaaacttggtgataaaaaattatatagaacatgttgcaatattccatctgttgctatctgttttcttaatttaattgtttaaattttttgaatgagtaagtactgatttttattcatatggtactctcagtatagtttttgtcttgacttcattcagtaatttaaaactaataattaagtactgagtattgtttggcgccttgtttatagcttttgaatcatttaataattttgaattctgtatgtaacatatatggagttgtatttggcttggaatctcaagtatagttcttccatgatgtcataattctgtgactggtattaataagtacttgtaccctgtcaaaaaaaaagtactgagttgtactccgtttggagtttcaattatgctttttcttatgatttaataatacagaaatttataattagtcattgcctatttgttattgtattgaagtcgttgacattattccgaaattaggaaattaattattacaaaattaataataaggaattttagaattaacaagtatcaagctatactaagtatatccttgatttaatgatccttaaattcaaattgacaggtacggagtagtatttgtggtattatattttgaatcttgtatttcttcaaaattgactaacatgtatttttgttttattttaatctgatttagctgatatttgcgtgtttattttcttcggaatttcagttacatgtattatattttactatatcattctaattctacctcacagccagtggaaggccatattatttttcctttgtcctaactaatgttagaatttgtcctaattaatgttagaatttcttataggcctaacttttttaaagataatatacttcctctgtcctagaatatttcatttctaccattaagttttatcaaaaaaaatattatatttctaatgaggtgggacccaataaattaattggatgaagattgcattgcctcaaccttcactttaatcaagtcctctaataagattattgtggtcatttgtgtatgctgctaatctgagattcaattattctctaactccatactttttagcaaatgatactaggaaaaacaactccgccaaaatgtgctcgagtaattaactaataacctactctgtcctgttccataattcttgacattttgaataataacacggtctccaaaatatatattttactatgtttttctattataatatatacaataaattaggcaaaatttgccctgggacacctataaattgtgtaatt

SEQ ID NO: 81870 - DNA, 4913 bp, Oryza sativa
ttagctccgtggcataccagtgctccgcccgtgctgtgcctgcgcctcgccgccgcgcgtgtgccacaccgccatgcctgcactgcaccctcgtgcgagcaccacgccaccgcgctgcacagcgcctgcgctgcccttcaccacgccgactgcgcagctagggttgggatgggaaatttttcacgagagagagagatggggaggaagggaaggggctcctccacaatctccggtcaagcagagcacaagcgtgctagctctcccggtggcttgcctcgccggcggcggagacggcgacggtgcggcgcaggatggagccgcgggtggtgttggtgcttgcgctggtggcggtggcggcggcgggcgtgccgtcaatggaagcgccaagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgtttttcgggtgtcccccagctaattacataacttttgagtgtcctgtagcaaattttgccaataaattaataaagttagtttatttttattgtagtacattgtaagacaaatttatatatgttgttttaatacctttaaactaaatagctttaaagttactgatagtcaaagttataaaagtttgattttaaccttgttctaaacgtcaagaaatatggaaccggagggaataccattttcgcatgtgcccgctctcgactaatctcggtatattacgtactcgtacagtgatattagtatattaaaagaaactccttgctctttgtcttacattgcaactaattatgctactaaatttttcaagtaaaaacgtagtgcaagataatgtgatgaataaccaacaatcttgtattcaatcaagctgtataaaagggaaatttgtaaatggagatgtttacctgagaaaaacataattgctgcttcgtccatcatgggtgaacgtctgagattatatgcaaatgcgaacatgacaccacggcatggctgcttagttgctttcaatagcaattccgaatattcatatgggtacagccgtacatgagcgttcaatccaaatattacgtatggttatatacctttgaattctgttccacgcatgctaatttaatttctgtggaaaagattcttacaatatctatagacaccggtatgattagacttaccatcatgatgatacgatccacataaccaataactagatgtttctgattaatatatatggagctcgtagaaagtgtcaaattagtataggtatagttatactgatagattctactagcagtattagccagtacaaatggcctcaatggttgatttattagttttattaccagtagttatttatgatgatagtataaatacatatgatctattcgcgattctaatgcccctctaaaacatatgcgcagagatcttcacagatgacagggtgaggaccctatcacaccaagtctccacacttggggacagggtgtgggagttggagcacaaaaaccccaggctgcttggcgagaaaggtaaactggagaagcaattggaggagaccaaggccggggttcatgcccatctaagcgagaaggaaaggtggagaggagcttgaagggtgaaaatgataagcttcggttggaggttttgaccccggaggaaaaatatagccagtctgcagcagaggttgagaagcttcagaaggaattagttgcattggcagaggtgaaagaggtagctgcaaaggcatttgatgatgagaaagcaaaaatgatgatggaatctgtggatcttaagagtaggctagaggaaatccagggtaacatggatatgattaagagtgaaaatgataagcttcggtcagaagctttggttgcagagcagaaactaaacatatgtgaagcagagattgagaggcttaagatggaattgggtgcattgacagaagcgaacgaagcagctgcgaaagcatttgacactcaaaatgaagaaatcacgaaggagctagaggatcttaagacaaagttggaggaaatcaaaacaaataaggatctagcggaaagtgaaaatggtaagcttcggtcggagcttttgtcagcagaggagaaatacagccagtctgaagcagaggttaagtatcttaagcaggtaatgggagcagtggtggaggcgaaggaggcagctgcaaaggcatttgctgccgagaaggaagacattatgaaagaatcagacaatcttaagaggaaagttaaggaaattcaggatagcaagcttttggtggagagtgaaaatgatgagcttcggtcagagattttaagtatgaagcagaaacatggtcaatttgaagtagaggttactagcctcaagaaggagctgggagcactagaggaggcaaaggagatcaccacaaaggcatttgaggttgagaagacagaaatcctaaaggaattggaggatcttaagaggaaggtggtggaaatccaaaccaacaaggatttagtggaggtagggaatgataaacttcggttggatgttttatctgcacaacagaaacaaagcatattagaagtagaggctaacaatctcaagatggaattgggtgcattggtggaggcaaaggaggtggctacgaaggcattcgacgctgagaaagcaaaaataacgaaggaattggaggatgttaagaggaagatggaggaaatccaggtcaagaaggatttggtggagggtgaaaaggataagcttcggttggagatattaatagcggagcagaaacatagcatgtctgaattggaggttaaaaggctcaagatggaacttggtgcattggcagaggcaaatgagacagctgtgaagtcatttgatgctgagaaggaaaaattcatcagggaaatgggggacctcaagaggaagatagaggaaatccaggtcagcaaggaagctgctgaggaagtagggcgcaacaagaatgcagaggctgataggctgagggctgagttggtgaagatccaagtttctttatcgcaactacaagcatcctataatgaacttgatgctaagcattctctcctaaatgatgagaagaattcagcccagaaagcattagatgttgagaaggttgaagcatataagctgaagtcaaaatttgaggaacttgaaaattataaggctgaaaaggatgaagaggctgggaaactgaaggcggcattggaggaaaagaaaagtgagattgatgtcctcatcaaggacaatgagttgctgcgtctcgcaattgctgaggcacaggaaaagaataagggaagcattttatcatgcttatcaccatgcggctccaaataattaggtcgggaatgtgttgcattaataatgtaatggtgatcaattaatactatgcaatgaaataaaactttcacttcctttgttatatgtgatatgcaagaatgctaatgttcttgattagtcaggtacattttgtgatgtctctaaactgagtattttggtaaacctgtcaccttaactattactccctttgtcccaatttagagggcatgtaaattttttgacggtgtaccaatttaaagggtgtggttccttttccactgcttttcttcccggagtaccctctgcattcatgcacatgacgcttgcacatgcccgcgcaataagggtgtgtttggttcctcgcatcttcctagcatggcccatcttcctcatccaggttgagtttatcctgttaagtggatacacacgcagtcgtttggttgtttgcatcagtctagcctggctcgtaccagatattgtttggttgtttgtgcgatagatacggtttggaagagaatttgtttggttgattttatgagccatatgtatgaggactttttttttcctgtgggtgagattaccgattgcaactattttctatattaatatttttcttctggtaaaactcataaattgaactaattgtctaaactagatttcggcaataataaaagggggtggctatcaagctcgagaagtgaatgggtttggagacaaaggatttatacaggttcaggccttctcattcaagaagtaataccctactcctgtccggggatgaatccgccgagtatcttattgattgtatgatttggagaaaatcaacacatgcccctagaggcacccggaccccccttatatatgggaaggagtccgtattacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggacatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaggcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaata

SEQ ID NO: 81871 - DNA, 13936 bp, Oryza sativa
aagttaacccatacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgtgatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatacacacgaggctgtagtcttctcccatttcttctatggcggcttcgctcttccgacctcaaaatttttccgcgggatattaagcttctatggaatcagcttgcatcacctaaacccaaattccatagttcacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcatgcaaactggttttatattcagaatcctgagcctgctcttcccgagtactcttgtcttcctccggtgtaccaagatacctggaactctcttccgattggggatgaagcagcccaagccttggagctgatggatcgcatgctaaaactcaaagaacaaggcttacaaggagagcagattactcggcacttcatcaaatgccgattggcaccaattaaagaaagatcccgtacggtattcgagtttgacggcaagcatgatcctaatcgtgaagaaccagattctctggattttaaaatcatgaaggagagaatgtgtaaaatcttctcaaatgctattgtcgtcagctactcacatcagctgccagttgtgccatataacgcattcaatccgcctccgcaggtacgtatccgaaatcttcaacctatgaccaaaacataatcttgtcttcatgttgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaatctccaatccgactgggcagacaggttctcgcaagagaaagctggtgcttaatgatgacgaaggcgacgacggcaacaaatctggggacaaaggctcgcccaataaactcccaaagcataccactcccaggaaaaaactggctagtcgtccaaggccaaagattagaacatcttccaggtataaacctcttggcaccatttcacttcaacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactggaaaccagtcggcagcaactgaaactacaacaacccaagagcccccgattggaaaccagtcggatgtaggtccagatcaagaaactcccgaagttgaagcgcagacgacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcggctgatgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaaccatcatgcaaagaatccatcttcgcaatgaggccaagaccgcaactttagaaaagctggttcctcatttgggaactcttgaagcagttagggaccagctacacgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaaggaactcggccttgaaggaggttgaaggtactgccagctgacaatctgaacttctctctttttaatgcagtagatttttatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttacagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggattgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagaccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattatgataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatggtagctgttccacccatttaccggcatagggttttagccggtcaaaaactcgcgctttaatcccttgaagtatcatgccattggctcgctccacctgtccattgctcatgggatgtgccactgaggcatagcaaatcttaattccaaagtcttcacaaaagtcttgaaaaactccgccagtgaattgtctgccattatcagtgatgatccgattgggcactccaaatctatgcacactgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggcaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggcttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagctggggaaattagaaccactcctgctccagtgcccgaaagtctttttgatccgtcgaaatgcatggtccagtgctccatcttctccgcgggggtatcctcctggcactcggtccattcggcgataaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaataccatatagcagcttctgaacctgagggtacctcgttttggagtcggctaggacctcgctgacaaagtaaatcggtcgctggactttctggacatggccttcttcctcacgctcaacgactaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgtatttttcagggtttaatttcatcctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgcctccgtcgatgagggttctgcgaagcttgacgttacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaattctaccggggtgtcgccgtcgtccttcttcctcgacgtgctttgttcttcgtcggagttcttccgtgtagtcttggcgtattgctccgcgaattgcttgtagacgaaacaatctttggccacgtggttggagttaggatagtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttggctttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtaccttggaagttggcgatgaagtggtcgcgtaattcggcccaagatccaatcgtaccacggggcaatccatggagccaagatcgggcggaatccgctaaagccactggtaaatagttcaccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgagtgaacggaccgctcgtcgtgacccctgctcctgcgattggatcctgcgccagtgatgctgaggcttggatgacggtagtcatgagatcggaagtgggggagtcggctgccagtcggcgtgcggacgctttcggagttaactgggaccgaagccgcaatcatggtctttgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgatgaaatcacgcgctcggcgccctgcttccaaggctcgctgctgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtagttgtcatctaggcttccgtcgaagtcgtcgagatccgggtcgttgtagcgagagctaaactcgtcgtactctacgatgtcggtgggacgcgagtcgacagtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgctaaatcgtcggggagcttcatcaggatcggtgggtaagcctcatcatcttgatctggtgacattggagaagatgcgatctcgcccgagtggtttgaagccaactcgattgagatggtcttgaagtaactttcagccgcgtttgggagtccaaacgggactgaaatccggttctctcccgactggtctgactctgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgcacccctacctggcgcgccaactgtcgaaactagatttcggcaataataaaagggggtggctatcaagctggagaagtgaatgggtttggagacaaaggatttatacaggttcagaccttctcattcaagaagtaataccctacttctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacactaatgcagtcctacacagtaaactaacagggtatttattactataatagtggctacttattaccggttggagaaagctaaaaaatgaaaaaggagaaaagggaaaaatcgtgctagtcccttcgcattcctcgccactaagcacgacaattcgctgcttgctatctgctccgctgagcctggctgctcgccatcgttgccgcatccctagaccactccaattggttgcgccatggatctggcaaggatgacggcgacgacgacaagggtgcgaagttaatgaccttgacctcgacctcgaccattccaattggttgcgccatagatctggtggtgccgagctcaaccgctcgaacaagtcgccgccccggatctggctgcgacaagcttgtccacgaaaaatctgacggtggcgaactttcagtcccagttacttactgctagaagagatggtcgccgatctttgtcaagcttctctctcccttcatcgcgtcaccggtgagcacagtgaaacctagtttggatcttgtggaggaaaaatgaggaggctgggtgcacccttgcacacgcgggtgcagccgggtgcacgcgcgcgtgggtgcagcacgttgcatctgtcgggcctggctgaggtgcgaagctcaaatagagcgtttccccgcagccagcctgaggaaccctttttgaacgagtggagccaggctgggaaggtcacccaggcaaccaaacaaagagagaatgcatccatagatgcgggccaagctgaatgcaagaaacgaaacacaccctaactgatcaggcgacgcaactgcctgcacgtggagctgcacacgcgtgggaccacaggattacatgcatgcagttgttacagctggtaaaataacatactataagtcagctataaacacatatcgagaagataaaagaggagagagaagagcagcgtgctacatatttatagccagctgcagcacagactcttacacacaatgtgagtatgacaaatggaaccatgtaataatagtgtagtatatgtttataagtaattattgtatgaattggctattaagttgactatagttgatttggagctagtagttggctatactattaaacttgcacttagtaatctgcatgtgtttggatcaaacctgttttattaggggcagtttaggaaaaaattaactctgcatgtgagctcgttggtctcggtgaatttatttgtgcgccctctaaattggtacacaggggtgttgacggtcgttagcgattagtttcgaccatcaatattactaaaatagagaagaactagttatgcttgcaatacatatccatgttagaataataatatttcactagtatttggttcactaaccttttatagacaataaccataaagtggaggagaatcgacaacaaatcagatgataaatcaatcggacaatgtcgagaatcagacttatgcatgaatgggccaagaactcagaattgacacgaccaattgggccaaaattcacaagtctgcataggagagcaacggaggaggccatctgccgattttgggccaggcccgctgtcacgcccagaaatatagccctaaatttccagactattttgtgtattaaatccctgtccaggaccagccagggtacacaaaaagacaagtaatatacagttccaaacataaataaagcgtaaaatacttacagaaggggcacttagtccccacaccgaaacgaaagcagcagcagcggaaaaaggcgatcctaacggggcttcaggtccactccacaggcaaactcaactggggtctgagccttggtcttctaacttcgtcttcaactcagaagcactacacttctgaaaagggggaataatagcaaggctgagtacaaccaccgtactcagcaagccgcaccaatgatgcaaacgtgcaaggggatacaaggatggtttgtggctatttgcataaaggcggttgtaaaacattttattgagcaaaacagtaaaatagttgagtaattaaagtaaccttaaatctccactgatcaacgctacaccacgttgaacaggcccaaccaacccacctgaactacagtgcattaggtcgatttattaagtgtgagactaatcacggtgaatctggtcgaccacccataaccgcggacacggctattcgaatagttttactctgatcagaggtgtacaactgtacccacaagacacagccccacgacacgtttccgtgcgccgacatgccaacacgacataccggaaagaggccgtgacaggacccttcgcataaccccctctaaccgatcgcaccacaccttaaggttcgcccccgtccccagcaggcaacgggcagcccccctttcgtgccgcggtgaatctagaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaattgccatgggtgcgactagcgaaaccatgcacccacagcccagcatgtagtcgcattttagttggataattacgaccatgaagcatggccaggtgtctcgagcacgcagctcattctgatactaaaaaggtctaatattgtaattatcccatcaactgagctagtgttatttaagcagggctaagcatatagttctagctaggtcacataagtaacatgagctagtcgatttattacccacggttgacaaagggcagatatcaagtaaacatggcacaagcgagcagataggtaatacccgaatcccatgtaattaacaaaacatgcatatttatttgtaaacggtaaaatatttataaattgggatcaacatgctcaaggggaatgtgtgacttgccttgcttcttcaaacaatcttccgaactcttatccttgcgaccgcgaacatccgaaacgacggattctacacgctggcacgcaaaacgaggaaaaactctaataaagaccaagcaaacagtacataaaaagtaaacaatcatgtagagctcaattttagatgaattttgcaagttgaacggctcaattcggagttcgaatgaattagatatgaattttataagttttaagccatttaaatgaatttctataattattcacgaattattgcgcaattattatttattttctcaaaggaaaaggctgtggtaacgtcagcaaagggccggcaccgacaggcgggccccactcgtcagcggcacaaggggcaagcacacggtggactcaatccatcgcggccgaggcggcaccgtggacccggaccacggaagtggtccacgggaccgacgccctggattggcccaaagcctatccaacggccatgggtggcgcggctggggcaaggcacggctcaaagccggctggacgaacgacggcgcgcggcggcgcggccacccgcggcgacggccggtgacagctcacgcgggcgaaagcggcgcacgcgagaagagcaccggcgcggcgcggcaaggggga

SEQ ID NO: 81872 - DNA, 674 bp, Oryza sativa
ttttccggtgcgtgggggaaacggcgcggacgtgggcggcgaccgcgcccacgcatgcgcgggagagggaaccgcgcgaggaaggcggcgacgtggggagcacgggcggccatggcggcggttgtgaccggcgtgaggaaggggatgggcctgacaagtgggtcccgcggtcccacttgtcggcctaagggagagaggaagggcgagggggggggggttatgtagatttttcaagggagagagcaagcaggccgagcggatgggaggcaggaggccggcccagatagagagaagaggggagggggattgggccgggcccaaggggagaggggagggattttatttgttttacatttaatttaattggtttaaatgaactttgtattattataattacttcttgtgctccgaaaattcgcgggaaatttcagagagtattttagggcacaaagaatattacaaaatattcccgaccaatgatttttaaagggaaaattttaattctcccaataattcacttggataaattgcttaactttttatttaatttctaggaaatgcattattaaatgatttttaatcccgaacgaaaatcggggcgttacattcttgctcttggtagaggcagaagcgcccgcttgcttgctgctttgctttccgtgaggtttcttgtg

SEQ ID NO: 81873 - DNA, 5315 bp, Oryza sativa
ctgcagcccatatcactgtatagattgaaaccgagaggagtgtgcatgggatctcggactcaaaccgagaccgagaagaggggtgtgttttattttcctttttaggggggaatcggatctagagtaagacttttttttatttttttcgctatttatattgttttgacgggagtcggacctgagagggagtcggactttttttttatttttttcgctatttattttgttttgacgggagtcgaacttatttatttatttttttcactatttttttgacggacgaaggaaacctctcttattttttaagtagtagagatagagatatatagaaatactatatataaaaaatttaaattcaaattcaaattgaatcgggtatgtaaacttttgacttataaactttggatatataaactttaggtgtataaactttggatgtatggaaatactatatatagaaaatatttaaattcaaattcaaatttgaatcagatataattcaaattcaaatttgaaacggggtatataaactttaagtctataaactttagatgtatagaaatactatatataaaaaatatttgaatttaaattcaaatttgaatcgtatatataaacttttggtctctaaactttagatgtgtaaacttgaggtgtataaactttaggtacataaatttactaaaatagaaaattgatacggtaccaaaaaaagaaaatcaggtggagggagatcgctacccaatcgccctggcaatcgctcgcccattagagcttccgccttcctgcacactctcgcaggctcgcagctccggcgtgttcatgtcgtgtggctgactgcgtcatgctgacatgtaccatcgttgacatgtatcgtgctgatgtgtgcacaattattgacttgtggcagccgcgagatgtttggcgaggtgaagactagggtgtggtgggaggagatgttaggctgcagctgcacgcttgcaccaactatactctttctgaagccttaatttttaaggcaatttttgaccaatttttgacgaattacattagctgctgctagtcaccattacaagtgaaatgactcctccctccagccaaatttacccagttttgtacttttgtgccagcctgccatgtggtacatgctgattatgatctcttccttaacatttttatctggagaattaatgctaattaatgattggtcgtgtacgtgtcctcctgcatgattaattcgatttctttgtttggcacgtgtttatatacctaaagtttttatacaatgcacctaaaaaaatacaatgtacctaaagcatctataccagaaatttatgtttgatttggatttggattcaaatattttatacaggatgttgttatataaaagtttatgtctatgtaaattttgtgtgtataaagtgacatgtatagagtgaaaaaaattatacgtgaatattttatagtacaatggattttttatttagttaccatttttttatttttttaaaaattcatttgaatggatacgtgaaccagtagtaagggaggcgcggatgtaggggtgaaaacggagcagatattattcgatccgatccgcttcgaatccgtctgatgtgaggatatagtaaggatttttagatatccggccggatgcagatgcggattcggattttgtcatgcggatgcggatatggtatcaacgatatccgacggatgcggattatccgatattttaatcggattatccgatgtactgtttggcggataatccgcaactttcaggccacacaacaactctatttagcccattttacatcgggcggcccatctagcccatctagtgtaacctaatccaatcctcccctaaatctctctctgtgtgactcttctctcggtcccttctcttgctcccacacgcgctgccgcatggcaccattaccataggtgcgccgcgccacctttgcagcctgttggcgccaccgccgccgctcctccttctagtccaccgacagtgtgttgtgtgctatatggaactagtgtgttgtgtgctgtatgcagtgtgctactgtgttgtgtggctgtgtgttgtatgcctagatagctgtatgcctcattgcctcatgcgtgtcgtactgatgagtgaactactgaactgaacactatatttttaaattttaagcaacacagtgaactgctgaactgaacacttatattatatttttgattgatgtgttatattaagcaaaattatattattgatgtgttttggttggatttctctagagagctgaaatcatgttcatatgttgttttgccatcgtattgcggctaattgtattgccgccctcttgttttacggattgaatacaaacttaacatccgacaactttttgtccgtttccgaaccgagtccgcaccgacttcgcaccgaatccgacgtccaaaataatccgctctgcatccgcatccgcacgtcatccgcacccgctccgcattcgcttaaaaaaaatagtttaggatatgatatagctattatccgtccgaatccgctccgttttcacccctacgcggttgcgcgcgtgcattagccacatcctctttatcccaaactctcgtatgttatgcacgtccatgttaatcacccaaatgattaacatttgacactatggctatttatccaatccatgcgaccgtgagcaagtcgtcggaacagcgggaaccagagcactccaggtctccagccgtctctgtgagcaggtcccttgcctcgtggagatggaggaattacacgagaggcagcagcaacagctcgtctgatcctcctggctccttcgataccatgaacttgtattctggatttccagtacccaaaattctttcatcaatattgcatcatggctaatccaaaaatccctaaatttggccatttctaacccatgcttgtatattgtccattttatctcccaaaatcagcaatgcacagttttgcaagtcacacataagaaccaaatttaccaaagtgaaccaaaacatgcatgataggagagcctgctacagtaatacacctacccataaccttggtcttctaagcttgccgtctccctcctcgagcaatggccgccaccaccgtcatcgttgagcccgtagtccacagaagcgtcatcccattctggtggcgtcgtcgtccttatcgggcgagcaagaaggaactcggactcttaaagttggcacccctgcatcctgcgagttctggttaagttgtgatccaaattcatttacatataataaaggccagcttttgccggagcaaagcggaggcccgtttgaagctagaggcatgggccggagcgaagcggatcgttatccttttagggtttcaccttcatatatactccctccgtactcataaaggaagtaattttggacagcgacacggtctccaaaacataaccttaacttctcgtttctatagaaatatttattgaaaagtgatatatgtatactttttatgaaagtatttttcaagaaaaatctattcatataatttttatatttccaaactcaacaacttaggagttatttatgatttatattcctaaggtttgacttaaatattgtcctaaacgatttcctttacgagtacggagggagaacttcttataagccgccgtttggcgttgtaatctcaccaccgatatggtgaagatattttgctggttggcgcccgtggttttttctctcctacttcgaaaggattttccactttaaatctcatgtcttctgtgattgatctattgttctttattgtttatttgcctatcgttttctaacagctctcagctagtggcatcctcttaggctgattggaggtctgaggaggaagaagattccttgagaccctgacatgtgggccactagtctaaattgcacattggtacgcaacaatagctggtctaaagtgaaaagttgttaatacctagtctaatctgcatatcaggtaagtaaacctagaccaaaatgcaattcaagagggtgcatgggtgggaggtgtggttggtcgaagcctcggaggcacgcgaccaggttggtagcgtgcaacgcacatagtactagttctagcaattttatacaattatacccactttcataatcatcaattttacgaactgatcaacgtacatatttaacctatttgtgctatttatttgtcattccttagttagaaaactatttatatgctcaaaatattaaaacacatcctttattgccatccatttattattccagaataggatgattagatacatctagaaccacaaccgcaactcgaaattcgccgaattatgcaatggtttggtggttgcgtctgattacatgttgactcgtagcagcatgacgatgcaaagcagttgcttcccttgcagcaagtgcatggatcacactctcttgtaacggataaaggaaaatagccggcttcactcgtcgtgttcatggactgcattggaacaatattccgagtgctcttctcttccattgatcctgttcatctattcatatcacatacttgtgtttatttatttgtatgtgtaacaacacaacaattgtgtacaaatgattttctcacagcttagcatgaaaagtagaattactacgaattcttattaaagattaatatttaaaagaacaataaaatattaattcattttgccaagaacatattctgcaaacaaacaccacatgacataaagtaaaagagagcttttttaaaaaaaaaattggagcgcattcttgtaatgcataaataaataattcagaccaataaaatgtgcatataaacctttggcctgaaggccagtccagagaaggggcaggaaaacaacggtgagcgacatttgaaacagctttgccattgatggtccttaaatgttaaattgaccgccaattcctgcataaaatcaattgaaatgaaaccattttcacaagtattcataaatatttgtatgtgggcaattatgaataaaatagacccctcatacgacgaaatataccaccagccaaccaaacacaattacgcggattgaagcgcccaagaaaaagagcaaaaccgatattatggagatccaatccactatgcgcaatcatgagggcccacttatcagcctcactcagaaggttggtggccagaggcggtttcatttggcagactagaggaaaaccaatatccgaagcaagtgatagaattcacgcttaacttaatttaagaatcttatttaagtatcttaatctacatcctaagcctttattttagttct

SEQ ID NO: 81874 - DNA, 720 bp, Oryza sativa
tattgacctttgcaacggaggttaggtataataacgaacgaattgatgatcaacaaatgtagtcaagtttatcaatctggagacggattgattcataataacaacacacgtggaagaaataagaaattctgtagtagttgtattctaaactaaacttattcctttcgacgccttgccaggcccaactcggtgagaggcccatcagtctagctgatcctggccacctctaactaggccgggcctagcaatctgggccgggcaagcatagctggcccagccagccgaccagctcagcaaccgggcaagccgctgcaactctccttgctgtcctcgttgcagtgttacaattattgtagcaatagatcgtacagccgccggtgccgccaaaattggcatgccgcctccgccgctgacctgctatgccgggctcacacgcgatcgccggcgtcgatcgactaccgcttctcgatctcaacccgaccatcccaaagttagccacacgcggttgtgcctttccccgaccgatttagaccgggaatcccgctggatcgatggcgccgcccacactccgccaaccttgggagctcatcatgtcgccgtcgctccgccatacacagccgcggctctaaacttgggttgaaacttgaaacccccaacccttttttcttttttttttgagaaaaaccaaactgattcggatcgaggctctcgaattaagag

SEQ ID NO: 81875 - DNA, 577 bp, Oryza sativa
ttgatcccagccgttcccggcccaaccgaacaatgccttacagttttgtaatagcctggaaacagtgctactatggctccgttcaagtttactgcagtaaattaagtacgggcatgaaaagaaaatcattaacatataattaattaaactttagttactttaaacataaaaatagatttatctaatattttaaaaatagcttttatataataaattttctcatgaaatatgccgtttaatataatttaaaaaacgtgctaacgaaaactgaagtaacatctgtatctagccgggcctgtggtctaatcctgaatacgtggacatcacaaaccgatcctcacatggcctcttaaattcagcacagtacaattgaatatagcgtcgtgtatctacatccttgatgatcttgacgacgtcggaaagcgattcttgatactcaagtacgagatttatgaatcctcaattctcatgtcccttgagcagtacgtggacttctgctgttgccgactgaattcttggcattcaattctcaactgatcaacctaattcagctctcacatcaccgccggccacttgg

SEQ ID NO: 81876 - DNA, 1104 bp, Oryza sativa
ccggcaaaagaatcatgccagtaaccagatagtccacgctgcccgttattcaaaccacttaacacatgcaagctgccattgtgttatttgttctatgcttctataatagtcacaccctgagaccctctatatttgttgttcttcatcccagatgccgaaacaccaccacaacagcttgtatatatcaatcctttatattacaccaattgttatctctatctctctcacagacacaaacatcagctgctatgcttcctgttttgatcttgtttgggcttctcttctccctacagtgcaatttccctgcatgctctgccacaaataatggcagtactctcatggcaggccaagtgctcaccggtggaaacaagctcatctcaagcaacggcaagtttgcgctcagcttcttccaaacaggcagcagtaagtcatcagacaacaccaccttgcccaactggtacctaggaatatggttcaacaatatcccaaagttcacaactgtgtgggttgctaatagagataagccaataactgaccccatctttaaacagtcagaactcagagtctcaagagatggcattcttgtcatcttaaacaaggtggccaagtcaatgatttggtctagccaaattgagaatagaccaaaaaccagcaggaacaatagtgtagtgctgttagacaatggaaaccttgtcatacgagatgcctcgaacccatccaatgtgtggtggcagagctttgatcacccaacagatgtcttcctccctgaagcgaagattggtcggaacaagattactggtcagaaatatagttttacttcaaagaagaattccgaggacccagctctaggcttatattgcatggagttagacccctctggttctaggcaatactatgataagctttgcaactcgtccactgtgtacttttccactggggagtggaacggaagatacttcaactcagtgccggagatgtcaagcaatgttttatttgactcccaattcattgacaacgatgaagaggagtactttacttacactccatttgataaaacagtaattacaatctgcttaattgatgtatctggccttacaaagcagc

SEQ ID NO: 81877 - DNA, 1538 bp, Oryza sativa
gaagggcctttgtgggcttgggattacagtcacgtgcggcccataggccttaactgactgacagcgattctcttgcggcccatgtaatatggcccgaacaggatcgcgactgattgcaggccagacagtccagcccagcccaggacactttacggctgttttccgtgacgacagctgcattttgtctccatccatggctactccatcctgcctagcttgaatgctggaccgatcaggtgaggggaggaaccagttgaaggccagtggcttggcgttggcgttggcattggcattggcattggcaactactgactgcatcaacactctaccaagaaacagctttgccatgggcatgtttggtgcacctatttgggttgacgcccatagggtgttcgacgaaatgcctctgcgacaggagcctttgcgcgtccagattcagtgtatgggattccgccggcaatcaagttatgtgtgtgctagattgctaatactctctacttgcatcagcaactgactctagctgtagttgtacaaaaatctcaaactgcagagtggggactgcgcttattctgggagaagcagcagaacggccggtgcacagatactgatgtgatctgtgcctgcagcgatgttcagagaactagacagctccgattaacagcattgcttggacagaatcttaggtcagcccctttcttttcgtttaaacactttaatcaaccagaggcctgtgattttctttgtttggtctatgctcattgttaaaagatataaggagttgggttgtcttcaatcacacatatcgattcaggcaatgagccaattttgtgatctcgacagaatatggtattcaggaaaataggaataaaattgttcattgccactggatggtgttacaacttacaacaacgtttagttctggatattttgttttttcttctggggtcctttatatgcaattcttttttttttgtgtgtgtgcttttaaagcgtagtacctaatatacttgccataaaaaatgatctctatctttttaaaaaatagtgggctggctggttcagaaacaaaaacacatgaattgttttaagtaaaattttcaactaaaaagttgtctcgctgctagccttacacttaatttaaggatcttatattgttaggcactgttcttggtacaattgcatagcaatgatatcatttaggcataattaccatgaaaggaggtttgaccattaggaaaacaaaatatttcattcatacatgtttgcatccacaagtaactgaagcaactctgtcctctctctgaacatgctgagaggagagagagagagagtaaatattaaaacatcttaatagctaatagtagtgttttaataaataagtaagataatcaaagcttcaccagcctttccatctaggatgtgcacaaccattattttcgctatcaatagtgtacatggaagcaagataattattctgttgaaataccactgatctggtccaatttgaattcttgcacgtcacccaaaatactttcaag

SEQ ID NO: 81878 - DNA, 5651 bp, Oryza sativa
cggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacaccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctacaatttccccgcttcatactgacccaccagtatttctccttcaagtctaagtacatcttcgtactgccagggtggatggaataaggactttcgtgagcttcctgaagtatcaactgtttaagttctttgttatctggaacccctactcgatttccgttccatagggtcccgggtcatctttgggaaacccccaactttaccctggttcatatttttgaagaatccacgcatgtccgggtcgttcctctgagcctcgcggatttgatcgagcaaggtaggcttggcttccaacgcagccaagaatccgcgaccaactatgcttaggttcagggcttccatctgttgattaagtttgggtggaatgccacggacgttaagagtgttgcaatagctctttcgacttagagcgtcagcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaatgagatagtgccgccagatttttagagcatgaaccaccgcggctaactccaagtcatgggtagggtagttgcattcatggggccgtagctggcgtgaggcataggccaccacatgaccgtcctgcatgagcacgcaccccaatccttggcgcgaagcgtcacaatacaccatgaaatccttgcgagtatctggcaagactaacactggcgaggaaaccagcctttctttgagagtttgaaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgacggtcttgggttgcttccaatcagtgacggcggtcactgtttcggggtccacagcaacttctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaggttcatgaagaaggcaggagcattggttaaaccgaacgacatcaccgtgaattcatacagcccgtatcgcgtggtgaatgcggtcttcggaatatcttcttcacgaatgcgtaattggtgatatccggaacgaagatcgatcttggagaataccgtggcacctttaagctgatcgaacagatcatcgatccggggaagagggtacttgtttttgatggtgacctcattgagagctctgtagtcgacgcacatcctcttcgtcttgtctttcttctccacaaaaatcacaggagcaccctagggggaagtactcggacgtatataccccttttctttcaactcttccaactgtttcttgacttcggccagttcatttgctgccatacggtagggtcgcttgtacagcggagtggttcctggagcaagatctatccggaactcaatctcccggttgggcggcataccgggtagttcttccggaaacacgtctccgaactctctgacgatggggatttctgacagtactatctgatgaagttctgaacttctgacagaggttgggggtgcaaagaaaacaaccggttgttccggccctcggtacagagtaaccgtgcgtctcgcacaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcaaagggttcctaagcctttctacccccaactgatttctccccacgaatggcacagatataaacgagtgggaagctccagagtcgaacaaaatggtagcagggatggaatggatgaggaacgtaccaacgatgacgtctggagttgtcagcacgtcctcggccgtcacatggttcacacgaccccgaataacatccttaccaccattgttggagcggggaggcgcttggccttgctggcgcctcggcttcgggcatttatccgcaaagtgcccgggctcgaagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcatcctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacagagcggttgccttgcttcaactcccggaattcccttttcttaagggccatgactccggcaggcacatgggtcctccggaaagcggcggtgaaacgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttgtgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccctggtggttgtggttgctgccttcaggttggttgccatcaccggtattagcacttctcctggtcatcaccatctgaaaaccccacacagaaccagcaaacagagagagagctgacaattaaagctaaccacccacgactaccataattcttgaatttattactgctattaaattggttcattaaagttcaagttgcttagacgaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctccacgaagcaggtccacgccagggactgacgaacaagctcgggcctggaggtgcttttgcgggcggtgatcttctggctgcggtagacgcggtggcgcttggggcggcagacctctccctgggcgatcttgagctgatgcagctgcgcctccactgcgtctaggtccttcttgagctgcaggttctcctgatgcagctccaggatcttcaagttgttctcgaccatcccacggcgcaccatctgatggaagtcgatacgagccgcgtcgtacgcctccaccatgcgcgccaggtgcacgatggtagcgtcatcctccgagctagcatcccggaaggtggcgtagtcgcgggctcctccacggcgagggtggtagcggtagggcgagtgctacaactcgtccgggtagcgctggtgaagagtgccgatggcgaggagagcggcgttctggtaagcggcggggaaagaatctccacccgcggtgactgccagcgaagtccgctcgggagagccagtgaggatcactgcagtaacctcccacgcagcgtggggctctgcatcgtcaccctcctgatccggaagcggcctggcctggtagtccactccatgcggataccccaggacaacgcacatgccccgcagctccaagacgaaaccagtcatgtccaagccacgacggctgacgctgccggccatctacaaacaaaaacaaaaagaaaagcaacatttaaaaaggtcagattttggcgataaatgaagcagcaagacagagagagactagagggttttcacaaatacaaaggatttttatttcgaaaatactgctatggcttgggatctacggctcgtcctagggtcaagggtggctctgataccaacttgtcacgaccggaaataacccaacgggcgttccttacgtgcgtgcattaatccttgtcccaggaggcaaggtacaccaaaagttgatacaattcaaagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaaggtttagg

SEQ ID NO: 81879 - DNA, 779 bp, Oryza sativa
tgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctttggatatttttttttttggttggcaagatctcagtgttactgtttgcttgctcatgtagatatatatatgtcagttaactcatggattgtatagccagtttaaaacggttacatataccattagctaagcttcctaagaagcagaaatttggcctatatgctgatgaaagacagctgcctccttagcttccattgcgtcaggtgcaccttccctttgtctactccactaattatctcatcaataagatccttaaagatggatttttcaatggccaaaacaattccttgccgttcactgtcggagctcttccactctttcatgccttgcattgcatcctctgctagcctg

SEQ ID NO: 81880 - DNA, 3723 bp, Oryza sativa
aaatatgaggattctggcgaacacatgggttcctaggtattcctcggaatacccgaaatttatattcgaccattcaatttttgtgcaaatataaaaaaaattaagtcatgctttaaaacatttgacgataaatcgaataaaaaatgataattacattttatttaacaagagaatggtaaaacgtactggaaaaagttaaataacattatatattgtgaaatcggagggagtatttggcacggatgcaggtcgtctgcagcgttgtatgtgcagttgcagtactgctcatttagcggtatggcatgggccagcgccttattaactccgcactgcagcagccggtgtcacgtacggcagcggcgtgcatgcgtgcatccgactgcaggtgatgcagccagagaagcttttgctattgctcgtgatgcccgtgagcgaggcgcacacacatgcgcacacagtcgcagtcgctcccagatcgacaccgtgcggcgcgcggcgatgaacgtctaacaggtggtggcgccgatcgaggcgcgaggttcgcgccttggcggtggcggctaactgcttgtcgttcgtgtctacgactgcacccgcaaaatttatttttcacccattccacgcgtattaatacaaaaccaacccaatttcaatgtaattattcttttctcaaagaaatatggttcaaaagtatacgcaaaaaacacgcgtacacttacatctataagcacacacgcatgtgtcgtcccatacgccctcggaagactcgccatcgccggtacatcatataccactgaaagaataatttgttgtaaatatgagcacttattgactcatatcaagtataggatttaatccgagtgggctagttccaccataacaaatctaatctgttggcactaacttcattcttttttttattcataatatcttgattccctactctctctatcacattttaaacgtagttataagtttccgtgtctaattttaatcgtccgtgttatttgaaccatttatgagtacccgtgtctaactttgatcgtccgtgttatttgaaccagccataagtacccatgcttccatggcatgagatgggacgtggggtcgctgcgcgtcagcgctgctcacccgacctgcaggagatgtcccgagtaaattgtgagatggcaggcgctgcactcgcacagtactaaaaatgtgcgcgcccgtgccacgtacatgcagaatagcagaattcatatgcatcttacaaaaatgaacgtgtaaaaatcaaacagagatagcacctgcaaattaatgaaatacaccagaaccaaatgaaagtgccgatggatgaaacgagtagtttgtgagaagataaccgactgaattttattactactgttccatcccataatataataaattttaactatgtgtctaaacagtccaaaaataaaagtagatacattttaaaactctatcccataatataataacttttaactttttagaacagtgatagtatgttgataagttgatttaaaaggttttctaagattgtcgtcaaaattacgataattgaaccgtttagtatcttaaaaagtatgtacgcgataattcagtgtccatagtagtaataataaaaaaatagcaggctcattctatcaaaataacttgagagctatgttcatcagctcctggatatccaatgcatggcaagtactcaaggtataattgggcagaaatactctcaagcagatctagaaatgtgctttccggaagtaataattcatgtgtatcatgggtactatcacatcgtgccagatcgaaagggagtgtccaataccaatcatacgaccatgcacaagactacgtagagatcaagcaattcactacctgtcaacactagtacaatttggatcaatgctactggaacgaaagggatatgaatcgcacaaacgacctgccagaatcatgccaaaacagtgtcagaaagacgaaaaggcattgtcgattttgcttcaaaaggaagggatacggcaagtgaggaaaaagttcaggcaagaaagacgtccaaactccaaatcaccttcccttcggcggcaagccagtctcttttacgtacaaatttgacatgacaactactttggttcaaagaattggcaagatcacaaaagtcaggacatgaaaacaaaccaaattctggtacaaaagacacttaaaaatatatgttttggccgccaaaaagcactttaacaagtactcctgaaagcaggtaaaatgcacagaaaagcatagcctcttgttgcaaaagattacatacgtctacaggagaccagatcaaacttggcagtaagaagagaacatgcagggacgacattcagggtaagttttctgatattgcctcaattaatcaaatattcaaatgggagcaaaacttttgtaatattccccaatatctcaagggctccttgctatcattcaacctaattaatccaacttgtgatgtgaacctgctatccttggctttctttggtgccaccagactccagtctgatctgcatccagaattcatttgacactcaaaatcccaaagtgaggcttctcgtctagtggacactgttaatcagttgaggcaaaaatgtgccatgtaggatcacatgacaatctcagcaagcatcttgctttcatcaagtcctcaaatcttctgacattgcggaaggtatacaatgcgttgtcagaatatcctgagtagcagcctttgccgtttttgcctcaagaacaaccagctgccagatgataccagtcaattggaaagtgctcacaggaagtagcattgaacaaaagaggatgataatttcactatgaacaatggaagagagaaagggcgctaataatccacatctgatacctgatcgtagtccatatcaaattttaagtattcctcgttacaatcttccaccatggttgccaagtgctttaaattttttactggtttgccattgaaagaaagaacctatagagaataaaaacagtaaaacacaattaatttaacacatcaaaggcaattttgttcagaaaattttggtcttctactactcttagatagtcaaatatagcaatcagaacaataaaatgtccattacacttggtaactaactaccaatgttgttagttccctcctgagatttatttccaccaatttcaaacagaatactgcttatggctgttaacttagctaatatatataacagcagttggagacaaccaattctgatcagcatcattcaaaatatgaaccggtgtagtgcaattgatacggtcagttgaagaacacccttttctggtatggagtatatatatgataacttgtgaaaataaatctcaaaccataaaaatactttcagtagtgatcattgttacctgaatattgacaatttcttcataaccaatgttgatatctgctacaagaacctgaaaattcatcattttttttcaaaaaattgtcatatgatgaaataataaataccaagctctaaataaaagcaagaaaggttagccatctcatttataacataaaaacataggttagtacagaaagaacttgagacctgtgacaccaccacaagctgctcgtcaggtgattgagccattgcatgtaagtgcttgtccaacaacttgacaggggcatcatactcatagtcttttccatactgatgaaataagattgtagttagt

SEQ ID NO: 81881 - DNA, 1182 bp, Oryza sativa
gtcaacattttcaaccaaaatcggataagcaactagtagtccaacatagaacagacatttgaaagatgtcattcaggtggcaatatcgcttccttctacaaggttggtgaaaatgacgcgtgaaacatatagtcattgatatttgtgaacatgactaaaaattatccatgttttcacacacaccagagcacaaacagaaatactaaatcactacaataaaataagttgacgataatatataaggtttgtgaaagtctgttaacaaaatacatatacaagactaagcacgcggtatatatatatattcaatttaaaaaataaagagataagttaaagatgaaaattacaattaagatcaagctttccaaaaatgcaacaaaattgtactgaacatcgtacagtagtagaatgaaaaattgacaactgaacaaggatgtaatatcttgattattatttcacacataaagctggacaagggagatgacagcatacctcagatcggagatatggaacagaaacaaccataaaaacgaagcctgcaacaatgtaatatgatggtggcctgccctttatatgagctggaatgagtcttttgtgagttgccagcttaatgttaaattcaagaactttcgaattccgcagaattttgacatgggccttctcgccagtgtacttctgcgaaatgaggtagctgaagccaatacgctccccatgtctgaaaggaactggataaccaagataaacaaaatgtaagccaatactctcctccttaagtcatacttcgtaggctacattggagacaaaccatttggagaactagtaataacagatgacaagaactaagacatgcagcagacttttaaagaagaaaaatcccaatgctttgtgctagacaatacgtgcacgttgaatgatgtcatttatggtcagtggagatctccattcaataaccccgcttagaacgaatccttccagaaccaaataatctagaaatggcacagggagtggggactagaagttgaacctgagacaatggaatctctcttgcatgaaacagagtgtcctagaatgcatgctcccaaatagatacaagaataactggccaaggcaaacaagttctaaaacaaaagcagtagaaataatcgctagttgtgtaaagctctgactaaccgggctgcagga

SEQ ID NO: 81882 - DNA, 2109 bp, Oryza sativa
  unsure (1)..(2109): unsure at all n locations
taatagaatttaagggataaaagtattctccccggcaacctaatttaacttttaaaagaggtggacataaaagaaacttccaaataaatccattctcttttcgcactccagtgtatggccccttcttctcctgacgtgcacgaccttaatggttgggagctgaaatctcgctcttcacaagtagggataaatattttcggaagtttgtttagggctaatgttgaagactatttttttttcttaaacaaaaacctaaaaatttaatgatttggagtagtatagctgatctcacgagtatatttcccaaacttaggggcctgtttggatgcccacctcactttgccacaattttgtgtcaaaggtgtggcaaaatgtacattgtggctctataattgatgaccacacttgtggcaagctttgattaagaaaaaggtctataactagtgggatcaaaagagatctaagaaagtgcggcatgctaaaattgtagaatcaaaccaatcctagctatatttgatcatattaacctactgcaagtgtagcaacatgtggcaccaaccaaacatgccttaaatcccagtcggacgtacgtgaaaatctaaccgcccgccccacctcatggcatgattgaggagatcaaccaccggatcggtggccccactgtcttagctaaaccatagccccacgcattagtgggtgagagatgattaccgcctttgggtaaaggaaagccagtcatagtattaaaccctgagtgccatattagctcattcatagtgtgtcctactcatttgaggagcttcggagtgccacgtaggtttaggttacagaattcctaaaaaatccttgnagttcttcnaatatttctttcacaatgcacctaggtggcattcagccccaacatgccaactaggagatcctttccacgtctgtatctgtcatgccccaagtatgctcctcgtgcaaagcaagcgagaatgggccagacgagcccccagtcaaagccactcgcattgtaagaatagtttcttatacgttcttcagcttatgtggcacatagctttttcgtgagtctcctcatagatggtagcaacactgctctttccctgcaaagtggctttagaagtggcttcaattttatagcttatcccctattatttttgtagttctcattttatttttcaatttatgtggaggtccaaaatttacaccgaacaccctaaaatctagaaaaaaattataatacccccctctcctttctcccttatcctttccctacttcggcctcctccttcggctaccctgccgcatccctctctccttaccacccactatcggcacccctctcccccttcaccactttccctccccccaaccgttgcccgttggtgtggctctccctccaccttcctcgtcggggcgccgtcggaaattgagcgacagaatggcggatcgaagcgacaacgagctcggcaccacgtgcgtgcgtggatggcaaggagctcgagacggatctagcaatgttggcgtgtccgtctcgtcggcgcgaccgggcagagaggcggccaaagcagcgactgtgtcgccaagcggattgacggcggggcttgctggatccagcctcaggcggcagtggcggcttgctggatctcccctctctcccatgggatgagctcgacgatgacacggaggctaggaaaaacgacaatgtgctcactcactcatgcacgcgggagcgggagggcgagggcgagcgcggtaggacgatgaaatgaggtcacgacctccacaacacaccgcttttcgcccctggattagaccgaggaacgagtgaccaaagttggacgcttggacttcagctcggtttggtagaagctaaaggctgtgtttagattcaaaatttttttcttcaaacttccaacttttccgtcacgtcaaatgtttggacacatgtatggagcattaaatgtggacagaaaaaaaccaattgcaccgtttgcatgtaaaatcgcaagacgaatcttttgcctaattacgccatgatttgacaatgtgatgctacagtaaacatttactaatgatggattaattaggcttaataaattcatc

SEQ ID NO: 81883 - DNA, 1041 bp, Oryza sativa
cacacacacacacacacacacatatatatatatatatatagctaatataagtctattttatgtccctacttgttggcccatgccatataatatgtgtatttttcatccctattctttgtgccgtatcttacatatggttgaaaataagtctgtttcacatccctgaacttcgtgtcgggtcctgccggcccagcgtgccaaggtaacagcccagacatggcactgccgtgcctgggccaggccgtcgggcctcgggccatatggcctcgattccacgcggcgcgtggaaccgcacacgcttttggctcggctcctttggcagaactaactatgtggcgctcgcctattaccaggccgcgtaccggttccgcggcaacacggcgtggctcaacttgcccgacaacgccgcatcccgtgggttgcttcacgcctccgtggacgccaagctctaggctgtgccagaacatcatggccgccaagaacgccaagtcctccatggcaccgcctccacttcagtctctgccactgccacctcctccgcgctcatcaacaactgctccttctcgtcctctggcaatgcaccgtgcgctgactcatccctttccctgtcatagtcgttgttgatgaaaaacacgaggcctgagagatctgcttaactccagtgcaggtccaaaactcgccttcgggtatgctagcatgccagttgatttgatcctgcaatcaacatgaaataaagacaaagaaagaactaaatcgataaacgatagccgatcggctaagtgccgatgacatatcatttatctttgagccgatgtcatatatatacatcgatcgacagttataaatgaataataaagaactaaatctacttgatcggctgtagatattaacaatatataatccttatgtggatatatacttaaatcaagtgattgggatagatcggtcgccatgccgagacagtataaatcacttagattgaaatatatacaaacaacaaaactatatatgttcatagcatagccgatcagatagatctag

SEQ ID NO: 81884 - DNA, 1305 bp, Oryza sativa
acgatcttgccagatcctcgttgaattgccatcaccaattcggcgcacaagccccttgaacagaatatctcttctcgctaatatagctctccaagtatggcttgaatgtttcttccgagtggcttgtaagaactctgactcatgatagtatctgcctttcaacactcgggcacatagtgaattaggatttttgatcagtctccatccttgtttacctaacatagctaggttgaacaatctcaaatctcgaaattccatgcctccatcagctttcggtttagtcagtagttcccatcgctgctagtgaatgcgtctgctatctgccgagctcccccaccagtagttcgctatcattgatttcattttccgacaagtatcctttgggattaggaagcagctcatgggataggtcggtacaacttgagcaactgatttgaacagcacatccctacctgcacaacttgcttcacggccactccatgttccaactagatttctgattttggttggcataaattcaaaggtgtcctttgttgcccgccccaaggcagtagggaggcttaggtacttctccgctaatgcttccatatcaatatgtaaaacttctcttacctcccgtttgcatgcattatcgcagttagcactgaaaaagatcgctgatttatctctgttcaccaactgtcctgatcctcggttgtataagtcaagaatatcttgcaaccgtcaagcccctctctacgaagcttctaagaaaacaatgcagtcgtctgcaaacaggtgtgaaatccatggagcgtgtatcccaacctgcacacctctggcaagatgcaccggtccaaccacccttaagaggcaggagagaccttcagcgcacagtaggaagagatatggggagattgggtccccctgacgaatccctctcgacggcttgaacgggttcgaaagttgtccattgacccgtacagagaaagatactgaggtaacgcatctcatgataattcgcacaaaactttctgcaaatcctagttttaacatcgtaccttggagatagtcccattccactcgatcttaggctttcgccatgtcaagtttgactgcgcatgcccccgtttttcctttcttcctctttagatagtgagtgcattcataggccactagcacgttgtctgtgattagtcttccaggcacaaatgcactctgttctgcagagataatctcatccaagaacactcgcagtctattggcgagtacttttgagcacaacttatagaccacattgcaaagagagatcggtctgaagttctt

SEQ ID NO: 81885 - DNA, 768 bp, Oryza sativa
caatatgcaagtttagtgtcacaaatgtggtaccattagatatttttctggaagtaacttcttgttggcaatatatttgaaaaaaatattatacatcaactttcaaattggttttgttattatcaatatatactttcagtaagctcagttctttaattgctgggcatcttttttataatactattgaatgaattggctagtttccacatccagaatggacaattgagtaattcttgatcattttagcctttagtcctgaatattgctaatttcacatgctgatctttatgctgcaaatcgaagttatgcatgaggtatgatttggacacttgattgtccttgtaaaccatctctcttccttttgggcatatgttacgtatgtctgctggtaaattgtgaatgcttggttggtgtctggtaagaaaggatcagtctacactgagatagaaacatagttacttatccactatttgcagtatgagattgaataatttctgattcatggggcttacttatagttctctctggcaatttcattgtcatttcgcaggatcgcccttcgaccaaggtccatgctgcccctggtggtggatcttccctgggctacctctttggtggaaactgaaggagtgatcctggtgcactgtagcaccggatgaagaaggaagtctaccgctatccttgtttatcagaactgggaacccccattgttttatcattctctatgcatgtcccgtacctatgactccgtggcaaacaccctgcctg

SEQ ID NO: 81886 - DNA, 1084 bp, Oryza sativa
atgtggggtttcttagtacaacgaatctgaactattatgttggtttttttttacggagggagtatgttgtttggttaaataaaaatgatattgctttttagaaaagacgaaaaaaaactgcatgtctaaccctataaatggctgattttcatgtgttatttggatgagtacgtttttagtctttgctcaaaatgaggcatgacaatcagtcattgttacgtcaagtctcacttgttggagcagacaacaatagaggtgttcttcaatggtgatggacagagacgtggcaaccggatttgcgaaagttgtttctctttcatatcgaacttttgccaaacttgtttgtgtggtacggtagttctactgtaatagtgttgatcgctgtgtataccatggtcagaatgttttgaaagaaatacgaagaagggtttttttaatcattatatatcctgtaattatcatggaaaacatttcgttttaatttggaacggggggtgaaatagctgagtggactaaatagacagaaactcagaatgtgatagatagatgcatgcatgcatgtatgcgttcgtggaattccatcgatttctggcagcaaatcaaagatgcctgcatgcgaacggcaaggtgcagatgaagtgatgtagaagtagctagctagtcaacgaggactagctatagctagcgctagttagaccattaattcacaatgctcccatgtggcttccacccctaagggccacccccggagaccggaaatatttcggggtggccattttccctcccaccagcagagcttttccaagactgggtagctctttgccatcggttcctcatcagtttttcaggaagagagaaagagagaagaggagagggatgcgtcgtcgtccccatgctccacgccgccgcggggaggaggacgaccggacgccgtcctcgccggagaagctcgccggctcaatagggggaaagcgacggcggcggtgaagatcgatttggcatcggcgaactcagagagagaaagaggggaaattcggcgagttgtcactccgcccggctccgcgaggaccaccgacggttgggg

SEQ ID NO: 81887 - DNA, 10115 bp, Oryza sativa
acgacatccccgcgcgttgagtgaacgatgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaatgtaataaacagaggtctacgatgaaacaaaacaattcttttttttttgtttgtttctaaagcctatgcgcgttgagcgattctttcaatttactatagcaggcctgaggcaaaaaatatactataaacattagagtttaggataaggttcggtccaaaatttaaaacattgatcatcaattttatattagaacaagttcagaaaaaaaaatctaataactttacgatattacgataatacttttcaaggcaattcacatataccattaaacttaagcatctgagaaatcattattggtcaaagttttaaaagtttaactaaattttatcttaaacattaaatatttatgtatggagaaagtatcatgataagtaggagtaatagacacatcaacatagttttgctacaaaaagtactgcaatatttttttctttacttcacgctttttcaccatgtgattaattgctaactctacctactaagtagtaagtatatgttcgtctctctcttatctcttattttttgacttccatttttcattttttaatttatcagtccattttgcaccgttaattttcaaggaatctagtagacaattaattatttatgtcctagttctcactagatatgagtactagaaaaacataggcttagttcggcatcctgagttcccaacccatctccctcgtgttccgcgcgtgcgcttttcaaacaaataaacggcccgttttttacaaaaagtttctatacaaaagttgcttaaaaaatcatattgatccatttttgaaaaaatagcaaataattaattaatcacgcgctaatggaccgctccgttttccgtgcgcggaacatatgtttccaactagcagcagcgaacacagcattagtcatgtgatttgcaattcatagttaaatatataaaattccgtgtaaaataatacaatgttaaatatatgctgaaaaatttgagttttctattttctccttgagatacttcttcttttaatttacctttttttattggaattaatgtttttggactagttatttttgttttgtttttattttggatcatctaaactctgttttgtgagtacattagcatcctcataccgacaatcatcctttttacgtgcaactcatcgtcaagaagagtggttgcatatgcctagataaacgcatttgggtggtccaaagtgcattaaatgaaaaaaaaaagtaccaatccaaagtgaaaaagattcagtacagaatggtttaaagtaaaacagagaagctaatggagtagcgcactgtcttgctcagcttgcaagacggtcgaatcagtagatagtgtggagaggggaagccccaacgtgtgtttctgagcttttggctcatgattgtactcctaatacttgattaataaagctctctgtttgcggaaaaaaaaggggagtaaaacaatcggtaatgtttggctaatagaaatgggaaataattttccacttaccaaaagacatctttaaatcctaaccatttattccccctcttccatttaatcctaaccctttattcattttacaatcccgatcctttccctattttccattatccaaacacacccattgggtaataacaaccggtgcaaaagtgcgattcattccttttcaaaatgggtgtaggcacaagtaggtacagtatgtgactacgagcccacaattacccaatgaagtttgtcctgtttttattgagttgctataacgcctccctactttgaagcatccatgaattatccaatcctagggtattacagtgtacacttaatttcaagtagctagcatgccaagtggcagagtagtcaaatcacctctttgttacctaacctacgtaccatgatatggtactcctaagagtgacatatataacacatgctaatctcaaagagaaaaaaaatcgaaaggattggatagaagctttggccgttgctgggcagtttcggcgatccatccggcacgtatatacccgccaccactctacgcacgatagaattgcaaccaacgacactactaaagtactaaacgttaacttgacccaggtcaacaacgtgactgaattaaaattttataatatagctgaacttggaccccccacgttaacacacggagcagtagcattgcatctatcagcttaaaaatgttagatctgacggtaatggtgtttactttgaaagataagcatggaccagaagagtaatctagtcgtcgatagcaattagcaaagggtcgatcgaagctagaatatatatataatatataaatgacacttgatgaatacaatgataagcatattttccgagcgtcttcgttagctgttactccctcctgcctacaatataatataacgattttgagtttttatttgtaacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgccctcgtgatcgccgccgccgccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatgaatcagtttatatgacattagaaaatggccgtaggaaacagacctgatcaactgactttatgctttatgctttatgcagtttgcagttgtacctgatatgtaagcgatctctctctatacttaaaaattagtaaaacattagacttgttcactttgatgccaaaaaaaaccttaccaaattttggcatagttgtcaaaatttgccaaaattttgataaaatttcttatatagttaccaaaatttggtagcaaactaaatgtagccactttttttggtaactttaccaaaatttggtaaggttgaaaatggcatcaaagtgaacaagatcattgttatatactccctccattctataatataaaacacaactatttttttaggtgttccataatataaggcatgcatgtttgcatacaattaactaggacatcttctctattaaattattacttttttaaatcctccacccttaagatctctaattgtaacatcttgggtatttagctatagtattaatcacgctaatgacttgatcacactggctgagagcggtattgattgagccacgattctggctaggacctataaatatgttgattgttgttctattatggatcttaaatgatatttcgatcgttttcttgtcatttatttatcaagtcatatccatatgcatcattgatttattgttagttagactaaatctgttgaggagtgggataatttagtttcgatcaaactatacgtagattagttgtcacgaagctaggtatacatgcacagtagaaatcagaactgaaactatagtaaattattcacaaactatttggttataggttgcatacatacatacgtacgtacgtacgtacttacgtacatacatatacagactggcatacatccatgtgtacacatattcattataaatcttatacgtatgcatctcatatattgtgcagatacatggtgcttataaatacaaactgaactcatacgctctgcattcaagtaaaaggagaaattaaatgtattaggaaatgtttatatgattttagaccgcacaatttctatttaggaggttgcatatttaaaactttagttgtagtagcaataaaggaatttttgtgttgtctcaatctacaaattttgcatccaaccaaataggggcacaaaagatgtagggcctgtttactttgatgccattttcaaccttaccaaattttagtaaagttgctaaaaaagtggctacatttagtttgctgtcaaattttggtagctatataaaaaatcctgccaaaattttggcaactatactgaaattttggtaatgctaaaatttggtaaggttttttttggcattaaagtgaacaggcccgtaaaccgagccatctcaagccaaattccaaaattatccatttttgcataaaactccctgaattctagggcaattattaatcggtcccttaactctggagtaacctccaaaattccaaaagcttatagactagaatgcaaaattactaagtattccaatttcaccagatttccattaaattgtaaattagtgaaacctctcaaaattaatccaccgaacatgtcatggtgaggtgtcaatcaaggaagcagccaccaaacaacaagtaagtgagtcactggttaagttccaccaagttaactagttcagtgtgaaaccattcattccaaccaagcaactgtatcgtcgataccaagagactgttcactttaatgctaaaaaaaccttactaaaatttagcatagttaccatactaaaattttgacaggatttcttatatagttattagtaagattgaaaatgacattcagcagtaggcacagcagtagtagtactaccattttctactgcaaagagcagcagcggcagcggcagatcgccatagtggcagcaacattaggggcgagtagcagctatgaagaacaacagtacaagcagtagaatctcaactggagtaaggcagtcttgactagaaatcagtagaggttagggagataaagagatattcaaccagaaattatacacctcaccaacaccacagctcaaccatagtatccacagtaaagcaacttggtagagagaaagagagagatgaaccaaatctgaagaaggagaagtaggggtgttcggttcctgcatgaacagtgatttcagctctaggaggagatggtacttcagctcaagaaacaagatggatcagtaacagcagaagcaggacaagaagaaaggaggagaacaggcaactgttgtaaattggatcaggaggtaaaatcagcaagaacaagaaatcagaaaaatcgttagcaagggtgcaaatcaagtaggaggtacctgagcttcaagaagagaggggtttcagtttctggaggagcaggtggtgcttcagctcaaagaggagaaatcagagttccatcaggagaacccttgaatcagagtccagaagagtagctgcagaaccagagttccctatatcagtcacctaaaatcatggcaggtaatcaggagattgaaatgaaagtacaatcatatcatggcatgattcttgagtgatgcatatactagtatgtgtaggagttgtgagttgcatttgcatccattagaatatgaacaagaaaattaagtaatttgtgaaggataagtctttgtagtccttggtcgtggttcttcctttgcttttgggtagtttcaccttttaaggacagcatctactcctttagcatactttcagttgctaggacagctgcggttagtaggacaacagcagttagcatctcctttatgcctcatttatactttattcagtttggatgccttctaggacagcatcctattcaaatttcgaattttagactagggtgcagcaataggcttacagccagctatggctatatatatgtatccaacctccctcgggtaggtatggctttgagtttatgaataaagaaaaccagaaaattgccccatcctaagtgccatcctcttctcaatgagagtaactattaaaattctaacaatttgagctgtagagtaggaggtgtaactagtaggacataaatatttttttatttaactgataagtaaataggttaatgttagtttataattatttggggttagtaacaagaaacattttagtttttctagaatcattatgtaaatgcatttaggtaaacagctgcgcatgcatttgtttggtgaatcctgaaattataaatagttagaattaatgagtagagttataagtctctatagcagagcatctagggcaaatgattctagattagagcatggcatatattagttctgtaagtattacttcctccattttataatgtaagactttctacatttcccacatttatgtaaatattaatgaatctaaacacacatatatatctagattcattaacatacatatgaatgtggacaatactataaagtcttacattataaaacggagggagtaatcaatataaatcgtattccactgtgagaaacattagcagccttaaaaatcaaccaatgcattagttcttaatattagtgatactgaatgtataggattactctggatagcaagtgcacaggtatatctttagttcgaataaacctaaacttatgggtctctacagcaagtcatctagagaagagcataatatcagaatctaaactttagtagttgatcagcataaccttgctaagaccaataccataaacaccattatttaactgtgatttcagtagtaagtatactttggcatcaagatgaagatttataatttctaggtcattaaatccctcaagtgatactaccattatgcatcatgtatgaatgaaatcatattaatcctctagattactattcagcatggcaacataaggatctgatcatgttagtttattagtttgtaacaaattttaatatttagatgtgttgctttttctaatacaaggatctaaatcactaatggaaacgatagagagcaagagaatagagtagagcaaagaagctacattttcatatattacataagccgtagacaccatttacataggggtatatgtccttttataggacttttaggtcggtttctacaataagcgacccgctacaatagcatgtttttacagctcatgttacagctcatctaatagcacaaaactagcttgctaccaagacagacgtgctgcttgccaagcacaagcagtaatgaaactacctgatacagtgtacacctttgctagctagtaaaatttgctttgtatccttccatgccaacacaacaaagcatacaactcacttgtgtattctatagcccattatcactcatttacaactaagcttagctaatttgtgctagaaacttcaagcagcaacaagcaaccaacttgaccaactagtagtcaaatccaatttgactttgttatttcaagaacacaaattaatttccaacacgatggtcattgcataagcataattaaggatttaatcatgctagagtgatttctattttagtaatgcaattcatagacctattcatgtcagcattcattcatcatgaacatataggcatcatccatcttagcaacccaatttctctagaaccctagatccagtaaatacaaccctaagtataacatcatcaagtgaatcattaggacaaattcacaagcatcaccagtacatcacaatttacataacaacaccatacaagagaggacaccacactagtatatcacaatagggatcagagacgggaggatggaataggtagctcacctatggagcagagggatgcagccaccggagttgcctgtgtttccaccggccatctccacggtggctgcagtagcaggagaccggcggctggggttagtttaggggcagagaagcgaggatccaagaaaccgattcaggccggcgacggttgcggggcggtggctagaagggtcgccggagtggggtgtggcagcaggcgcaagggagagcgacggcactgcctgggaagcggcggcgctgggtggagagcctggttatgtaatctggatgatattctcaagtttggtattgaacttgtttgttctcaaatggttatatgtgcattatgggtacatgctaccatttttttatctatgtcaagtgctttcttgacttgtgtcaaatgctctacaaattgcaaggtacatgttgccaaaatttagggtacatgctgtcaaaattttgcttacatgctgtcaaaattttgccatcggagcaacagtttatgaatacacatatatacaatacatgcagcaatatatgcagcagttatatgcagcaatatactccctccgtcccataaaatatcgaatcctagaagcccgatgcacttttagtccaagcggtgaaagatcaaaatacccccatcaagtacaaccatgattagcacttttgttttgaaaaaaatctctgtgaacactaaattgttcccagccccttcctcgatacccaggcatcccaccaccggatgttcgccgtcgatgcatcagggctgcaggaat

SEQ ID NO: 81888 - DNA, 27294 bp, Oryza sativa
tccccagccgaagttcccttaggttcctcggaggccttgtcaagatggcgtaaagggacagtaggataggtttcaacgctaggtgtcgtcgtggtaaggaatctctgggtaaaacacttggcgatagtgtgtacttgataccaactttgttggagtagaggtagtaggagaatcgctacaccgctggtcgaggaccaggtagtagtcgtaactcgaccacttgaagtaaaaggtagtgggagaatcgctacaccactggtcgaggaccaggtagtagtcgtaactcgaccactggaagcaaatgtacgagagatcactacgatcaactggttgagaaccagtgagtaggtgtctctcgatcatttggagtcgtggtacgaggaccgctacgctgccggtcgaagactagttgtagctgttcctcaaccatctaaagtcatggtgcgaggaccgctacgctgccgtagtcatacctcgaccatctgaagttaaggtgcgagagattactacgtactggttcgagaaccagcgagcgagtagaattatctctcgaacaccaatggaagttgcggtgcgagagattgctatgtactggtgcgagaaccagcgagcgagtagaattatctctcgagcaccaatggaagttgcagtgtgagagattgctacgtactggtgtgagaaccagcgaacgtgtagaattatctctcgaacaccaatggaagtcgtggtgtgagagattgctacgtactggtgtgagaaccagcgaacgtgtagaattatctctcgaacaccaatagaagttgtggtgtgagagattgctacatactggtgtgagaaccagcgaacgtgtagaattatctctcgaacaccaatgaaagtgctagagttggtttattacatgtgtatctcatgtggccagcatgactcacatacccaacttatagcatatccggatatccgttcgcaatcatgtcgggtgatcaagccgacggcgttcgtgaggaattatccgttaacaaccttttcttgagtagtccagcgatggccggtgctatgagatagatcgtcggtcttcgttggtaggttgggtgcgataactccgcatttgtcgataatgttctcgataatagagtgtactcgaccataacctactcgagtgctcaattgttcctaaaaaatattttctagaaggcaagatatatagcagataatatcgagtatgtacttaaaaaaactgcatggatcttctagcattatcaggatataacatgcagatgtaaatatcatgcattatgtaaaccgtaaacaagcatgatttatacagaagaaaacagagcgagcccccagcgttaggccgtagttggcctaacatcggggacgcttgcacaatagatattgtataaaaaatatgctctaggtaaacataataaattatagatctgataatgctgtatgatctgaataggtacgataaattacatataaaatattacgtacttttgtagatacatgccggatatatctacgaaattagtagattaatttaaaaattcaatctgctaattacctctgttgatgtagttggataatctgcacatgtacaagtgaagcaaccgtggatgagtactgtggtggttactcctgtatacacgtggctctttggctttgtgcccacgcatgtagacaaattgacagcaagaccaaaatatacacgctgtaacagcgtgacgttaggtcctctgccatggtttgtattccgagtagaaatcaaggagattaatggatgcccgctagttagcctggtgcatgcgagtggagcggcatacagggcagtttcgctgtccttttcgtcatgtgcttgtgtgtcatcgagaatcaacacgaagccgacgaggacagggctcaagcgggagcactctcctgattagatttttggcggcgacgtggtctcaaagtaatcaatcgggccgaggcctcacgatcgacaacattgaaccgttgttctccgcagcggcgacatcttgaagcttggtcgatctcgccggatcgaatagttaatgatgatggttccgatcttgtcggggcacgtactctggtcagattagatctccctctcaaccgaagtcgtcgagtaggttgttgttggagaatccatctcttaaactcatctcgtcgaaaccctgaagcaccaaaatccccctacctggcgcgctactgtcgacgtttgatgtcgcaattctggtatttacatagtatggggatcgtcggtgctaggatatacgcgagactgaggtaaaagagacggagacagggatttttatacaggttcgggtccctgagttgtcaggtaataaccctacatcctgttggccggagccggagttgcttttattcaccataatcacaccagtacaatatgtggggtagcctatctaaccgtcgtcgacatggcggtttgaatgtctgactcgtagtcgatgacagggtagtcttcctcctcgaatccgtgcccggcgagatcagagatagcgctttcgtctctcctgacagtatctggagacaccgtatgggactagccgtgcctttctctgaagtcgatatccggcgtcttgtcttggcgtatgttggcttgtatgttgtcccgtgtattgtgtcccctcttcttctaggggccttgtatttatacccatataggtgtccccttgtctaagtagaactagggaaaccaatatggatacaatccgagtagcccttgtcgtttccatgtagaactctggttgtctttccttatccggaactccctccatatctgaagttagtttccgtataagacatggtacgtggtgcgtcctgccgagatgtagtcgactactattaggtatgtggtatccataaccttgacagccgcggtatcgagatactagatattgtaatcagacaatgtttgaatctagaaattagaaccatctgaattggtttatgttcatctatgaaattatgtagtagtgaataataataataataataataataataataataataataataataataataataataataataataacaacaacaacaataataataatagcagcagcagcaggagactgttcgatacgtgaccttaaatacattcttgaattgtttttggggaggaggacagataaatatcactgagggttgatggataggatcttctagggtaaggaagagagagggtgaatcctatctccatcatcatggctttggacagatgtccgcttcagactgaaggaagctgctctatttaagccgtacgtgatcctacagctcttgtctcatgagtagtacttttccctgcgctggctgtggcaaggtccatgagttgagtgattagagctagtagaagccttcccggtaattaatgtatggaacattgtcctttggtttttgtgagtacatggctagaataaacacctgatgtctagctatagaatagatagattagtgtaaaaaatatactaatatattagtgaaaagactaatactctggctaacagcagctacatgcatgcatggaagcacctactagtacttgttggttctgtccctttagcatagtcacatcaactagctatcttctattagtagctgtcatgcatgaaaatttatatattgaggctgtgtttagttcgtgtgctaattttttttttaaatttacgaacacacatttgaagtattaaacatagactaataacaaaacaaattacagattccgcctgtaaactgcgagacgaatttattaagcctaattaatccatcattagcaaatgtttactgtagcatcacattgtcaaatcatggcgtaattaggctcaaaagatatcgcaatttacagtcggactgtgcaattgatttttttcgtccacatttgatgttccatacatgtgtccaaatatttgatgtgacagaaaagttagaagtttgaagaaaaaagttggaatctaaacacggcctaattaatatcaaagatttgcatatttggctaggcgaaacgcacgggtagaacgatagaaaactaggcaagactacgcccatcaactattttacttaatcatctctaactaaatttgcttaccattattacattgagatggtgatactaacaatctaacagtaaatattattaatacacgaataatggattgatgattttatcagtgagaataataacgtgatagtgatacttagcctgagacggccgatacctgaaacaacgatatcgagtcggctgatatcagtgtgagatgaggaatgcctcacacaactagggaattcagcggcgtgattctcagattagggtatcactaattgggggagaaaatggattgaaggaacgatattatgacgattattttaatacctctgcagtgtatttttaactcatttactatgttaaatgtcttctattatttatcggttgttaatatctaagggtagtagtattttctgtctttaaaaacatctatatagctatatgtactaatcttgctgagtatgtgtaatatactcatatatttactatttgatgtgcgcagaaactagtcaagacgagatgtccgagggaaatgatgacatgcaaacctaatggggagcgtggtctacttagtctttagaagcatacaagaggacataccatcatgctaggtatagggtatcgtcttggtaataataagttggtaagcgaatcaaccgatgtattatgcaatgtagctggtgaaaaataaatggaaccattgttgaaagtgtccaagctctagttgtgatagttagatattacatcttgccttatatccttatggacttatatatatatatatatataaggatacgacagactgtcaaaaaaaatatttgggtcgtgacaaattatgaatacaaactcggtagtttattgtcaggacctaagttaaatgaaacattatctctagtgtgtagttttctcttgataaatatttgtatgccacatattattattactctattcttgttctgaacggttacatataattgatacaaatacggattaatggtgtagggggtgatcgcaaacgcgcgccccaagcggcaatgaggaagaattgcatttgcgtgcgatagcgggtcacagttaaggtacgaatttccccactagcatgaactctgtggggtcttcaaatataagaggcaaccatttcttcttgatacacaagcacaagcccttttgagaaacccttgtagattgctcgatggggagggaggcagtgctgctaggatataaattaatagccgaccaattcggcttcgtcattccatctctcctgtagaagtaaatagtgcggtttcttgcaaaaacctctctctcggccagttatctttcggaaatgctaatgggcgggtgatcgctcccccacccgcctagcgatcacccgcccaccctctcccctatactactagatgtactcctccctcttctcccccttcctccttcccttctcctctttctactacagtaaaccatacaattttttttaaaaaacaaaagttagaaaaatttatgtatagaaataccatatataaaaaaaatttgaattcaaatttaaatttgaatcgggtatgtaaacttttgacttataaactttgggtctataaactttaggtgtataaattttagatgtatagaaatactacatagagaaaatatttgaattcagattcaaatttgaatcagatataatttaaattcaaatttgaatcgggtatataaactttaggtatataaactttaggtgtatagaaatacttatatatgaaaaatatttgaatttaaattcaaatttgaaatgggtatataaacttttgacttataaattttaggtctataaacttgaggtgtataaactttagatgtatagaaatactatatataaaaaaatatttgaattcaaattcaaatttgaatcggatatataaacttttgacttataaacttttagtctctaaactttagatgtgtaaactttaggtgtataaactttagctgtataaatttactaaaatatgaaagtaatgcggtgccaaaaaagaaaaccagaggagggaggaaggggggaggtggggagcgaatctgatcgctatcccatccccacggtgatcgattgcccattaggcgtacccgttatctttcacgacagagctatcctttgttgacgggtcgtgccactagattactatcgtctatggcccgcaaactgacccaaatataatttgttttctctatgaaatccgagatattagagcccatcgtgtctgtcctgggatcataatagccaatttcaatctaatctatcgagaccaagaaaaacaacaccaaccttaaccggcgaatgatgggccgcttccgtctcattcttaatgatctagctctgcaggagctagtacatcttaacggtcgttccatacttccatcatgtggtcgaatgcccgggattcccgagcgcctagatagactgttcgtctatgtggatggggaagagtttgtttccctcgttaccttttgaaaccctcttctctccatgttgccggccctgccagagaaaaggagattctaattcgaatccttctggtgtcgtctccctgctccatccatgacctgatcaaattgatgcaaggagaacgctcctgaggaagcatcgaaggcaaaacagtgaggtattttcccaaaccattagatttacaaaatgatctttccgtttgcttattatgtatcaatcttccataggataatcagatggataatttgcatgtttattatgtaaagaaacctagaaccaccgtccaccactaggccgtcgtctcccacggttatccccctaagcccagcgatttctcctctcttccatctatcccaaccctcctcctatccccacccaacccgggaccctaaaggcttaaaccctaactcatcgagtcaccgccggtcgccagagttagagtagaaggagtgcatcacgaatcgggacataatagaaggttagcaattccgatatttaaaacatactacctccatctcataatacaactattctagcatttaaattttatccataatagagctgctgctctatctatttcctcatcataatcaatggcaactcccttttatttagtctcatcctattctttgattattatttttaaaaaaaagtgtatcagtaaaacggagggagtacttagtgtctatgtgatgagtttaaaattttgagaaacaactggttagtaactagcttatgagagtctggaaaacccagcttctagcttatagttcattttctagattttataactacatcttcttataatttggatgagaaactggactatttaaaaaagttttaaattttataagaagttgtagctgttagaagctttctaaacatgtaagaaagcaagaggaatgtgttactccctccatctcataatactgtaatatagcaatttagtaccggttgaaatatattctagtattatgatgaatctaaacaagttactaggttactatattatggacggagagagtatatgtgattttcctaatagtgtatttcctccgtccattaaaaaaacaaacctagcacatattaagacacatcctctccatctcatagtactgtaatatagcaatttagtaccggttgaaatatatcataatagtatgatgaatctaaataagttactaggttactatattatggacggagatagtatatgtgattttcctaatagtgtatttcctccgtccattaaaaaaacaaacctagtacatattaagacacatcctgatactacgaatctagatattgtgttatattccgtactactccttccgtctcgtaaaaattaacctagtattaaatatgacacattctattactatgaatctggatatacatatgtccagatttattgtcctggtatgtatcgcattcaattttgtttttttatagagagagtagatttgtattttatttgaccgagagaatgcatggcttaatctttgagacaagcatatgaaaaggataagaatctgcacccccataaaaaagtagaggcccgaaaagagcccaatacccaaaggaatccacccaagccgatggtggttttagccacgggtctcagtctcactcccagattctactcccgctcctccatcgtcgtcgccgcgagtttgctcctctcggcggcgccctcctcgtcgtccccgcgcgctcgtgccgctgctccggccagcgggtactccccgtggcgaggcaggtgagcggggctcttcgagttcacgaggtgtcgtttttttttttcggggggatttctccaggaggattagtagagatcaggtgtgtcctcctttggatcgcttttatctgttcgagcgattgcttggtccggtagcgattcgggtgtgagactgagccatctgcgcctctgttactgtttctgttttttcctttaatggggatggttttctgaaaattaggatggcacccagcggtatgagattgttgtggattgtttgatttcctggtggttggtgaagtcagaaattgagcagtactctctgtcataagacgttttaactttggtcaaagttaaactactctgaatttgactaactctgtagaaaaaaaagtagtaatatttacaacacaagcatagtttcattaaatttatatgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagcaataccaaagtgtttcaaagaaggattaccttgacttaggtctgcctccggcctaaattaaatcaacctaagttaaatggagtctctatcgttctgctgcaccccttctcaaacaacgcgtttgatttccttccttataccaaaggaattccttctttctcttgccgatcacatccaagggtcgaatacatcctgtctttgaacctttgtagtcctatgcatagtcagtactatagcctcactgtcctcgtcgaggatagttattcattaaggttaatttgattcaatgaccagaattctgcgaggatatatagctcggagacgacgggcaaaaatgcgttcatttgcctcaaacttttcggggtagaagaactcgttagttgtagttgttccgaagggacaagtcgctcccctctgctgaccggaggaagcactttggaaaataaaaactcgatctatacctccgggcagcagagcagagggaacggagccctcgtcccgaggcctttctatgaaggcgagcagcccagcccccttgttgaaattttgatattaaggaagccgtatttcgcaatagcagctccgagaagctgggcttagggtgcgcctcctgcggtcgtttcagtgattcaattggctggcttcccccagctcagactgatgccgccacctctcccaggaccggaatgattatccctgcccgatgggtctacattcatcctagaatgtcgtcggcatccaagctttgaacaatactaaaagctgcaactcgtctgctattccgatcttcctctgattcaagtgctaccagttccttcttcaactccaggccaggcaagagccgagaagggcttcccaaatttttcccgcggaggagggagaatccgcgagtccacgacctcctactcccgagcggcctctgactgaaaaggatcgaatttatttgagtttggttttacatgcggatctggaaatgcaagaggacctagaagaacgttgctccttagatgtatgcagctgaggcatcctaacgaatgaacgatttgaaccagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctacgattattccaaaattgccccttcgctttatcaacttccagttataagttgtaacttacttcaaacgatttgagacctcttgatatccaacattgttcttaccagaaccaaaggccacaggttattgctaatgccttccactatactcaacctgcatggcaattacttaatcaaagtcaagatgcctatccacataggaaaaacccaaagtcaaaagagcaattggcctgcaaaaataaaggatttgttctcttttgtaattagaacaaacataaacaaattggatagaaaaggagcggaaaccgattgattgtacacttgctgttctcaactgggcctctgaatctcctctggtttcacctttgcgagtcgaagtaatttccggaaagacacagaggagctctcatgcgtggaccaacagtagccctgtcctctcctctttgttggaagatgagtacacatcgggtaatccgcccacgagagcccaatcacaagaggctcatatagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgcccaaaatgcctctagaaagatcagacagaagtaagacgagctgtaattgtacgtacatgtaaagaactcaaacgaatgtcaaaacaaaggaaagatgattatcttataggaagactgccaacactgactggggttgttcaatcttaagtggagtgagttaaatgacttggcttgctcaattccttcccggtgtaatttcataaaaggaatagcactcaaagcttgaagataagttttgtactcaattaatttctcagtccctctaatcgggtgggcaccggccggccggatccccctgaaaaccgtacgtgcgggtctcctttttgggtataaagataaaggagtcgagtttacaattgaataaattttcataatacatttgtcttgggttaaaaatattactattttttctataaaattagtcaaacttagagtagtttgactttgaccaaagtctaaacgtcttataacctgaaacggagggagtaatatgaatcactagctagctggggatgtaatttactaatttacataacatgtgattgaccattgctgcagataatatgtcttgtccacttcggctagttcttagtttgctgtattaatgtaaaatcagttttattcagtggacagtgatctattagcctcagtgccgtggttgctttattgggttcaaaagaattaattgaattgttgcaaagaggcaatagttttgatagtgctaagacaatgacttgtattgtaaaaaaaaaaagtgccacatgatggggacagcgcgatgaaaagaaatcagttgtaatgacgcacaattgttttgttcttagaatatgtattgttttatttttatttttatgttgaggacctagtagcaagtcttatgctcgaaattcttggtctgctttatgtagtgatcacttgacccatcttttctggcaatgctgatttaacctcattgactccatctggcagcattagtagaatatcatcgcacccaacagctatggctaccacacaagcctcagaagcagccactgagaaaggattgcctttggggatggatgtctccatggtggatgaatatgcttcccagtccaagctgctgcaggaattcgttaaaattcccactattggcaacgcttggatcttcaattccaagactggtatgtgctgttattgctatctggttttactgaacttaggtttcttactcttcttctcgtgttgtgcagaaaacacatctagggcgatagtttctgttggccaaacagatctgttggcaaacaaaaagaggagcttcctattaaattcccacatctcaaaaaattcctcaaattctgtggatttccagtggtctcccttcccaatcgaaatgagtggagtttcagcagtaattccatcgccatctgggagaaaacttttactaatacggaattctgaggatgattcccctacaaaactagaagtttggggcccctgtcagttggagaacgagattcacattgcacaatctgttcatggatcactctatgtcgacgaatggtaaactatcctgcctcttttagaacaactttcttagttttttgtgtggtagtgggtttttttttggaagaaagacagaggtaattagggacgagagattgctccattcgccactttttgtacttcatgtttcttaaatgcaggtttgaagggatatcgtggaatcaagaagagactttagtagcttacgttgctgaggagcctcctcaaccgaagccagaattcaatgattcaggatacaagaaggctggctcgtctgaaaaagactccaagagctggaagggaaaaggggattgggaagaaacttggggagaaacgtattccaagaaaaggatacctgcattgttcgtggtcaacatttcaaggtgtgtttctggttgttctgaaggttgaatccaaaatagctttaaaagtactgcaattttgtgaggaatagtttcattgcagcggtgaagtgcgagctgtgaagggcataccgagaacattaagtgttggccaagtgatttgggctccatcatcatcacatagcctggtttttgtggcgtggtcatctgataatggttaccaaaagacaccaaggaaacttggaattaaatactgctttaacagaccttgtgctctgtatgctgttcctgatcctttcatggaagaagctgataagccatcacttaagtgagaacacctgtccttgatgacaatatttattcagttctatttcaactatgcaccattgtaggcttcctgttctaacatattaaggtattaattgtcacattttagttattttctagtgatcgtgtgacactgtaaattcttctctcagaataattgtagcagcatatttttttcaaggaaaaaaaatcttccatatatattttcactcttttttcctcattaatcctagtcctgagcagacaaatgctaaatggattgtatgcatcatgtctcaaaaaatagaaagtttatttctgatgtcatttctgtttattgtacagtgtcagtaagggtgaaactgcacctacaaccaagttaacatcagagttgagcagtgcttttttcccacgattcaggtaggactgcattcagttttctttgctcagtactgttattcagtttaggccatatgtctcaactattatattggaagaagtacaagctacacatcctagccgtatttctttaattatgcattataattgttaggcgtaatttttcttctatggtttaaaatattttaatcaaattcccttaaagcatgtcaattgattgttcatgcttgttatcatgtattttaacctaaatatttgaacaatcataattcaaatgggagtgaatttggaaagtggagcattttgggctgatgagtaggtgtctttattatttccttgttcctgtaatcctgtggattgactcagtagatattaatttactgcaacaccaatacattttatttgcacatctacaattgaagttttcatgtctagattataacttagtactggtagctgatgcatgtagatgaatgttaacaatgcgtcgcaaaaatgatatggaatctttattgtacagtccagatggaaagtatcttgtgtttatctcagcaaagagtgctatagatagtggaacacacaatgcgacaaattcaatgcataagattgactggcctgcagatgggaaattggagggcctcagtgttgctgatgtggtacaacaatgcctttcctttacttgttaattttttaatcgatcattttgtttagatggcttccttttatatatagcttcaaagtcatggcttggaaaaatacataaatctaaccagtgtttatttgagcacattgtttgcctgttggctatacttgattaaagatatgtatttctggactttgtgaagtggaacttcaattatttttttaattattgaagtatctaaattcaatttcagttaaaagaacgaagttcagagggtaaaatttataatggtgtgtttctttttataggtgctctgcatatccgatatcaagttcttaatgtcttagctgttatgtaggtacctattgtgatgtgccctcaggatggttgttttcctggtctgtactgctctggcatacttaggaatccatggcttactgatggacaaactatgattttatcttctatttggggaagtaaggaagtaatactttctgtaaatgttgtgaggtgattacaagcatttttatccatcagttagaatgatatggctataaagtttatttatttatgaaattacctattttcttcacagccgtgaagtttcaagagttagtcctcaggattcggattattcatggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatctaaccatgttgcatttactcaaggcaacactaaaatgcatttgtaagaaagttctcaaagctcatggtagaatactcttcttggttgtttgcatccttaaggatgcatgctaagcttcatttgcattttaatgtttgaaaatgtactttagtagaatactcacatcctctccccttcctaaatttttatattttataaaattgattcaggtgctaagctgccctttgaggctatttttgtgtcctggaaggattctgcaacaagaccaacaattgttgttcttcatggtggaccacacactgtttacccatcaagctattcaaaatcgttagcatttctttattcacagggatataaccttcttgttgtgaactataggtgagctttatttttttttcttccagtagttcttctgttgaactaggttaaaataccctgtcctttctgaattctgctttggaaatatatcatattaaacactaacattaatgtccacgtacacaccattctgttgcctagaggttcactaggctttggtgaagaagcactacaatctcttcctggaaatattggttctcaggtgcactgttgttgatttatttccatgttttaagattattttcttaagttgccagaaattttatatgaactgtcattacgtacaattgtttaatactcatgaacaggatgtgaatgatgtattgacggctttggactttgttataaagaaaggattaatagatgcatctaaagtagctgttgttggaggttcacacggtggtttcctgacaactcatttgattggccaggttcttagcatgcctttgttattctgaattctttatctatgcaattattcattacatttgcagtttatatttcctttagggattcaattatttgtgcctaatcgtttgcacaaataatctagcacaattcttgttgtaaactgtatatactcatttggacataattgggaacagtgtcttttgataatgtgtattggtctatatgaaactcttatatttgagaaatgtgctgtaaacttataattttgggagggaggttgtaatttgtaaaagagagtagtaagtttaatataagtacccaagcacactaagttatggtcagtgaacttaaaggctcaaagctaaacttggatatttcaggagctctgtagcagtgcacagctaaaaattcttttaaaaaaatgatgacaccaatttatattagctattaaattatatattacattgcaacgcttaagtccagaataatatcctagaaaaacattcttacaagagttaggatcagcatttgtttccttttcttggaagtaaagcttcactgcagtgtaagccgagctgtttttaccttttcatgattaagaagttcacatgtgatattctcaagaatatttcctgattttagaatataattatttccttgacaaaaatagtgagaaactactgctgcatgtgggaactaggtctatacagtttctttatgactatacatgcaagacaataagagttcatgataggtctatacagtttctttatgactatacatacaagacaataagagttcatgatgcacaggcaatagcacatggattcttctatttatcaggtcttcttggattctgttgaccttatgtttcatggactgcaggctccaggcacttttgttgcagcagctgctcgaaacccagtatgtaatttatcattgatggtaggaacaactgacatacctgagtggtgttttgtggagatttatgggaaagaagggaaaaactgcttctcagagtatccttcatttgatgatctttgtcaatttcaccagaaatcaccaatatcacatatatcaaaggtatgtagattctgcatacttaaccttttacaaaatctatgcttgaggaagaaagtgtagttccctcatgcaaatttgctccttgaggactttgagtaatcttttcttgacagtttaagaaaatctgcaggtgagcacgccaacactttttctccttggagcacaagatctcagagttcctgtttctaatggcttacaggtaatttcttatgcacttctgtttcatttttatatgatgaaagggttgtgaaatgattactagtagcaatgttgcattcatgttattgtttgcgtagacaagttcagtcaattttcctgaaaaccattagtgaaagcatatgattcatattgttccactatatactgcttgtatctatttatttattttcacttttacaaatgctggtttatgcctaatcataatcgcaacatatgcagtatgcaaggaccttgaaggagatgggagttgaaaccaaaattattgtctttccagaagatatgcatggccttgacaagttagttgtactttttaatcattttacctttgttaccccgatcagtgtcttctgtgttgcaacatttgactaagtcaaccttgcgtcccctgtgcaggccacagtctgattttgaaagcttcctcaatataggtgtttggttcaagaagcacatgagcaaataaacaacatgcctctgttaccacactctcaccttgcttaataaatgcttgtaatttgggtcaaagcagcccaaggaaacgtggttctgttggcattctaataaattaagcctgctgtaacatttctgtactgggataattcttgaaaatgtaaatgcatttggttataaaattttaccctcgtggtacggaactatggattacaaatatgtgatgttagattatgctttactttgaactttgaagtacttctagttcacggttgctgtcctgtagcctgttgggcttgggcattccttttatttttatctttttttaggaaacaatgggatcataatttcttttgaatttcagtgagaaaaaaatacatgaaagttcagttcaagttaggcacatggaaatgctgattgagaccactgtaacttctgcttctttgcatcaagatcccttgaagttgccttctggataatctcattttcatcagatggtacaaagagctttgttgtttcatacgattttaaaaaggacaacaatataagttattgcaaaggcttcttgtgctgttcgatgctttcttcgtggatgcggacctgacgcaaccttttgtccttattgctgggttcctcttgtctcattgtctatggtggtatgtacgatcattagtaactttttaagattccttttgttattttgggcccattctttgagacctgacacaaaaagaaaaccaaaatttgatgccatctgatcctcaccaattgtttgttgttaggtttgttgggatcgttgctaaggactgatgatgttttaaagctcaactgcagtcttggatcaaccactctgccactagactccatttgcacttcactgcaaaagcagaaaaatatatgtaagtattctcctttccttcgtctcctgaaaggctaatacgatttataatctgattttattgttttgaggcttctaacttgctgaattttgttggtcctaagttgtttcctcctgcactcagtctggtcctcttgattattgctgtagttccagaagaatctgattttgttagtagaactagtcccagacttaacatccaggatttaatattttttagtgttcatcgtattttttagttatgtttatacttttgtactacatgaaaatcaaagcatttagtgtcagagttctccagaaaaggattttggtgggaaggaagaatgaaagatacttcattttattaatcttaggtagccattatagaagtttccatgttttgtttgtctaagtgattcaatattttttcttgaattggtgcattgacaacgtcaaatctgtccatggattgcaagatgaacaattgggactgttgttcttgagttgttaatggaatttatgaagtataaattaaaaaatagtttgtgtctgaactacattaaagtgtatgaaatctgagtcttagtacggtagtacctgaaatttttcacgggtaactgcaatttgaattatgaaagagttaaggtgatataggttgagtggtgtgctctaacctctaggctcttttggcattgaaatgtatacccatacatcatgaagttgaagtcaggaattcaggtttctcagttttcatcttatcagtggaattgacaacaaaatatacttgagcttccctgcagcttgtttaacatactatattcttgagtttcccttcagcttcctcagcatattaacctttgtgacaatgcagatttagcttaacccagtagattgtgtctttccaaccgaccttacaagtgatttgaatcttctttgagaaagacaatccattgggaatggatgcactggcatctgaagaatacgcttcacagtcgaaactacttcaagagttcaccaatgctcccagcattgacggtgcttgggttttccagaccaacaatggtagggatgattttcgattatacctcattagtaatcatcattttactattttccagaagtggcgtaaagcaactcttgtgtcatgtttgcagaagacagatccacagcaatgtattcgattagccaaacaaacctactggcaaacaacaagagaaaatatattttgttttctcatattatgagaaatggtactaaccttctggactttcaatggtctcctttccctattcaaatggatggagtgtcggctgtcgtaccatctccatcgggatcaaagcttcttgtggtgcggaatggagagaaaggttcccctacaaagcttgaaattgttgatcaatcacatgtggagaaagagatacatgtagctcagtctgtccatggtccactttatactgatgagtggtaaaagtacagcataatacctgcacttttcagtccattcaacctatctgtacaatattctggatcatgatactatttttgttggcacaggtttcatgggatttcctggaaccaagaagagaccttaatagcatatattgctgaagattcacctgaaccaaaaccagtttttgatgatactggatatagaaaagaaggttcttctgagaaagactgcaataactggaaagggcaaggggattgggaagaggattggggtgaaacttactccaaaaaagggagaccttcattgtttgtccttgacattaataggtctctcagcaccttctaattaatacataatgttgacctgaccatagatctgacaatacgacttactgaaaccgtttatttgttgtattcagtggagaagtacgagctgcaaaaggcatttcaagatcattgagcgttggccaagttgtgtgggctccaccatcttcatgtggaaggcagaagtatctgatttttgttggatggttagagcacaatgggtttcagaatactcctagaaaactaggcatcaagtactgttctaataggccatgttctctatactcaactctttgccctttcgaagaatcagatgttgataatgcaccagctaggtaagtaactgagcacccatcttcagatcatgctgtaactttgtaaagtttacaaatttactttatttatcactagtttgttgaaataagaaaatgtaaagctctgaataactatgcttatggggcagttgtaagttgatatttccatgacatttttccagtgattctaaattagagcctgcttcagtagcaatcaacttaactccaagcataagcagtgctttctttccgcggttcaggtatgcccgcattagtatttgcgtattttcttgaaggaccttaaaccatgctagaaaaattcttcacggaaaatctctaattattttcaacagcaaggatggaaaacttctggtgtttctatctgcaaatcgtgctgtagacagtggagcgcacaatgcaacagattcactgcataagatcaactggccttctgactggaaaatggatcaatacctcgaaatcactgatgtggtatgtcctcagatttgtcttgaccggtacttatctgctgtctgcagtcaatttatttaacttctgaactgtgccagattccaattgtaatgtgtcctcaagatggttgttttcctggtttgtattgttcttccatgctatcgaatccttggctttctgatcgatgtacaatgattctgacatctgcttggagaagcactgaagtgatattatcaatcgatgtgttgaggtaaacaaggttgctcacatatgcctttctactgcttcaaaaatcattgcaatatcccatgctatttccttaattcctcctgcagtggaaaagcaacaagaataagcccagaaaattcagagtactcatggagtgctcttgcagtagatggccacaatgttcttgctggtaattctaggtgcacataatcagttaacttatgcatcaaattttattattttgggtgtaataattttattttatttttgtttgttttctagtgtcaagcagtcccatcgacccacctcaaattaagtatggccatcaagtgtcattgaaggatcagacatgtacatgggtctgggacgaagttaataataatccattgatggcagctaacaataaggttagatggtgtacaatttgaagtatacttaggtgttctttgatgctttgaacaatgtaatttactaaatcaggcttttttttttcattctcacattaccatctgctgcaggtaaaggctttgttgtcacatcaccaattcagcatactaaaaattccagtcactaacccctctgatgacctctctgatggtatagtcatggacacaaatattttagactatcatatgtggcttatcatccttcaccaagcaaatgttttttatatcctgcaggcagtaagcttccatttgaagctgtctttgtgtcctgcaaggacagttcgcacaaaccaactattctagtccttcatggtggcccacactcagtatctgtatcaagctattcgaaaacatcggcgttcctcgcatcacttggatttaacctacttattgtaaattatcggtaagtttgctgaaacatttctacagttctgatcaattaagcttatggcatcatctcactatcatctgaaaaaaaaagagggacaccgggttttggagaggaggctttgcagtcacttcctggaaaggttggatctcaggtatgtaatccagctaaactctgagtctttgtttctcatgaaccaacctaatttctgatgtgtgtcaaactgtcaagcaggatgtccaagactgccttacagctctagactatgtcattgagggaggacttatagacgcatctaaagtagctgtcatcggaatttcgcacggtggattcttgactacacatctgattggtcaggttagcatcctaacagattttagcctctcaaaggaaaagaagaagaagaacaaaatcctaatagaagttagtatatgtttcttgttcagcttgtaatttgttgttattttgtttcaggctccagatagatttatggtggcagctgctcgtaatccagtctgcaacctatcactgatgattggcaccactgacattccagattggtgttatgcagtggcctgtgggagtgaagggaggcaacatgcctctgaatctccttcacctgatcatcttcgcctcttctatcagaaatcaccaattgcccatatttcgaaggtgcatttctgttctcgccttcattcaaagagcaaaaaagaaatgttcttactgatcaagtcattgttcttaaaaacaaatgaaccagagaaatcaagtgattagctactcaaaaaggctcactgaactttgctgattttttttttctaaaaaaaaaaactttgctgatttcaacaggtgaaagcgcccctgcttatgcttcttggaggagcagatcttcgagtccccatttctaatggcctacaggtacatcaatagccgtttaaatttgcctcagtagtttccactttcaattcgttgtagaaatagtccataacaaaaaggctagatcctgaaacaacctaacaatcccgtgaaaagaaaatcaatcgacgggctacatcaaacagacattctttaaattcatctacactcgattaataacctaacaatcctgcatttgcttcactcatttgtcggatttggttaaactattcctgctcggatgatttcagtacgcaagagctctgagagaaagaggcggcgagatcaggatcatgatgttcccagacgacatacatgaaatcaacatgtaagcaagtaactgaaccgaatttcagctcatctgctttatataaaatgtcggcaacagccgttcggaaaaaaaaaagacattcagatgccattgtactattgcttttgtgcctaattttctccctcatactggaatccatgcttttgttcagaccacaatcggattttgagagcttcctcaacattggtgtctggttcaagaagcatcttagcatatcagcatcagatgcatctgcatgaagtcaacttgaagaaggggaggaagaaattacgtggtttaatctagtccaacaggtagatgccattgtaagccttgttcatggagctcgtccgtagacgagtgctccaaaatattagagacttccctattgaaaaaagtaaatggagactttaattggtttgagttctttccttttcccttcaattcacatgcttgatgattggatgcaaattcagtcggatttactaattactactagctactgctctgaccgtgattgatgatcagtccaacaacaatacttgcaaaatagtgcaatccaggagggtgttgttctttatgcacgttggcccatgatttttttttttcaaacaaagtcaacagccgcgcgagcaagtacaaacctgattcattaagtaaagtgtggttttgtgaattttactcttgcccggcgaaaaatttactgccccctgtgaattttcctcttcattctgaaatactttgcacaagccaactcacccatcaacatgccaacttaatgtaagcaattaaattggtgaaaaattaaacacgccatcagattgctacgttaaaactacaaagctggaaagcacaacaaggggggcgagagctataacaattttacaacaacaattgactatatcagatgtaccaaagaccatgtcagttcttcgttgaggcttgggcaagctgagatgctactttgtttgagaagaagctctcgagcctgcacaaaaagaaggaataaaaccaaatcaattagacaaccaggtgactgagatgctactttctttgaactctcgagtatgcaaaaaaggaacaaaaccaatcacttagttagacaaccaagtgactatggccttgtttagtacgcgaaaaaaaaatttttgggtgtcacatcggacgtttgaccggatgtcggaaggggtttccggacacgaatgaaaaaagctaatttcataactcgataggaaacagcgagacgaatttattaagcctaattaatccatcattagcacatgtgggttactgtagcacttatggctaatcatggactaattaggctcaaaagattcgtctcgcaatttccatgcaaactgtgcaattagtttttttgtttatctatatttaatgctccatgcatgtatccaaagatttgatgtgatgtttttgggaaaaaaaattgggaactaaataaggcctacgtttcaaacacggacgataaataattaatgccagatttcccccaaggtgaatcttctactggttatgatagaaagacattattgagtgcacataaatccaacatgagatgtaaccacccacgtttctattaatggttaggctaaatattttcaaagaaacattgacagatgcctgacttacaggtagatgaatatgcaaacacaagattgaagttcattgctcaccgtgaggcacacttgtaatagattgtatcgggagagttataagtttttgcattgctgaacattctcttcatgtcagctacaaacatctctagcgtcacataatactgctcagactcaactctttttgacattgtcttcaaatctgcagacaagcttagtgttcagaaactgaatagcttagatggcacaaaacatagcttcgccaagctgggaaaagaagggaaaataatcccctaaatcattccagcataccaataggatctttgataatgtcataatagtcaggaacatcacgtgaatccactggctctttgaatggccaagcatcaggatgctcattcatattctacaagacaaagctcttatatcagaattgataaaagtatgaagtatctttcgtaagacaacagtagatccaacacatcaggtcattgcagatctacaacatctttggaacataatcctttgaaaaaattgtctatagagcactgtacttggttgtcatgttaactcccaatcacaaaacaaaattagctatatctgctggcagatactcttttgttgccgatacacactaaaagatcaggtctgtttgcccatagttttgtttgctggtggccattgcaatccattagcatagtagcatatgcacatgactttaaggtgtgttttgagtaatgacatggatccttagtgttacattggtgtagccagttttgcctaatttctaaaccacactggactgatggttgagaatcactagtggctcacctgacaatcagcttaacgtttcaaaggataaatatgactaatgtctgaccatatgaagtagagttcacagtgaagtataccagaaatatttgaatattaaacttataaaatgtggccatttcaatcattgaaccattgaacagaccatccagctggtctggctttagaaaatatgcttgaaacagaaagggtgcaaaaaattcaaaagggagcaagcaaagtacaggtttatccagtgaggtcaaaccaaatggttgcatgtcatataaaaagatttgcgaagataaaagacttgccttcaacaatgaacgcattagattagtaagttgttgcctgtaagtactgtaatcaggagaaaaggctgatcttgatttggaatgcccccactgatctggcgtccacccagcttcccctgcatcacattgattgttctgatcaggcttgcatcatagctaaaccagtaaacctaacaaggcggcaaaacaaatatggtcgaataagacagatggatgaacatcttattttagaattctgttctgtatatttaacaatctccagttgccatatgatcatttctacaattggctctaaggaaaacatccttgggagaggacaggaatgcggtagaagcaatcatcatcgatagctgagaggcagcaccgcagtccgcagcactccaatgggatagcagtgcactgaactcatgaatgtcagaatgcatggtatcacactctggacaactccttgcatcctgactgaggccctgtttggcagggctacagctccagctccacctctactggagctagagctcaaccaaacggtttcagctccacccaaaaagggagcagagcgggctggagtgatctgaaaaaaatgaagtaaaggggtggagcggggttcaggccactccacagctccactccacacactgctcctagagttagatttaggagttaagagccctgccaaataggacctgaatgggggatgatgacaaatttgatagaatatttggatggcatgcatggccctacgtgtcatactt

SEQ ID NO: 81889 - DNA, 3229 bp, Oryza sativa
  unsure (1)..(3229): unsure at all n locations
atatgtggctgacatatgggttctagtgacacgtaagcgtcaccatggcatgccacgtcagcacacagagtgggttggaatccgttggacctatatgacacccgagacaagttaagggacccaaaaattcatttcaaaagtttagggacatagttgacatatccacacaagaccggccatacattttactcttttgaacgatggaattgtgaaaaattctcacggtttggtttggtctgtctcgtgtgtgtgatcactgatcacctccacatggcaaattctcctcgcagtaatcagaattcgtcactgggccaagccagagcccagtttgcggcccatcatcccggtaatgggctgaattcgtaattgggccgaacagatcgctggcacctctccacattttctcgtcgtatctttctctgttctctccaactctctttgatcttccggtgatttcgcatttcctcgccgccggcgtttgattccgacgaactgatcatatccgccgccgccgccgccgccgccgccgctgacgccgacacggactcacgccgtcggagcgaaagaaccgccgcgattgccggtggggttccgctgctcccgcgacagaatttgggttcagggatcaaccacagccatgtctagtcttacccaatccaaatcttgcagatgggatactccgacgatgttcaggtgatctcccgcccgacgtggatcattttcctttctcccctctcgcccgtacccttgtcccttgcagttgtaagcaacaaaatgttttggtcaaatcatctgtagattggttgtgttgtgtctgtgtgtatgtgtgtgtgtttcaaccaagtgttgatcaaatcagctgcagggagtatgtttgtgactagaagcacggtccacattccctgtcacccaagttcctttcattcagcattggtgccttgttcatctgaaagatccatttgtgaaattgtgatagtggcgtagactgtagagtgtgacgtagttggaatgggggttttgcaagtgggcagtcttaataactcttagtgcaacctgacgaaaggtgtttttttcggcaatacgcgaaagatttgtgtatcattgcattattaagatggacaaagcagggctgaaaggaaccaaaatctgtattagatgctaagcacctgatggtaggtatttgtatgcaatgcattcccatatgctagttaactctgttaaattttgcacttattgtctttttcggaggatcgagtctgcacgaaccatgtgattcattttctcatcaaagtgtagggttgtatttctccataggattgtaccagaatttcgtggtttactcctgtgtcgtggtctcatggatttaagttttgaactagaatggttcacaattgccttcatgctcttgttagatttgaaacttatagttactataatcatatatatttcaaatctatgtagatatatttccttgccttttgttctactagacagataatataataattattcttgtttagaggactttggaatctgggggtaagatataagagcaattctacggtccttgaggaggtaccatgaggtaccaaaaatttaatgtaaaatttggtacctcatggtacctcacagtacctaagtaccaaatttacaatagaaaaagtggtacctcatgttacctcctcaagaaccgtaaaattgctcaagatataaagcttcatctgtaaacatcatcatcagaggtacattagtacttccgtagaaattctgattgctatccctcatctgataaggcatttaataattactttataatggtagactaaatatattaatgatgttcttatgcctattatctaaatgatcacatcccctttaatttgtccttgacaactcatagctagttgctttgtttgtgtcaatattcattaccctgtatgtgttcatgttggacttcagacttcagagtctagacagtagatagacatgccaacttcctgaaagtgatcccttccaacttttagttgggacaataaacaatatgatactgtcataactgcaatcaagtatatgacatatgtgagagttaaccacttgttttgcttgtggtctgtactctgtacgttaggatgctagctgtaatatctggatttctttcagaatctttctaataacttatctgtccctcatcaggaaaatggcaatgatttagctcctaaatcatgacactctttgtgcatgcgcactagaactgttctcaggtagatataataatttaaatatacaatagtgcatcctagctatcttttatcatttgacaacctcagtttcagtatttctgaataagacacagatacacataggcatgacctttatattgtcagatttggatctgaagcatgacggccatcatacttattcatgatgcaattactcttaatttaaaaatactttataagcacgaagcaactactatatagaagaaaataaagtacttgtcaccaagaacttatatgagaatatttcagttacagctaggaagtgataacgctaaataactgcaaacattgtaagaagtcatatgtgggtttgtatagatttatgttccttagatttatgctgttattgagcactgcaacacatttgggcctcttctggaactcccttgtagttggttaaccacatgcatgttttgcagtcaagcaaacatgcttgatgcttcagtttcttccacaagtaagagtcttatatgacccatagtattgatcactatctcaagtaacttgctgaaactgaggtgcgtgcatagaaagtaatggttagcaacattgtcagcaccttcttggtctcccactctcactattggtttttggttgaatgtgcatctccaaatacaaaatactagtgtaatacacttaccaaaccccaccagaaaagtccctgttagtggctcatcataggaaagatttggataactagatttccagctcattctgcaacagcaaaacacgcattgcacgaaggtgaaaaaagcctatgncgccctaggtttcacaagtgcatgtgggtgtagctctgagactgtgcatgaacaccagcctatcccacttgagtcctccttcctgagctcgctggtcgccactgatcccaaataattgcaccgagagcaagctaacaccatgtttagatcccaattttttcttcaaacttccaactttttccatcacat

SEQ ID NO: 81890 - DNA, 1893 bp, Oryza sativa
cgggtgagggggcgggcggcggcttcggcttccggccagggcggcggccgggcttgcgcttgggggaggaggtggaggcgagctcgtggttgtccatggcgacgagctagggtttcatgaaggtgggagaagccaatgcccgaaagggttggggttggctcggtcggtatttcttaggtgcgggtcgggtcgggttcgagccacaaggtcggttccaaaggagaaattggacatcctctgccatcgtaaaaagagggtttcctcatattcaccatttttcacgttttttaccattttctacgtttgatttgaccaaaatactctgagctcgggttcgatgggtgtggcgtggcattggtggggacggcatcggccgttgcggcgggggaaggggggaggggctcaggttgctcaccgcccaataggctgtcagcgataaccacgtggaggaggatggaggataccggcgttgatccactgtgctccagcttgctgatagatcaatcgatgaagcccgccggtaagaggagcaacgacgggggcagcggtggaatggcattgctcgatggcgatgtcacttgctttgatgtcaagtccttcgccacctccctcgcgctactcaccctcgtcatggagctctgacagctccacccctaccaactccttatcctcctctccgccgccagctcaacctcctcctcctccattcccccctccaccccgcttacccaccatcattgcttccgtttcttccctctccaccgccgccatgcccgctgctaactattttggtcaagccaattgcggaaaaatggtaaaatcatgtgaaaatggcgagtatggcaaagtagcggtttggcatcggttgggagtggctttttaacgaatccaatctacggagtggcatttgagcgaaaccatcttttggtagtggcagaatgtataatttctcgttccaaagtggtggcgtgtctgtgctttgcctgcacaactttgtgttacattcttttctgtgaactttttatgtaacgagagaatccacttcatggattgttctagttcaaagatttttcattgatattgtcaatttctataatataccaacgagtttatcatttattctataatacagtgttaggctgcttttttttccagaaataccaaaaggttaccaatttatttaccccattattttaaaaaaaatatgaaattttttatgtaaccttcttgcacaatatggtttttttatctaagtttcaagtttttatattttaaagcaaaatatttttctatggtatatgagagtgaattgcttacccaaaagataaataacacaaaaatattgtgtgacatataaaagataatttacattaaaaacaagaacaaaaaaatattttatgtagcatataatgaataaattatttttttagttgcaattgaaaattctaaaacttatacacaaactttcacattttgttaagaggctaaataaactcgccggtatattatagaaaagagcaatacaaatatcacatcattaaattgggataaattatatttatcaggtgctcagtttcctttattctgcaccatgctaaagatttgttcaaatttcatccgtgttcagaattcaaaaacttttcatggtagcaaaaacacttgagaacatcagattgtcaccagttttcaagtccttataaagaacagtctcatcgtcttccagccggtgcatgttttctgaggagtgaagtgcacggatggtccctaaacttgtatgggtgtgtcaactaggtccctgaactattaaaatgaatttttgggtccctcaacttgtctcgggtgttatataggttcaacgggctccaatacactccgtgagatgacgtgcatgcc

SEQ ID NO: 81891 - DNA, 716 bp, Oryza sativa
ttcatctcatctctctatattgtttatatcgggttattatccattaccaaagagagaaaagattgaaagatcttggattaaacaatttgtgtaattgttgctttggtgatagatgataaaccaatgtttatgggattaacctctcttttacataagttgtcaactaggttatttcctgataatgaaatgtggtagatatgtattcttttgtgatggaccttaatcatgataaggatgaaatgcatggagatagagcgatatgtatcacttcttatctcctactttttgataggttcatatatatcatttccatgttattgttatataagtgtgagactaatgtttacttgagtcttatcttatttagtctcctttacattgagacatggacatcatgaaggtatgtttttttgtttactttatcattgctacatgccttcttcatgtgtataggatagaccccattggttcttctttaattatacatacacttgtctctcttgtatagttatttgtatgcatatatttagggcgagcaaatcctatacatttattgcacatgttctagatccatgttcacctattatttatattgaatctttgcacttgagcttatgcacgagtatatgacacttgtggtgttaatgaatactcaacgaacatattcatatatttcatatgcaacccgggtggtcatcaagtggaggatgacaacc

SEQ ID NO: 81892 - DNA, 1500 bp, Oryza sativa
  unsure (1)..(1500): unsure at all n locations
gaaagctttttatatgaaagttgctctaaaatatcagattaatccatttttcaagtttgtaataattaaaactcaattaatcacacgttattaccacctcgttggtgtgaaacacttaatctttatctcatcttcaggagattcaaacaccaccatattacctaaaaatcatgtacatggtgatcaaagatgctcttcattacacatcaaacacgcagctaaataggggcgaatctttattatttatagcgagcgtgagtggttacggtatgcaattcctttcatcagcacagtgtgagcatcacgcgtccccgtcccgtcggcgcaccagcacagccacaggttggcccagagagggtgcttcaactgtcggcgcttgcacatctggaccgtccatcgcggcgatcggacggccacccgtcccgcaaccccgccccgcgtcgcctatacaagacgtcccacccccccccccccgtacgctcctcccccatttcgaacggatccgggcgcagggtgcgagtgcgtgaggcccaatccccaaatcccccccccccctcgccgccgccgccgcccgtctgcacgcaggcctcctcgtcggtgaggtccccccgctgatccgtctccctcccccccttcctgttgatccctgcgctgtggagtggcccggatcctcctgcgagatcccgtcgcccccactttctttgtttttttattttttacttnnttctcgggtgttcggcgcgggcaatgctggatcggtggcggatttcgctcgccgtaggtagcgcacggcgtgatccgttcgtctgtagggtcgtttccgcccaccgtgcttttgggcggttgtttgtgctgcgtctgtgcgttcctggtaggtaggaattgcgtggagagcattagcgaggagtggaatgtatgttcgagattcggctgcggaagctaactttgtgggacgatttctgatgggtccttgtatggtctgtggctgtgtgatgtgtagaattgtggattttgttttaggcctttggaagaggatgccacgatctgttttgtttagtttttcggtccgattggactggatttcctgaatcattctgtgctgatctcatccctttgatgaaacatagtgatgtacgtcagtatttgcaacggtgtggtcgttcagatgagcctgatcttgcagttagatttgaatatctagtaagcgtgacatgaacgtcttaataaacgtcacatgagcgtcacctactgttttctagcggcatagacgcctagtggagacggaagatctttctttattggttatcttgttgttttgcacaaattacttggtagtgatgttgctgtctgtgtacttatagacaatagaaagttgctttcaaatgtaatacttcacaatgttgagcagtaaacgcaccagagcgtaaaggttcttgtgttgtttatacttcatgaatagcaaactaccatctaggtgcttatagccaccttttatgcttg

SEQ ID NO: 81893 - DNA, 665 bp, Oryza sativa
tctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctaccatggacgacctcgccgtcgtcagcttcgccgggggcctggagcccagccagaagccgccgacctccatgagtttcagttgccctgttcgtccatatacaggtcttgctcgcttgaatcctaccacgcttttctttctctctttggcttcagtttcagttggtgcgctactgaaatgctctggcgaaatgcgtattgagatgaatgcaaacgttccatggattaaggtggaaaaactgccaagaaatccaactgggttca

SEQ ID NO: 81894 - DNA, 3101 bp, Oryza sativa
tcgctttcttttttctgctcggcggtttattcttgcatggattgctcattgcaaacgtgcatctactcctctgcttctaattgtgtttgccctgcgtgtagatgtagtccagatgagccacgagcaaacgctccactaggcaatcatcttcttcgcaaccttccactctaccatcgtagtttcccctctccacaacctgtgccacgatacccacaacatgatggtaaaaaatcggttaaagatacgttcaattaatcaaattacactacttcgtacatgcaaatttatcaaaggaaaacatgtcgtgatgcaacatgatatcaaatgtacaactgaaactaaatttaaaagaaagaaaaacagtttttttccttcaccttactggaagctttgctgggttcaattggcccaattctaccaccatggcttatgctgatgggaaggagaagtgctacaaggcaaatggctatgaccttcggtgacatggcgtgttatgtttgtgtaggactagtatcgaataggtcatggaacctgcatacacaatggtgtcattcagacgctttatataggactcaaagcaggggagaaacggtgtcaatcgtatcaattcttttacaaggatttttgtttcaaaccgatttgagaaaaggaatatactgtagacaagtatgggtatagttatgctgctgcggtggcaagtaagagtacagttgataggtttcctgaaaaaaaaaattgccacaaagaaaacatacaggagtatattcgttagttatggacgtgcgcattcagacaattgacaagtgacgatgcttctcgtcgtttattataccggttcatccacgaagaaaaagaaaattaatatatgctcttagctatttacaaattaatattgaagaataaactacgataaaaaatcttaaaattatcttgaaaataagttccaaactattttttttcggctgataagtcaataagcaaatgataaaactgtgtatatggactccacttgtctataaatataagtattccaggcatttagaacttgttcacaaatggattcgtgcgttgcatcaatcatcttagattcatttttttaatttactctatttgtttcaaaataaattaactattggatattttcatatttgtaaccataaattgctttccaatcttactcatttgttgcttcatcaatgggaagtatctaaaaaaactgtcgcattttctttaggaaacactttcaaatataaatatattataactatattgtaactacgatataacttacgtaaaacttgtattttcaactatggtttgtttggctagtgccgggatcttacgcatgacatgtaaaattttctttatagcaattttttctcttcatgcagaaatctcaagatgatcgagaacgaccacaaatctataagttttggaggaaaaaactagcgaaggttttctagcgattccggtgtcaatataattgcagtcctcgatcgttacctagatagtcttgtgcatgtgagtatccgatcaagatcattcataatgttctcaaaaagaagagagagaaacctttcggaaacgaaactgaagtgtctctttcattttaagttttgcaatccttcattaagtagcactaagatactaatcacttactcacttatcactttcattttaagttttacaatccttcgttaagtttgcaatcttattaattaccaccttatttttaaagtgtacaacgttattaatttttctcataaggtttaatattcttcttattaaaagatttagtataaatatataaaattataaattaagattatattttatttgataataaaacaagtcgtaacaaaataaataatattatactacttttaaataaaacaaatagtcaaacgttacatgaagagttaacgatgtagtagcttaatttaccagtcctatttagagcaggtactcagattataagctagctagctataaatatattttatagaaataaaagagaagagagaagagcaacagtctatctgtagccagctgcagtacggactttaatacgtaatgtatatatgacatgtggaactaggtattaataatacagtaagcaattattatatgaattaagagtattaaattagctataaatattttagagctagtggttggttataatataatattaaacttgctctaagctggggccggtcactatctgtgtccatgcgcagacgaggatcgcgtcgctttccccgcgatgattacccccggcccgatcgagaagaagacacagatgatcgagtgggtgaccaaggacgacggcaagtcgatccaacagatgagtaggtcgttctttaattgactcccattgcctacaacctggggaaaccaaactctggttttcccaggttaaaagccccaaacgagagcggctagccacagtaacacgataacgtacataacaattccagctgcgcgcggtgtatggcggcgccggcccgactccgccggtgcacagcccccaccaccagcctaatttgttccaacgcgcgcgcgcgcgacagagagatcagcgaagctgagcatgcagtgccctagtggccgcgtcgtacgtacgcatctctaccttaaaacatacgtgtctttatcactaccacgtgagctcgataaatactcatacatccacccgtcaatgataaatgtatggtgcttttaaagataaaggatctgaatcagagtgtgtttagttcacatcaaaattagaagtttagttgaaatcagaacgatgtgatgaaaaggttaaaattttacgtgtgtatgaaagttatgatgtaatggaaaagttgaaagtttgttgaaaaaatttgcaactaaatacagtctcagtcgtacgtcgagccgcccgcaggagccaaaccacctaaaaatcccacagccatcaacgtactcgatcgatacagatatagatggatggatggatggatcgaccgcgcgcgcgggcaacgacggcactgatcgatcaccttaatttggttgcaggttgcgacgtcgacacgggtgcgcgtcgcggggccgggggggggggggggggg

SEQ ID NO: 81895 - DNA, 25939 bp, Oryza sativa
gggtatctgcggccgcggcgccgggatcgttgatcgtgcgtgccgggacatcgcggctttggtgggccggcctggccatgttggctttaacttccgaagctgtggatcgttcggacgtatcaggcccattacgccatcacctgtatgtattcctgtactcatgtagttcgttgggagaggatcatagaaaggaaaagtccctcagattttcgtgtgcacccttcctattctgctaaataatatgtttttaatatattttctatagataaattattgttttgagaaaaatcatattaattcaattcttaagtttaaaacatttacaattcaattaattatatcctaatggttaatcctgtttttgcatatcttttttccactctttttttaatccattgctttccatctacactacaacaacccagctttccacacatcgccggcagcatcaacaacagcccttctcttctactccctcggtaaaaaaaaaaagacaaaccctgagtttccgtgtctaatgtttgactatccatcttatataaattatttttataattactccctctattcctaaatataaggcacaaccacccttaacccaaagaccaagaaatagttattatcatcttgtaattgaatcatcctaataaatgtaatgcatgcatccaatagagttagagaatgtgaggatgaaggatttaaaagaataggagtgaatttcagaaaaccccatgttttgaggctaatataacacataaccacaggttttgtttattttctcacataaccccgtgcattcaatccaattaacataataccacaggtttaagtaaaagaaagtgccacaagggcaagtgatatggcaaacctgctccacatcagctggccccacctaccaggtcaatacatggcctattagggtgggatcacgcgggagaacagaagcgcgtgttccctgtttctacgcacacgacacggcgcctcccgtctttcttgcgcacgctggcggtggcgacgttccccaaccatctcttgcatgatggcctccggtgatgatggtgatgttgacctagctggaggaagagaactcgttgggtaccattcctagcaggtaacattcatcccttttcttgtgatgatcatatgaattgactccaaagcatgctggttggtgatttgcaaggacactctgcttcatggttctttgacgaggaattaaatccagccattttgatcatgtttggcttgtcaagaaattaggcctagtaaaatgtaatttaggggaaccattattgttagggcattacaactatgcaatcgttcttctgtttgtcattgcaaaattgcttttcatcatttgaccataattttttaaataaaaaaagcatgtagattggaccgtgtataagactattgtattacaactattatattgcagtcagatataaaactaaccacaattaacatttaaaggcctgcaacatttttttctgcttcacaaaagagcagacatggcttcctctttttttttctcggtaaataggttgtatttttctctgcttcacaatgtatatatttcagatatggattcgttttgcaaatttcctatgccctggacctgcaatgggtcacatattaactgttgctatggtgcttttattcagacatgggatgtttttataacgtttgctccattgttctgcttaatgcatagaaattgtcagttttttcctttcatttttttttcataggaacacagtgtcaggcaccttggtgatcgacctacttacaaaaaattcgagcagaaacattgtcaggtcctgccgtcctggccacgtttaatcaaatacacacacaagctttgtattagaagataggaagtatatgtacagtttgatcagttgatgcaaaacagaacaggcgatgcttgcctttgcatgtgcacgacgagctgcccctctgaacttgtaggaggaggaaaactgccgcagcgagcacgaggaagacgaggggtgcgtcatcgcgtgcgcgggaacagaggatgggtgcttccccgcgctaaatagcccacgcattgatctggcaggtggggccagctgatgtggagcaggtctgccatgtcacttgccattgtgacactttcccacacttaaacctgtggtattgtgttaattggatagagtgcattgggttatgtgagaaaataaatagaacctgtggttatgtgttacattggctccaaaacaatggggttttctaaaattcactcaaagaatagtaatttaatgaagaatacatgcatgtcttatattatgtaccataaaaaagtggttgtgttttatattatgaaatagaggtagtagtatttttattattgttagatgataaaacatgattaatactttatgcgtgacttatctttttaattttttttcatattttttttaaataagacggacggtcaaaacgttagtcacggaaacccaatgtttgtttttttggacggagggagtacttgccctgcccgtacggtgtatacgtgctgtcgtcgatcttgccttacgagactgacaccggcccactcaaaagggataccataccaaccctgtaagactcttaacatttttttttggcaacattgctcatagggttagtacacagtacttgctgatccattgattgacagccgtttcattgggttgatattcaagggcgagaggacagtacattagaagtactagtaatcaacaaaaaaaaaagcattaatttcttcatgtacgtgggcgtgcttacttttacatatgtaccacgcatgcaccttaaattctcttaatttagagctcatcaacagtttgtatgtacacaactacggctgtctgccagctagcttttctacgtatacccttggcaaaataccctaatttacggttatgttaattaattgtgatgaaatatatatcctcctaagtcctaataacagtctattgccacatactaagttctggaggggtaaaacatttcacacacaattcagagaataattttggtacagctccacctttaatggttcttgtctagctctaacttcaattgttgcgatgatcggatggacgttgtttgcgtcgtggatgtaaatttcttctttgtctagaagacattgtcatatgtttcttggtcattggttgtacatacagttgtttattcataggaagtcagagctgctcttttgagctcgacaacaataatttatgtgttggaattaatacgtggctaaaacttatatggagattaattctttgaaaaatcataaaagcccatctcataataaggtatacatataaatctttagtaccacctcacttattataggagagggatgcctcctaaaaaaaggagattgctcttctagttacttgagccatgtgagatgaagaggactagagaaacgcacgtgctcccagacgaggcggcgtgagcatgaatggtcacaaaaacggtatttatttttggaaaccagttttaggaaacacaccgaactgcgtggaacgacatcgagtttggataagttacacacaacttatccagttcggttatacggtgaaatttggtgtttgttatcggaaacataattgtaggaaacacgctgaataatccgttgcgtggagcggcgtcgagtccggataagttacgcgcaacttacccggttgggtttatagtgtaaagatcgtgtaggtgtcctgatcacacgtcttgatatctctctctatataaaccgagccaccacctcctcacaacatacgccaaaacaacctagggtttgtctcctcctctatactacattattgctcgtaatctactacatcccgctcgccggcattcactgatgatcgggagagcaggtctccgaaaccttcgccttcggtttcatgcaccgggagaaggcgacgataagagttttgggaaacgattcgtgcgactggtcgctgttctttcacaataatttgtcttcctctacgcttgacgtaagattaagtgagaaagctattatgttcacattttagacaaggtagtgtcttaaatcactttattttagtctacaaatgtcatatttggcacagctcaggatctgacattttctggagctgggtgttcctagcttcacaaatccatggattggatttaggattacattgataatatatggatgaaccattttgttcgtattttataaaatttcaaactgtactataacttaatatacaaactttaaatttagtgtatctaggatttagagctgtaccataccaaaccagaccaaatttagtacacactccatatcatgtaagaatattaaaaaaatatatagctctaacaaaaatctgaaaattagctagagctctaccaaaacccggagttttcagctgctggcagcccacagacgacaaaagcacaaaatgccatgatacagcgcacctttccctttgggcaccatcatatcagtccagcgcaagtttaacatccgtgacataatttatgtgtacctaatgtggcccccatgccatcaccctacccacaaaaagagacaacaaataactctagtttgctttgctagccactcccttgttttatgaccaaacttaaactttttattagtggccatcaaattgaatataacggcttcccttttagactagaagaggacgacgcagagagaaaactgaaagtttttttttcactaatgtcttgattaatctcaccctcagtgacgatgcgacactagtttcatatctagattgaaattcactaagggcccctttgaatcacagaaatgaaaaaacggaggaaaaaaacataggattttgatagaaatacaagtgtaaaacaggtgattggaaaaaacaggaaaaacataggaatgactgttcgattgggccgcaggaaaaacacggaaatttaaggagagataaaagactcaaagtattctttccatgaggttctacctcatgttaaatttactctaaaacttacatggggaaggacaatccataggaatttcataggattccataggatctatttctttgattcaaaaggctatatagaaaaaaatcctatagaaatgaaatactctaaaatttctatgaatttcctttgaatcaaaggaaccctaaagttttatatcaagtacaaattgggaaattaccggttggtaggctagctaactttaacttaactagtggcgccaattaaggatgtgttcggacccaagggttcccaacacctctccatggttttccgcgtgcacgcttttcaaactgctaaacagtgtgttttttgtaaaaagtttctatacaaaaattgcttaaaaaaatcatattgattcatttttaaaaaaaaaattagctaatttctaattaatcacgtgttaatggactgctccgttttccgtgcgaagaagatttgttcccaacctcccccagcaaacacagcctgaagaagctttcgtgcagcgcggcgcgcgcgcgcttgcttctcctttttctttaagattgcagctaaagcaaagagctaaaaggtggcgaaacgggaggcctttctcgccgcgctgcgccccctcttcttcgtgccatcgccattgccgcgcaacatctgagctcgggtagccattgctagcccatgcagggcctcgcgtccccgcggtgcgctcccttctgcggccgctccggcgccggcgcgggcggggcgccacgcgcgcggcggcagcagggaggtggctgcgggcggccgctggaccgcgtggccgggtgggtcggcggcggcatcgccgcggcgttcttcgcctccctcgagcggtgctcctgcgtgaacgtccgcacgcacgacgagctcgacgacgagacgagggactccgaggcgctgctcatcatgttcgacgtcgtcgacggcagcgaagacgctgcctccgccgccgccggcgccggcgggaggaggggcaggaggagcgagaagagcaagcgaggtggcggcggctgtggcgggcagctatggtgaataattaattagcagctatatataatttttgctatgtatgatcgagatcttgatgatgatcgatggatgcttgttaagtttgtgcaagattatttacgtttatatatatatgtctagctttcatcttgtgaaagatacatattttcttggatgtatggatcgatgataaattgtattcaaggtggttttttgaagttcaatggcaatggaacactgattctcccttccttttcattgtgttctcaagatgtattttccatcctcaaatgatacactgttctattctcaagaaaagttttaagttatatgtaaagatcaattatatggcataatatgtttttatatggttagattgttaaaaaattttagggcaatcatcctatattttgttagttcattcctctctttttttaatgtgcacactaaagcagtggtggttctcactgcaacaaaaagcatctctacggattttttttttcaattgaacatgattgaaaaaccattttcttatggggtaacccattttcttataatccacctaggcgttcaacccaaatgcttcctggctctacgttctaacataatgtcgtgtgtgctccgattttctttttgtaatcatcaggagtttcgttctcattgatcgcatataagagaaggaagaaagtgttccattttctttaagaaaaacatgtgctatttcatgtttttaataataggctcagagcctcagattacaatcggtggaaaaatatattacaatgtcgaacaaaatatgctcaattgccggaagcacattgctcaaccaaacagccaagcttaacacttcctctagcaaacttatttaagtcatgaaagacatgagttattcaggctaaattggagcaaaattaacatcccaacaaagcccataactttatcgcaacgtaccaagttgttctgttcgccagcattcggtttggcccatcaatgtaaacccactgccttattttgaagcccagctttgctttctcagctatactacccatttaacaaccatcattgatcattcccatcatcatctccattttagttgtgcaactcaactgacagagatttcaacaaagcatgaatgcatcacacatgcacatacacgcgagtgcgtccctttagcacacatctctgtatataacattcacattgtttgcttatcatttgagtcttactaataaacaaattaaggaagaacaagaaaccaaataactaataacagacaaagtaagcaaaagtatgaaaggcaatctaaccaaagctgctgtgcccaaaaggccccaagacactatatcggcatgctcttttacttggacacctgtcccaataatctcccaagatcaaagctgcatatgcatcccccatgtctgcctgacaaacacaaccaaaaacctctcacatgcaggcctctggaaagctcaaaatactatcaaattcccaaagcacaatcagggagcagctagccaacagcctttatcccacaatctcgatgcatcccatgtgtttggctacattgcgtgcaacttttgcttcaaaataaactaagtacttcatccgtcccaaaataagtgtagccatggttttccacacccaactttgatcgttcgtcttatttgaaatttttttaaaaaaaattaaaaatataagtcacgagtaaattactattcatgtttatcatctcataacaacaaaaatactaattatataaaaaaataaataagacaaacaattaaagttgggcacggaaactcatggccgcacttattttgggaggaagatagtaaaggttatggagaccagtaccctcccatcaatcatcatgcatgcaactaactctctgcatatagacaggcagctctggcatataggcttggaatgatgccatctgtccttttgcaagtttgcagtctttcttttgcatatatggcctgtccgttgcagcttaaacatctccttttgtagttttgctagctaagaacaagcttttttagttagttaaataggtggctagtgacacttatatcaacattcatctcacagatgaatagatgtcgttatgtaatacgtgcagttaaacctcgaaaccttaaataattaatttataaaatatattaggagttgatacgagaaaagtgtcaataggtgcagtcaaacctcgaaaccttgtatgattagttaataaaaaaatattaggatttgatatgagaaaatgtcatttgtagatttgtcatgaaaaacacatttatattgtttacttttaatggtttttaataaatactacataagagtaaactatgctcacattacatgaactttcgtggtaggtgtaaataggtaaaaaaattacaaaatgattagtctatgagaatagggacgaaatgatccacgcaaacaaaattgttgcaacgttgcaaactgatggcacgacagcttacatgtatgaccatgttttagagatcttatttgaaatctaaagaaaaatagaaatatgtgaaagttcatttttcatgtacataacagaatttatttcatgtcttggaaaaaatttattcactatataactcatataaggttaacctatatgttaaggaccagggtaatttctgccatgcctttgtacaagtaactgctgaaaattacattttaattttcatgctcagaaactcatttcaccaaaaaaatgtttttttaaaagcttactttcatggttgggcatttttaattgtttcgctttttgtcgatctaattcttaaaaatatcaagcgaataatagttacacattttgtccatataaaatttgatgtgcaataataattactcatcaatatgcaccacattagatcatattttgcttgcagagattgtattgacccaggttcacacaggctaggcatgttgtaaattgttgtatctatttatacccaccatacaagctgatgtaccgtgaatgtaatttactaaatatgtaatttagtgataagatatacgtattgggaacaacgtgtcaatataaaaaacgacaaataaaatagaacagaggcagtccgtgtgtagtgtggtgatcatgggcaacggcaacggaagggaggtttttaatttaaggttcctttaattcaaaacagcaatttctttcggttcctaccgaaaatgaactgttttatgcgcaaaaatcatgcattctaaggtagcgtactcctgcatgcatcttgggcatcttttttggctcaattgatctctcatgcagcccacttggtgcaaatgttggagagaagtgggcgtccatttaggagaatgctttgggcgaaaggaggtggatagctttagagagagtgagacacttgccatttggattggttataaaaatttccctagtgcagttaatgttacaaaatatatatagccctgtttggttgtacatcggatgtttggacgttaatttagaatattaaacatagattaattacaaaacccattccataacctttgactaattcgcgagacaaatctattgagcctaattaattcatgattagcctatgtgatgctatagtaaatatttactaattatagattaattaagcttaaaaaattcgtctcgcggattagccctcatgattatcatagtagcagcctatttcttccttgcgccctgaccctaatgattggtgacattgcagcaactagagctagattctgtgtgcattaagttgttatatttatggggtttcctgcaagggatcgactaatggaacatgttgtccactgtccagtggtttagcatatcaccttcacaaaagtattatttttcgcaaagttcaatctttaatttgtatctaacatatcttttgatagataaagacatagaagaatatcgtatggttctatcaattatagtactcgaaaataaaagtagaaaattgacctccaaattcgttttcaaggcgtacaggttattcctaccatgttaatcaaagaacaaaggagaagggaaaaaaatctaacccgttgagtgtggtgtccggatgacaataatgtatatttatctgagatggcatattaggtgcatgtcaaaagaaaattgccaattgaattagaaatcttaggtgcaaatgattttcaaaatagagtatcaaatttggtgcatgctacagttattgagaagtacccctccatttgttgataattgacaattttaacttttccaattaaactttaaccattaattattcttaaaattggcatatcaaagtgaacaaatgttctatggacatacagcactctaataacattgtatcatttctagtatttatattttttgaaaaagaaaaagacgagcaattaaagttcaaaaatgaatatatgttgtttaaagttgaaagagaagaaagtcaagaaaccttttctctcttttcttaataaactggccagtccaggagagattggccggagaaaagaagtgcaaacagagtgagcatggtagtgtgcgtgagctatgcacaagtttggggtgattttgatggaagacgacccgaagggcaaaatcttcaaccttaatcacgaaggaaacgtacggcccagatatttaattatctcacagcagtccaccccatgatgatttgaagttactctgtctgatggccctgtatcttgtcagtaattcggtatgccggaaactgggggcaatgtcaaagtcttttgggcctattggttaattaactggcagcttaaactggacaactgttttattggctcaaattttgcctaccacttttgttcctatattatggacttgccaacatttttgggtttgttaaatttggtctaaaagcaaacaaaaccatactttggcttgtcaaatgaagacatggaacagaacaaaccagacacgcgcattggcatactgtttaataaggaatactcataatacttgcgaatcattttattaagattttgcgcattgaaatattacatccgattcataacaattgacacgtggcaatattccctatattccaaattacaaaacgtaaacaattcaactctaataatatttagctaacaattaatttggtataaattaaattttatttgatgaaaattatattattgtattcatatttggatgtgcttccttatggttatcttttgctactaataaacattgtagtaatacgagaaattaaaaatcaaatattagttttagagaactccgtcaagtatggaccgtgcagtatattctaggacgaggaatcaatagcaaatgcaaagctaacttaaccacaaattcactcacaagaattttgggatattttattttaacatgaggattatggaatatggaccccaaaaagtaagaaataccaataatacccctcctaaaccatctataaataccccagcccttcacttcttccctcccttttccctcactcccgtctctcccactctaatacgttcctaattaccattatgcccgtcatgcacctcctggccccaccagcgcaagccttcgtcgtcgggcccccgcgcgtcgcgcccgcgttcgacggggcccccgcgccaccgcgtgaggacgacccagccgccgaccagccgccggagagggaggccgacgccgacgagcggcgcctccgccggaagatctccaaccgggagtccgcgcgccggtcccgcgcgcgcaagcagcggcacctcgacgagctccgcgcgcgcgccgagcggctccggcgctgcaaccgcgagctcgcggcgcgcggccacgccgcccgcggccgcgcgggcctcgtccgcctcgccaacgcgtggctccgcgccgaggccgccgccctcacccgccggctcgcggcggcgcgccgcgcgatcgcgctcggccagctgtaccgccctgccgcggcggcggcggcggcgtcgggacgttcgagcagacgatcgcctcgctaatcgcgtagcgcgccgccatgcacgcacgcatgcacgttcttgatttgattggctgcaggttaattaatggaaaggcaaatggatttaaatatatcctgaaatccaagcatagcctctggatataaatcgtcaagtaaaagaatgagaaagaattaatggcatgactaatttgtgagcctaaatcggtcagaatgtttaattactggccacctgtatttcctgagatcgttggatatttctatgcttaggttctcagattattagcactgatgtcaactggcgagacacatcagaactgatttcatttttgaccttcttcggaattgatgattttgtcgggaattgaactgattttcatggaagtctcttttaagttttttgcattccaatttccaaacgatatctgatagtcttaagagagcctacgtgtgaagagagtactccacctgcagaaagacgttttggacaaagatctttcataatctcataaagattactatttggcctcgtttagttcccaaaaagtttttcccaaaaacatcacatcgaatctttgaacacatacatggaatattaaatgtagattaaaagaaaaactaattggacaattagggaggaaatcacgatacgaatcttttgagcctaattagtccatgattagctataattgctacagcaacccacatatgctaatggcggattaattaggctcaaaagattcatctcgtggtttccaggcgagttatgaaattagttttttcattcgtgtccgaaaaccccttccgacatccggtcaaacgtcctatgtgacacctaaaaatttttatttcttaaactaaacatgccctttgtttgtaaatttattttgtacaaaattatgaccaaatttgcactgacaaaaaaacagttcaaatgtcaccttttttaatcgtagggagtaacgtacaaaatcaatatagaagctctcgacacagtccattccaacaatatgattccaatataatcatcctctaaaagttacatcgtcggctacaaacatagccaacacatacacctacaataaatggtgaccttgtttttttaaaaaaaaacaaaaaaaatcaatgtcaccccaacaaaaccaaattgacaaaatttaaattaagtcccgtgcacaattagaataagatcattaagccagttgctcgacaagttaattaggcgcatttgtcaaagaaggtagattaagctggcccacctatatagatctcctcattagattattcttttcgatgaaatggttaatacattatacatacaactgaataatatttcctcttccttgttagatgaggagcactagaacatatctttctcattacatcgtttttgttaccgaatctataccactacatatcaatccagcttccaattggcttctatcactatcttcctgcccttcttctatatatccctcccaaccacggctttggaggcatcacttctgctttaccacttatctgtcaaccttccatcgccccaagttcggtatatatggaagtttccactctaaatccttaatctggcaggacaccccatcactatcagttgttagtttttaccacttaggttctctttggaggtaggaatgctaaaagcatataaataggaaaaaaataggatttttatatacatgcttatctagaatagaggaacgtaaaattcaagataaatgtatactctctccgttctttaatatatatatatatatgatatgttgacttttaaagatatatttgaccattcatcttataaaaaaaatacataattattattcattttattgagacttgatttatcattaaatgttctttaagcatgacttattttttttatatttgcaaaagaaattgaataaaacgaatggtcaaatgtttataaaaaaatcaacgacgtgatatattaaaaaacggaggtagagtagtacataaacaatcatttagatagaccacatggaaaaacataggggttagatggcaaagatggacccaaatgaaattttttgagagtttgaaccttatgctaactatcctggaaagatctccattcgttgagcatttcatagctagaattttaatggtatccaattctttgtctcaaagtgtcatttagacacaaatattagggaatgacctaataacaaataattagaatgtgtgaggctttaaacccaggtcgtctagcccaccaccttgtggagctagccggaaaatccctaggcgtttctcaaagtgccattcaggacaacaatgtcctatacagggacccaaatcctaaaaaaaaacctccatttgtcatttggatcatttgttcccaagggcgcaagtaaatagttaaaaatgtagcaatgctatagtcacaaacgtttcaaatcttaccatgagcaaatgaattgatggtacaactgatacagtgatactaaaaccccaagaccgtaagaaaacttattacgccataattaatgtgcaaacactttggatggacaacggccggtggatggatcttgatcagacaactgaacgttctctcgtacgcgtgtggtggccaactggccattagttcatgctagatttgattggtcaaccgatcgatctggtgcatgcatatatgatgatctgatcgaagtggacgtcgttgtttaattcctgtgattaaaagcgaggacaggatgctttccagattaattttgccagcagagcttaatgcgtcttaaagctgtgcctgctttgggcgttaatatcgttttcgggtgcgattaggaacttattctgtgggtgggctgttgctatcgccacgtcgaaagctttgctgcctcaaatcgtgttttaggactcggtactattgacgcctttcagataatccgaaagaaagaaatatgtcctctggccgagaaaatatatacaggtctgtttagattaatttgctgtggcaaattattttggcaaaaattttggtggaaaaagatttggcattgaagttttgctagttggtgtgtaaatacatggtagagttttgccgacttttgctactagtgtttagatccattttgacaaaaggtgctctaaaacagcaaaacttttactattttagaataactaaacaggggggcatagtgaaaatcacgtatgtagtaaaaattatcgtaagatataatagacgtatgtgatttatctacattactataagttctactgtggtaaaatttttacccatattaacgtgagccaattcttatcattcattttttttcatcttacaataatttccactacatattttctccctagaccttattggtttgcgatgctaacatgcatggcccacctagtcacccgctgtctcgatgggtttggcccaattaaaacaagcccatttggtatccatttcacctccttttctcccgaagatttttctttccattttgttctagcgaagaaaaaaatactaaaaatagattaatccatatccaaatgtataataatatatttggattcatagtattagattgcgtaaaatataatactagattgctactccggttgtcccggaaaaaaactcctagctagcatcccaagacaacaacaagagtagaaaagatcgaaacgttccttattagtagaaatttagaattggtggatgagggatatggacagtggtggtgccaagatttatggaagactagagctggatagagcggtaccatgtgatcgtgggttcattccccacggacggtgccagctgttgtcgattagacaatatatagcgtctgccgaaagacaatattcactcaaatatttggaaaatatgaatggtaaatgtattgatttcttaataattggatcccctattacacatccattggggtctatttatagttttatagtccaggtttataatcctaaggttgttggttactcgggaattgacttggcttctcttatgatagggacgtttataggggtaataattgtcttttgtcccagtttacaggcccatgggccctaaaggcccctcactaggccgtttattaggttcgcagggcgaaagcctctacgaagagctcatcctccttcgtcgtatggtgttcctttgtcccatgcttggcgaaggtcttttgctctgttattccatgggcgctaagccactagtcgcttgccttcattacttatgcgggcttcgcccttcaacgtctggcttcgtgacttgacaggtgtttcggtagtctgatcaaaggtactcacaacatgcctccaacagttggttgaagacattcatgacatgtccctgacagttagttttctataagatttatatggtgatttaataaaatatagtcgagattttagaggcatgaagctatcctaggtctacctctgaccctgggtatatggaagggatatattttctcgatttataaaggtatgtactctctccatttaaaaaacagttatggatttgaatctgaaaaatgtgtaaaaggatagaaatcggtctattttaagatgaaatttaaactgtacgagttttttttttttaggaagcgtaagcagttaagctgatgtggatgcagagttgcagacagtcacaagcaggcggaggttggtttcttggtttcagtggagagattgacaggtggtaggagtagaaaggataggtgtggtgtaggagtacgggcggaaggcggcgaggacagcaggaacgaggccggccaaattcccccaggggggggggaccgtggtttggactttttaaagtacctatcataactatctatcatatcggatgtttagatgctactctcttcatccataaaagttaaacatattttacatttgagtttttctaaataagttgatttatagttcttatgcattcaaaacttaaatagagagataaattaaatatttgattagaacgtaaggagtcatctaaatacttattgattgcatgcttgcattcacttcttgagtttgtaatatccaagatgatttaatttctccttggtcgtaatgataaaagtaatatgtgtaaattttgtggatggagtaatttggagtattaaacatagactaattataaaactcattctataactttggactaattcgtgagacgaatctattgagcctaattaatccatgattagcctatgtgatgctacagtaaacatttgctaattatgaattaattgggtttaaaaaattcgtctcgcgaattagctctcatctatgcaattagttttatcaataatctatatttaatactttaaattagtgttaaatatccgatgtgagacagactaaaatttaatccttgtgtccaaacaccacctcagtgcccgttgctgtacgccgtgagccatcagatcaccgccccaaaactatgagcgcctttgcgcctttcgcccgggccggcgtacgcacgccgacgcagcttttgcacaaccacaacactgctgctgacatgttctatgctactgttctaccttgtgctaagcatgggccattagtttagctctactacttcagttactattactactgctgttagtttgttactgtactagtactactccccccatgctgtgcctgtatggtcaaagaaaggcttgctggttaccacaggtgccagcatcattcgcttcagaaatcagtgtgtgttttttcatagaaatggaatgtcagggaatcagggatacaccgttcaaagggaccaaaacacacacacacacacacgcacgcacaaacacacaacaccgctcctctgagttctatcctgctcccattgagctgtgtgtccatggctctcattggaactttcagctagcaataaatttacacaacaagaaatggaaaggccccgtcctccccaacgagaggcaaggagaggactgtcgtcttggttttggttggaggctggcacaactctcacactcacagtcacaggcttcacgaatcacgaccatgagctatacagtactggtacttgcactagggcccagtttagtttctaaaaagtttttctcaaaaacatctcatcgaatctttagacacatgcatgaaacattaaatataaataaaaacaaaaactaattgcacagttaggtcgtggccccctgtatctgtctctcaaaacacacagaaaccactaggtgtgctatggtttattggtttagagcctctttgaatcgtatgattgaaaaaacagaggaatagaaaaaatatagaattctgataggaatacaagtgtaaaacagagaacacaaagaaaatacaggaatgatcgtttgattggaccgcaggaaaaacacaagaatcagataaaaagagatagattgaagggaagttttccaagaggttagagtggatgctaaattttctacgtttttcctctagaatcgtgggaataggaaagtttcctacgttttttcttttctcttcctacaaatcaaagacatgaatagtgtagggtttcaattcctttgcttttcctctatttatcctccaattcaaaggggttatgtttagtttctgaaattgggaagaagtttgggaaaagttggtagtttggaaaaaaaagttgggagtttatgtaagtaggaaagttttaaatgtgatgtaatgtgatgaaagttgggagtttgggagaagtttggtgcgaaggccttaacagggttagtaaaaatgtaaaatgcaggagcagaagccatggaggaccttgtcctgtgctgtgcaagaagctggctgtgcatagaaaattggagtagcagtagcatagcacctgtgctcccttgtgctgttcctctgaagaggggcagtgatgagagattttggggggcctccactactctatagtcaagctttgaactcaaaatattgcaaggtgcatcgtgcatggatacatatatactacagtagtatttgccagtactctctactaggcgtactacggagtactatactgtagtatccgtgaagataacatttttatgctgttccttgtaatctactcaagtagttcagtaaacaggggaaccagcgcttctaccaaatcacccttgctctgaactgtcgcgaaagcttgaaattatctgatgcatcgagtagaccattgcagcgtgtgctgtactccgatgtaatgttatccattcggagtactactatcagtgttccgtactgtgtcttaagcctaaccatgagagtgtgttttgctgcagctttatatggtcgctgccactgccactatagctgattcccctgatccgtcttcaggtgccatccaatcaaacaaagcctatatgtttagatacaaagtttgaatccaaacttcagtccttttccatcacatcaaccagattacacacacaactttccagtcacatcatcttcaatttcaaccaaaattcaaactttatactgaactaaacacagccaaagttgaaggtatgtttgaagagtttcacagctacggtttctcctagaattagagggtgttttggtgaaacacccccttaaaatcttgctaaacagtttaattttttttcaaattgagaagctatggttgtacaatctaaaacataaatcaaaatttagaagttaaagaaacccagattttatatattttcaaaagttgactaacaaccagttacttccaaaatctcccgagccccattggttgccctaataaaccaaaactgaaactaaaatttgaattttcaattctcaacatggtttcttttctagctttgatttttaagttgttaagaacacacatataaatattttacctatacattattttttattttttaataagccgtttttgttctactagagaatatatatgggcgacagatgagatcccccttctctcaaatgccagctgacctgcttcaagatttgtacagaaaccctgatcccccgaatgtgtaacatctgatgatactaagttggtttttttatagaacggaagggaaggagtaacttgttctgtttacagcgccgtcagtagccaataaaacgccagcgaccgcgacgcatcgtgccttctccgttggttttactccttcgcctcgcaccgcaccgcatgcggcgagcgcgacacaggacacactcggacgctcgctactcctctccgctccgggcggatggatggctgcgctacccaacaagtaacagccatcgtccgtccctggggaccccgaccgcagagcagacgccctcctcctccctctcctctccccacccatggtgttatgaggagaagaatactatgatcctcttcttggcttcttcttgcatcccctcctcctcacatgccaacaacaacaacccttcctcctcctccattcgccacccctcctgcttccatccatggacgccactcccgtcttcttgattgctgattagtcagctgcctgcgctgcgttctccttgtgcttgtgtgcgtgtgagagagtgttcgagcgaaggagaggaggaggggaggcaatggcggcggcgaggaggctgtcggagctgctgcaggagcagcaggagccgttcctcatcgaggccgccaagatcaggcggctgcggcgcggcggcggccgcggtggaggtggaggtggagcgtgctgccccgtggccgcgtgcaggaggctgctcaggctctgcaaccacgggttcaagaagaggcgaggctgcggcggcgtcggcggcggcggcggtgtcggcgggggcggcgtcagggggctgaggtcggcgctgagcaaggcgctgtgcggcaaggccgtgaggagggtgctccgctgggacagccttggctgcttccccggcggcgtcgaccgcgagttccgccggctgcggcggtccaccggcgacagcggcgagtgcgacccccgcgccatggacttcagcggccacagcaacgacgagcggccgccggggaggtggaaggcgcccggcattggcatggacatggacgtcgacgagtcgtcgcggcagctcagcccggtctccgtcctcgacctgcactccgacgacggcgactctcctgtgcactgccgctgtaagttctctgacctctacagtgccctctgcactctgcactactacgctttaccattttaccaacccgtcagtacttttgattaggcattcaatgtgtcttaacatttcgatttaccccccatgtttattactcttaccaccttaatcaacattttcccctctctctctccagcaacaatggttaaaattaacctttactacaaatgctacttattaacatgttaactgcacatttaatgtgtcaccattgccattaacccgatgtttatcagtactccatcttaagattcatctttcccatcttaacactccatttctattatcacaggggaggatgcaaagccctcgacctcagggagctcgccaccatccgagggcttcatcggcgccacctcaccatgcttcacctacaacatccatggcaagatcatcccaatggaggtagaagaagacgaagaagaaggcgacgaggaggaggaggagatggccagagccggcaagtccatcgagcagcagatctcctcgtgggagaggatcgcagaggacatctccaacatcccgagaatggtggagatggacttctcccagtcgatacaacaatggggcgagctcaagctcgaggcagccatggagatcggcacgaggatagagaccctaatctttgatgagatcaggagagaaaccgtctgtgacatgcttgcttcacactgtacattggcagctgcaacatcttgttgaccacagaaaagagagagagagagagagatagtagtatgtggactgaggaggaggagaggggggtgtggttaaaaaaaatggaggatctgtataatttgagagggttcatgtggaattcatttttttccctaactccaaagtcttggtcccattgttgtcccgagctccatgtttttcattctgcaaatattatatatatatctttagatgatggcaaatattagtatatggattgaaaaaggacggatttttattctttcttaaaagagcagcagttaagaggcctaacaaacactaaaaatatatcaagagatgtgtagacttttacatgcctgaaaactctctgaacaagaacactacagatgagtgcttgtcttgacaaagaaagtggggcttgtctgtccatttactctcattgtaaattcaccaggaaacacgccattattccaggtaaacagaaggagacaaatctgtggtctcaaaagtcacaggaccaaagctttgcattgcatggacatatagacatatggtcatatagtataaaagcaaagcttagcctttttcattaagtgatcagtttttgtccatttcacaaaactaacaacctaaactgcacatttggaatctgaacactgcattgaaaacaggtgtggcttccaatggagactctgtctgtagggaaagccaagtcctctgctaaaggacagggcatcatgtataggataccctttgctgctactagttgatgtcttaattagtgggggtcaaagaagcagccaatgctgctggcactgacagtaccttctttgcatctccccatggcataatatactgctaattagctcttagattaaggagactggtactaggtgcacccttgtactgctgcttaactaaaggtttaagatgcaactgaaatgattccgcatttccactagggaggagctagagaattctctcacaagattagaccaaagaaagtagtagtaggccacaacgtgtggactagtgctcacaattacgccacactggaagaaaaaaacgtgacttaaaatatgatgaagagatcgtgcgtggttgctccaggtaaggagtacaatatgaagaatacaaacttaggagagttgagtggtatcagggttttgctttcactgaagtaatctgaaatcggccgatcgagcttgtctcttgttgatcaggaggaggttggtaggacagaaacctgagagagatcgatcatagccaaaacaaatcggcagttagaggggaagggggcaatgcaagagccgctccgatcgccgtcgccgtcgccatcgccgtgcacatgcacactgcactgctcggccctgcgaaaaattcagagaaccaaacagaaaaaaaaaaagaaaaatacgtttgcatctaccaccagtctctgtcttgtgccatgaatctctcagcagctatacgggcaagcgcaatgttagttgccgacttcggcaatgctgtgggccaagggattaaacggtattaaaccatcgcacccttcacattgtttatacgcgttggagaggaataaggtgggcccagctaaataaaaaaatcaccgatagtaaaattcccgtgactgctgcgtgactccttctcgcgagttatgtcagaaacattgtttatctcttgttcatcagtagtagctgtatgaccaggttttaactctttgctactctcacaatgctttctactaggtaggaagagagcatgtattgcttattaccggctaaaaagcgacaatgtggatgccgtacgagagtaaaatgcgtgtgcgtcgcggaggtagctgagcagagtgaggagaagcggagtggagtgtgaagtggggcccaggtggcagccagcgtggcgggggccatgtgggcacaataaatggcccggcggtgaggcagattgcgcggttgcgtcgcacaaggctgctactgaagtgatgccccacccaaccgccgctagtgtccgtcctcgtcctctctctctctctctctcctgtggctgtggggcccgtccgcccatgcactatgccttgtacgtccacggtacaattatgtggtctctacactcgtccggttctccggccccttcccttcccttgtggccgctttgtcactctttctccaaactccaagtggaatccatccagtggaacaatggaagggatcgagtttaactgctttgagtggtgatagggaaatcatacttaatactatactatgttgataaacagggaggatcgatagaaagagatcattttgattagacaaattttactacagcacatctaaagtttatagtcttcgctaaaagacaccgtaaaacgtgaaacaattggtagacacccctaaaaaattactctctccgtttcaggttataagacgttttgactttggtcaaagctaaactactttaaatttgactaagtttataaacaaatatattaatatttataataccaaataagtttcattacataaataattaaatatattttcataataaatttatcttgggttgaaaatgttttttttctacagacttagtcaaacttaaagcagtttgactttgaccaaagtcaaaacgtcttataacctgaaatggaaggagtagtaatagctatgggacaccgaggctattattattttttggtccaaataaaaagagaaacatttagaaaaaaaacaattttgcctctagggccatatgcttctaacctaactgggtctgattaaaaaatagggtttggagaggggatcagggatgaagattggcctaattcttgttgaaaccaaacccagtcgtcttacaagcatttggccccatcggtacatttgtcttttccacattgtttctctcttcatttgaaccaaatataataaaataatggtttcgttgtcccaccgctattaccattttttgggtgcccgccagtcgtgtcatgtttctgtgcgatgttattttagcaaataccacaaactaaagctgcgtttggaagtaagggttgggaaccctcactccccagcacgaaaaacggagcagcgattagcaagtgattaattaagtatttgctatttttttaaaaaaatggattaatatgattttttaagcaactttcgtatagaaactttttttaaaaaaatacaccgtttaacagtttaaaaagtgtgcgcgcggaaaacaagaggaggagttgggaacatgtccttgcgaactcagccgaagtgtcagtagtaaattttgcattatcctgcattaccacgaagtgtgactatacaggcctataaaaatggtgcattcttagtagagctaaaaaaaaaagaaaattgatttcacccacgtgagttgaattgttatcaagtttctaaaggtcactctataaataatggaggagactatacttaacaacagtaaattgattccgaacaaagcgggcatccattagctgaacaccggccaaaaagagaagcagtgcacccataattgaagagtatcccgcacgccccggataataatgtcttaggaccaaaatcataattgaataacaatgtccagagaggagaaaatctcgtatgtcttcttccctgggcatttaaacataagccaacaaaaatgtgtgtgtatatgcatagatcaaaatggtccaaatctatttgtgaaggatatgtaacggccaacggggccgttgcatgcaacagcagcatgtgctccaatagtttgcaacatgtaccagcagttattaggtttaggcaccgcctgttgccttgttgtcgtcgaacggtacagcgctagtacgtccacacattttgtagtttgtcaaggcaggattaaattaaaccactaaaattgcaaaggttaatatttttaatgtgaaatgctaagttaagagccctttgattggtagggaaaatacatgacatttataatcctttcaaataagtaaggatggggacctgaacactgctggagaaaccatctttgatcggtcgaccaaatttcataatagtcctggttgtattaaaaatcgggactaaaaatatctttagtcccggttttaaagctccaggggtact

SEQ ID NO: 81896 - DNA, 1218 bp, Oryza sativa
aactccactccagactcaactcctggagttatatttaggagttggagctgtaccaaacaggccctaagactttctagcatttcccacatacatatagatgttaatgaatctaaacacatacatatgtctagattcattagcatctaaatgaatgtagacaatgctagaaagtcttacattgtgaaacggaggaagtaataaaatgtatttcaacttccttcatgcaaacaattttgcacttctcaagtcccagctatatgatgagttgtggatgatgaacttagcgcatataaaatgcataagaacgatcagtaggatttggcttaatttgttgaatgtagacatgtactggatatatttccacctatgaactatatagccactgttgcaaatacaacactaattgaaactaatactgtgaaaaacaaacaattccccccctaaaaaaacaattgtgcacagccagagttaggttttcattttccatgttggaggttgtgaagtacttcctccgcttcataatataagactttctagcattgcccacgttcacatagatgtcaatgaatctagacacatgtaagtgtatagatccattaacatctatatgaatgtaaacagtgctagaaagtcttacattatgaaacggagggagtactttgtaggctttacttgcatgggctcttttgagtttcttatttaccttttatgttcattcaagcaccacaaggaagtgtcttgcattgaatggttggattctaagatggtttctaattgcctacattctaataaccttcttaagctctccttcccaatatgttcacatcagactgaatattatcttatctacttgtctctcctgctgtctgtgtgcacacgtgcgtgctcgtacatgcgaaagaaagaaaccaaaacttactgttgccttcttgccacaggggtgtagccttcggaacacagagtacattgtgggggttgttatattcacaggtcatgagacaaaagtatgaacatttcacttttccctgtatatttaacttgaattcatgatatctgctgttttgaagtttactggatgtggaacattgttacaggttatgatgaattccatgaatgttccctccaaaagaagtacattggaaaaaaagctagataaacttatccttgctctatttgcaaccctgttcacaatgtgtgttattggtgctattgggaggt

SEQ ID NO: 81897 - DNA, 5534 bp, Oryza sativa
  unsure (1)..(5534): unsure at all n locations
tggtttatatatatatatatatatatataggtatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtacccgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgaatcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccctgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctttgtttgcatggcgtccatgctctgtgatcctacctgccccgttgaggcgcagctgctacggtttcctgacgggctcaccattgcaggaggaatggtcggctggggatcatgggaccgatgtgcggccatgcgtttatcaaccttccttggcacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctattgccagttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacatgcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctgattcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatgtatatatatatacatgtatatatatatatatattgcatttcacgttaacgttcgtcctcgttcgttcgctcgttcacgttccctagctcgttcacgttcgttcgatcgttgtcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgacggcggcggcggcgtggcgttgtggggccgtggcggcggcggcgtggcgtgccgctggtggcgtggcgtggcgtggcgncgtcggcgtggcgtgacgacgacggcattgcgcgctcggcggcgaaggcgccggcggcgtggcgttggcatgcggcggcggcgttgcgcggcgtcgaaggcggcggcgtcgaaggcgacggagagagatcgagatcggagagatcgagatgcatgaagggagatgcggcggctctcaccccagagatgcggcggcagcggagtaggcggagccggcggcgaggacgacgagctcgagacgacggcgagatacggcggcgtcggcgcggggatttgccctaggcagtggcgggaaggagagaggccgagagagatcgatcggccgaaaacgttaagtgttggtgaataagacaagggcgcaccgggaatatatatacccctggatctttactcccggttgttctcaacaaccgggagtaaagatctctt

SEQ ID NO: 81898 - DNA, 6580 bp, Oryza sativa
tgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacagttaaagaaggaattgaaggaagaaatacttaaagaattaaaacaagaaatggatcagaaatttgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactctggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatcttgttaagttgcttctaaaaagatagataggtgaggcttacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtattttgtctgaagcataagtgtctgaagcataagtgtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaatggacatatctaggagtctctttagaagaatagcaagcagagatgataactgttctgataaacaaaaaggcaaatatgatgacatagatgagctgaaagatgttgcacaagtagataagcagctcgaaagatatcaacgagatactttaagggcaataaggcctcaacaagtatactgcatgggattttttgagaataagaatgggctttatagaatatctagagaagtagaattaagtgttctaacaaagccagtagaattaaaaatagtagctaaagaatttgaaaatagtttaagatattcaggatataagtatattcaccaaggtatgtacataatagatatcaaaggaatgacaagaaagaaattaggagctaaagtgctaataaccttattagataaaagatgggacacaataaacaaagcatctttaggctatctagaaggagatatgaatgaaaatatgttgataacccatatagcgcctgattcaatgatgcctgtaaatgaattcatatataaaatgagttttggtttccaaacaaaaggatactaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattacatctacaaattataaaaccagagacttcgcatgatttggatgcagaattatctgacagagatattttgcataacagaagacctattatatctgaattgatggaaaaattagaccatgaaagtgaaataaaatattatgaagataaattaagagatatagcagatgaatataataactctatgaaaagtgagtggcctaaaattagagacaaggaactttatttctatagagaactatccaggattaagaaacaaaaaaaagagaaaagcttggtcatagaaaccccgagaacccaggaaattaaaatagaacaaataaagtcagaagaaccaagagaagaaatccaaaagttagataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggaaggtttgcataatctagataatgcaatggaagctatggaagtagatttgggaataggaaaaaggaaaagatacggagagggttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaaaagtgatggggctatactaaatctagcagcacatgatcccatagactggccaaatatcattagtatttggaaggggttaatagttcaaaaatacatacaaaatcagcataatatagggaataaggtgggggatatgataacttatttagaaacatttttgggtgaatctgctaaagtcctatgggaacaatgggttgaaaagaatcctaataactatgaagagctaaaaagagcaggaagtaatcctcacaactttgcaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattttgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcacctttcttacataaacgaaatgtaagaagatataacccaaagaaaacttatgataagacatgcagatgtttcatatgtaattcaccagatcatttaagtagaacttgcccaaataaagatcaaaaaagatattctagtaaatatgaagaacaagagagagttttaattatagatagcgtaaatgaaaatatattagtatgtgatgatgaaataaaagatgacgaatcaatatattctatcatagaaacagatgaaattgaaaacaccaatgaagagtatgaatcaaccgatgaagagttagatttaattgacgaactagccggtttaaaaatagaattgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtggaactagagaatctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaactgcctttcaaagaaattttgggaataagaataccggtaaaagtaaaactatcacccaaggtatcatataaaattctagcactagtagacactgggtgtacaaaaaatattattcatgataagtacttcataaaatgtccagaaatagttcatacaattgatgataataaggcagaagtctctacagacatgtccggaataaagaaaattcataatcagctagctcataatgttgaagtatacattaatggaactaaatatataatagatgagattacaataagaaacttatccatgataagtgatgacatgataattggcctaaggtttttacaacaatcggtacaaaccacagtaatacatgagcaaggaattacttttatcccatatcaaaacaatgtaagcggcgggtatcaactagtattcctaatgaaacacgaccaatcgttgcacggcctaaccgctcgtctcaccttgaaccgctagatcgagggtgccttgtagtggctagtgcgcggctcagataagtcatcctcaacggcgatagtgacatagatcgactttggcccggtgtatatagatggcggtgaaaattgggatgctacaaccatgacggcggtaaccagaattgcactacatgtcgcggcggttccggtggtgatgcattatatggtggtgggcagaaaccactgagaaggccgagctcgactaagagcaggtacaataacagactattagccagctacaaacatattttaatgagataaaaatgatagagaataacagcgggttacagatctgtagccagttgtaatacggactctaatacgtaatgtgtatatgacaggtgtgaccatataccaatagtatagtaagtaattattgtataaaatagctattagattggctatagctgaattggagctaatagttaactatactattaaacttgctctaacattgatggcgccagtggcggtggcaagcagcatgtcaaagcatatgtacgcttgatacgatcgagattcgagaggtgactgagagctcgagccaagagaccgcgagcctgtgcccgaaaaaaaagaaaaagaaggtgatctcaaagggccaaagaaagaaagaaaaaagaaaacgtgatctcaaagggccatattctttttccattggattgggccgaaatacagtttatccaatcactcttttgagcccaaggtcagaaaattcttaaggtcatgtatttctaaccccggtttggggccaattacattacagtccttccaatctggctctttccttctatccgaattttttcgtttttagattttttttaatatttacagaaataatctatcgaccaaaaaaattacagaaatagcccctgccgccctaatggtgggcggcaagctgacgtggcagacggtgggtcgaccgcgccgtctgccaccgtcggcaaaaattgcgattaggcccttgccacccatacagagggctgcaaggggctaattgcaattttggccgcccataaagagcttgcggccgtacttttt

SEQ ID NO: 81899 - DNA, 16601 bp, Oryza sativa
  unsure (1)..(16601): unsure at all n locations
ttttgaataagacgaacggtcaaacatttgctaaaaagtcaatggcgtcaaatatttcgaaacggatggagtatttttttttgcctatcatttacatccaattgaatatatgtaagcttttaggacccctttaaaatacaggattgagaaaacacaggaatagaacaaaacataggaatagaatgtcatgattattggattcctatgggattttcaaacacgggaaagtcttcaaaccatcgtttgattaacatacaggaaaaatactggaattttagacacacgtagagaaaatcatgaggtgagacctcatgttattttcctctaaaattgttctagcaaggttaattccatagtaattttaaagggattagtaggaaataatccttagattcaaaagactctataggataaaattctatagaattcctatagtttttcctttgtttcaaaggggctcttaaaattgagaacttgacctttcaaacaacccaatgtaaaatttactttcataaaaatttaaacttaaaatttcaaaatgctactcaggtgacggcaactattacgctacctactctttcgctgcaactgcacgcctgcctcgagacctccttctctccctctcctccggcgcggtggccggccgggcggcgctttgacccacactgcccggccacggcgaggcgtagatgctacgtaggagcaggagtagggtaggagctagctgggccggccatggcgctccttttgcagcagctgggagcagtgcatcgagacccggagacccacgagagctacggtatctgtgtctgtgtgtgtgttttttaacgtacgtgcgcgtagcacaaggctgccgagtaatacccagatgagaagaccatgatgccatctctctctctcacacagagtagggtgcgttcgtttccggtgctttggaactcattccctccataccgaaaacaagcggttcattatcacgtaattaattaagttttagtgtttttttaaaaaatagatcaatatgattttttaatcaactttcgtatagattgttttttttaaaaaaaacacatcgtttaacaatttaaaaagcgtgcgcgtaaaaaacgagaggggagagttgggaacaccctcttgcgaacagagccaagagcaggtaaactagcagcctataaatcagctttaaaagtatatcgagatgataaaaaaagagagagaagcatgtggctacagatttatagccaactgtagtacggactttaagacacaatgtgtgtatgacagatgtgaccagatattaatagtgtagtttttatttataggtaactattatatgaattgactattaaattgactatagataatttagagttagtagttggctatactattaaacttgctccgagtttaacactccctccgtcccattttaagtatagttgtgggtttctatgtaatgttgatcgtccaccttatttaaatatatttatgattaatatttttattatgacatatgataaaacataaatagtattttatgtgtgactttaaaaaaaacaaatcataaatatttaaataagatggacggtcaaacgttagacatgaaaacccacgactgtacttaaaataagatgaaaggagtatatagtagcgtagctataagccaactgtaaaattatgtggagaagaaggaatttaaaaattgaaaaagggttagagtaaggataatagcaagcataagtcaaaaattgaaaagggttagagtaaggataatagtgagtataagtcaactatacttatgtggaggagagagttaaaaaaataaatgagagttcacttaacacgtgctcctggataaatacactaaatacataagtgagaaaaggagagaggagaagaaaaattgaaggctctattatttaacttgtacttggctttgatggaagagctgactattcacatacttcaacatgaatatattaaatgtataggcgagagatatagagaggagaagaaaaatagagataactttataacttatctactatacatgttaactctattattatttccgttctaaaatataacaactagtattatctatgaacgtggacacacatttatctaatatgagctatttaaagatggagtgaggccgtgtttagttgttttggcaaaaaaaaattgacatatacggacacacatttgaagtattaaacatagactaataacaaaacaaattacagattccgcttgtgaactgcaagacgaatctattaagtctaattaatccgtcattagcaaatgtttactatatcaccacattggcaaatcatggtgtaattaggcttaaaagattcgtctcgcaatttacatgcaaactgtgtaattgatttttttatcacatttaatgctttatacatatatccagacatttgatgtgatgtttttagttaaatttttttttatctaaaccaggcctgagaatgaaacaggaggttcgatttttacccgggtcaagtggcgaagaattccaggtagtacaggtagtactgctttttactgcggtgaaaggagcaaagcttctgcgtctgcttggcgttggtctacgtctaacgtgagcgtgcgtgcgcctgttggtcgtcgtccgaatggcctggtctccaacctcctttttcgttcaacgcctttgttggtcccccggcccctctcttcctcttcttcatcgatcaccaccttttcttttttctttcttcccctaaagattatatttgcgcgcagctgatgcagtgcactgcagcagggagagcagctgtggcactggcagtggctggctgctgctctttggtttgggtttgcctgcctagacgaacctctgcaccgtcgtggtccacctctgtcttgttaagtactcccttgattctcatacggctcgtttggttggagggagtttttaggagagattgggaatttaaagggatgatgttattaagggcctctttgaatcaaagaatttatgtaggattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttcccgagtactcttgtctccctccagtctaccaagatacatggaattcattgcctacaggagatgaggcagcccaggctgtagaactaatggagcgcatgataaagctgaaagagcaaggtttgcagggagaacagatcacttggcacttcataaaaagccgattagctccaatcaaagagaggtcccgcacagcttttgagtttgacggcaaacatgatccaaatcgtgaagatccagactctcttaactttaagattatgaaggaaaggatgtacaagatcttctcgaatgctatcgtcgtcagctattcgcacttgctgctagtcatgccattcaatgctttcaatcctcctccaccgatatgtaatcaaacatttcaacttttcacagaatatagtcttgtctttttgttgaatcaattaacaatgaatgatattacgaccaggaatttgctttgatgaaatcggaccccccagtcgtccaatgccgatcaccccaccgccaaaccggtcaagggagcggggtcccaagacccgttctgaagcccggccaaatacttccaatccagccagatttacgcaaaaggaagttggtgtcaagtgatgacgaaagcgatactgctagaaagcctggagaccgagaggcaaccagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattcccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatattcgtgaaaccttccttgtcatatcgattaaccgaagagcatttcagtgcaagccgccaggatttccgacctagagaggcaggtcgaagctctggagaaggacaaggccgaactagcaaagcagagggacttggccttaaaagatgttgaaggtaatgataactagttccccatgctcttatagccacctgttgatacaaatttattcgtgcaaatcgcaaaatcaagtcccaggcacagtttgatgtcttaatcaataagatcaataggcttgaaggggccagggataaagtcgctaatgccgctaccctactcatccaagccatgttcttcaataacgccggttcgagtacacttgacgcttccgagatcttcgacaagctgagagtcgctccggatacttacttcaagaatattagggaggttggatgtatgggagcaagcatggcgttagctatgaccaaatctttataccccaaaatcgatattgacgccgttgatgggtttgcagacgggacaagcgaagaaacagccctcaacctcatcaatgatgcgcaaaaagccgctgacaagattgctgctgacatagttgagagattccaggatggcgaccttcggccgactgggtctgataattccgacgatgaaaaaactgacactgattgatgttatattgtaattgtgattctgatgatgatgatgacgatgatggaggtacaatttgtacaatactgataaatttatgctgtgcatgatatttcaaacttagctcctgatttcttaaaagtttttgtcaaaccttgttgagcctaaaactcgcaaaagttgttaaaaaactttcagtcctcattgactaagccaaaaaatcaaacagagcaatgataaatcaagtaagcgaattgaattgataaagatcacactccattatcatagtagcccccgactgacaactcaagaaaaggcttgatgttagcagtcgaagaggaaaatacagaagtgatgcctaagcataaaaacaacgaaggtgttcaatattccaagaattgttgacaagagtaccatcttcacgcttgagtcggtaagaacctggccgagtgactttagcgattatgaatggtccttcccataagggagataacttgtgccgatcctatgtagtttgaattctcctcagaaccaggtcgccaactaaaaaggctcgcgatcgaacattccgattatgataacggcgtaacccttgtaaataccgagctgactggattagggctgcttcacgggcttcttccagtcggttgatgtcatccactcgatcctcttcatggcgctcttcccggaagttacgaaatcggagggattcaaactctacctcactcggcagcattgcttctgcgccataaaccaagaagaacggcgactggccagtagcccgactgggggtggtgcgtaaagaccaaagtacagacggcagctgttctacccacttgcagcatagggacgcagtcggtcgaaaactcgtgctttgatcccttgaagtaccatgccattggcgcgttcgacttgcccgttactcatggggtgtgccacagaggcgtaacaaattttaatgccaaagtcttcacaaaaatctttaaatattccgcccgtaaattgagtgccgttatccgtaatgatacgattcggtactccaaaccgatgtacaatattgatgaagaaatctctagctttgtctgcggtgatggtgacgaccggtttggttttaatccacttggaaaacttttccacagctacaaagagatgagtataacccccgactgcctttttgaatggaccgaccatatcaagcccccaaaccacgaacggccaagacaacgggatggtttgtaactcctgagctggtaagtgagtttgtcgggcaaagaattgacaaccttcacatgttcgcacaattttgtcggcgtcggaaacagctgtgggccagaaaaaaccctgccgataagccttgccaacaatggttcgtgcagcagcgtgattaccgcagatgcctgaatgaatgtcttttagcaattgtcttccctcttccaaagatacacagcgttgcaggattcctgatggacttttcttgtacaactcggtctcatgaatgacatagagtctgctgcgcctggagatctgcttggcttcatttttgtcttgagggagttcttgtttggttagaaattttatgagaggttctctccagtcggcttcaatcatgcttacgccttgagtatccatggcttcaattgtttcttttctgggcacggttggttctaaagatgttcgacgaacacatctgaaggagccgcttcctgttttgaaccaaaattggccagcctgtctgctgcctcattattatgtcggaggacatgggtgagcttgagtccgtcgaatttatcttccaacttgcgtacctcttgtcgataagcggtcatattgtcatctagacaggaccattctttcatgacttgattaacgaccaactgagaatctcctcggacgattagtcggcgaatgcctaaagagacggcaatccttaatccatggagcaacgcctcgtattccaccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgttttcttgacactcggtccactcggcgaggaagtcagctaaagcttatgacttgatcgaagttcgtggcttgaaagatatgtccaaagatgtcaattctaaggcccacttcgctatccgtccgtttgctttgtggttatgaagtatatccccgagtggaaacaatgtgaccaccggaccgagtgaccttgaaaatagtgngnnaggggctaacggtaattaagacgccatataataaattttgaacctgaggatatctcgtcttggagtcggccaaaacctcgctaacgaagtatattggtcattggactttttgaacatggccttcctcttcacgtttgacaaccaggaccgtgctcacaaccttagaggtcgccgacacgtataacagcagcggctcttgtggatgtggcgaggccaaaactggtgtagtgagaaattttttgaagtcttcaaaggctttttgtgcttcgggtccccactggaaattgtcagttttcttcagcaacttgaagaagggcatcccccgttcaccgagtcgcgaaacgaaccggctgagcgccgccatgcaatcagtcagcttttggacatctttttgtgagcttggcggtttcatgttgagcatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgcgatcaggtcatacttctgcttggtcttgacgactacatcatcaacataagcttcaacaatgcgaccgatctgagttgaaaaacatctttgaatcatgcgttgataggttgctcatgcgttcttcaatccaaaggacatggtgatgtagcagtaggacccaaagggcgttataaacgaggtcttcaagtagtcggattctttcagtcggatctgatgatatcccgaatagcagtccaagaaactgagtagctcgtagccggccattgagtcaaccacctggtcaatgcgaggtaacccgaaaggatctttagggcaagacttgttgaggtcggtgtaatcgacacacatgcgccattgcccagtcttcttccgaaccagaactgggttagccagccagtcgggatggaggacttctttaatgaagcctgctgctaacagtttggctaattcctctttgatcgcatccttcctatcttgtgcaaagcggcggagtcgttgtttgatgggtttggcgtcttccttgacatgtaaagagtgctcaatcacctctctgggaataccaggcatatcggatggtttccacgcaaaaatatctttattattctgaagaaaggtgatgagagcgctttcctatttacaatctaactcagcgcctattacagcagttttggtaggatcggagggatctagtggaatcttcttagttttgtcgtcgccttcttcggtctttgacagcttggtcgtaggcacctctccttcgcttgccgtagtggcagccaatcggatctcttcgcgagcgagagtgatctcgtgggtttgggctatttcgcaactttctttgtcacatgtgacggcttgcttgatgtcgctccgtagtgatatgactcctcgaggaccaggcatcttcatcatcatgtaggtgtaatgtgggacggccatgaatttggctagagccggtcgtccaagtatagcatggtacgttgtctcgaaatcggcaacttcaaaacaaacgttttctgtgcgaaagttttcccgagtgccgaaggtaaccggaagagtgatctggccgagtggtgtagcggataatcctaggatgacaccatggaagggtgcattactcggctttaattccgttcgaggaatctgcatatcgtccagagtcttggcgaaaaggatgttgagtgcactgctaccatcgatgagggttctttggagcttgacgttacgaaccactgggtatagtaccagggggtaccgccccgggtggaccactcggtcgggatgatccgagcggtcgaacttaattgctatctctgaccaccgaaggtattggggcgtgttaggctgaaccgcattgatctcccgttctgttagcttctgctttctcttagattcataagccaggggtccgccaaagatgtgaattagttctttgcgatgatcttgaaaaccaagtgggacatcgtcttcaccatctttcttctttgatgtgccttggtctccgtctgagggcttacgtgcgttcttgacgtattgctctacaaactgtttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtaannnangtttgtgtccgaacttgccgactaggtcctcgtggcgaatgcctttagtaaaggcggcaatgatgacgtcatcggntgatgtcggagatcttgttgcgttgctcagagaagcgtcgaatgtaatctcgaagagattctccagacttctgaatgatgttgtagagatcgaagtgtgtaccagcccgttcaaaagtgcctgagaagttggcgattaagtggtcgtgtagctctgcccatgatccgatcgtgccgcggggtagcccgtgaagccatgaccgggcagtatccgctagggccacaggtagataattcgccatggcttgctgtctcctcctgctacgcggattgcgagaccatagacggtgagccaagactcagggttggtggtgccgtcatatttctcgattccggtcgacttaaagccagctggccaatccactcgacgcagatcgcttgtgaaggcagcaactccgtccacatcgtcgtcgtagcgatccggtgaatgatggcctcttgctgcgcggtgctggttgatggtgtcacgaagatcgatggggcgccttcgatgtggggagtgtggtcgttcaactcgacgctccctgtatcgttcgggaggcgaacgaacagaccgttcatcatgtcccctgctcctgcgactagatctggcgccgtcaatgctgaggcttggctggtgatagtcctgagatcgaaggtgagggactcggctaccagtcggggtgcgggcgcttgcggagttggctggaaacgaagcaacgatcatggtcttcgtttgattcaagatgtttacaacatgatcagcttgattgagtacgtcttccttgaggagggtgtcgaggagagtgattgctgcaaccgcgttctgctgggggtgcgaaaaaccgctgttccatcgacgtcttgttgcccaatgagctctctcgctcgtcgcccaaattccaaggcgcgctgccgtcgatcttcaccctcctttgcaatccgttcgcgatcttgttgctcacgctgtagtcgttctcgctcctgttgctgtcgctcttcctccagttggcgacgttcagtttcttgccatgcgcgctcttggtccacttctcgggctcggcgttgttcctccgtttcgttgtcagccacgaatacgccgaagaagagaggcgtgtagttatcctcatagctgtcgtcgaagttgtcgaagtcgtcgtggtcgtagtggtagccgaagtcgtcgtagtcgaggatctcggttggtcgagaactgacaccgggggagctaaggtagccatccaactcttccgtcgagactgtcccaaggggttggagtataacgccaacctccctggatctagatcggatcggggccgaagccggagctcgcctagatcttcgagcaggagatgtcttggctgtgaagacagcggccaaatcatcaggaagttttatcaggattgagggataggacccgtcatcttgatctggtcgcggaggagtagattagatctcgtccgagtggtttgaagccgactcgggagagatgatcttggagtaggcctcggccgagttcggaataccgaacggcgcggggacctgatctctccccgactagttcgaatccgagttaggagagagatcttgccgaagtcgttggtgatgaagttgaggctgccgaaccggaacgcctgtccgggagggaaggcgaagtcgtcgatgccagaaacggaacccatcgcacttagccggtaaaaacttgacgctacccctacctggcgcgccaactgtcgaaacaagatttcggcaatactaaaagggggtggctatcaagctaggaaagtggatgggtttggagacgaagaattttatacaggttcaggccttcttattcaagaagtaataccctactcctgtccggggatgattccgccgagtgtattattgattgtataatctaggtcaaaaaaccgtgccccgataagcatccggacccctccttatataggggaaggggtccgctttacaaaatacagtccatatcctaaaagaacatggaattacagataaaatataatcgtaaccgactaggatctcgggtatttccttgacatacaagtttagaatctaacccgagtcctcatgaagatattctgtctttattcggtatcctgtacccagctagaatatgaccgccatgtagatatagggtatccataatctccacatgtttatttaggagacatgagaattttggtgggatggggatggggatgtggaattgaggaaggaactccctccttttcaatacctgggtaggggcaggtgattgggagggaattcctcctttactttgtctatgcaaatctcaactatccatttttattaatgacataatctccaactaaactccctatcagtttccatcactccaaccaaacaagatactgggattaaaaatcaaattcccatcttaatctcatcataaattcccttgtgtaaactctcaatccccttccctcgagttaccaaacaagccgataagacttagaattattttatattttgatttttcaaagtaaatgggtcataccttgtagttttcatgtatatatctgaaatttaaatgatttaccggaacccaaatacacattcaatactcatcgattgcattatatacacttacaccttcatcggttggcttatgttgttgcgtttcagcataagcagactgatgtttatcggtataagcgtttccatcgtttggcttataaagagtaatggctgattagtggatcttctgtggcatggtgatcgttgagaggtagggttcgagagaggggagtggggaatcgaggttggtctcctagcgatgtggccgtagaaaggtgtcgggaaggattgtcccactaccaatggctgatgcataatcagcccaataagctaaccgatggacttttgctgaaaatctgcctctgcaacattgaaccgatgagagtgttctttgatctttgttacattacatgtagttttggtcatggtgataaaagtaatatatctaactcttttggatggatagaatatattactaaattttcatgcgtgtgtgctataattgggatcaaaatgcttataaacgaccagaaacaatattgtttctatgaaaaattagaggatataaattctatgtatatagctaggattcaaatctggcgataatggtaccacttttacagaaaccaatctgaaaattccgtcaccattttcatctcctaggttgctagccagctgcttatggttgatggaccagatgtatagttactgagctctaaattggctatagtattgtattatcctttttaatggtaaatagtctgaaggctgagattttcttttggctgtggtttataggccataatatgtgaccaaagcaatgaaaaataattctacaataggatttttatgcttatactttcagcggtttaaaagtcagggatgaaaagtgaaaaacgatgggaaaaacatcaagagtaatataaaatcgactttgaaaattcaaattagactatgattctcatgtatccatatgcacatttgtggtacccgaattcgaatttcgctgctctaataatggaagattggttcaggatttgatgggtttataagtcatttctattaaaaaaaaacaaggtcgcaagatacggtcttaatatgttggaccttagcaatttaaattcgtactattcgtgaaggtttctttaaataatgtccaaatttggtagaaatttattcaaaaattaatcttgtgaaattttcccttaaatacccaatcgagtctccctctccaaacgacttaaacttgcttcacacactttttcccaattttatatatcatcttaaccttgctgccatattctttactggttaacggataaatggatgaataggcatgttctccgaactaattaa

SEQ ID NO: 81900 - DNA, 583 bp, Oryza sativa
atcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaaatccttgggcatgaacgcggttataccgggaagacaggaactcaagtactacaatactctctcctagttctaaaacagacaagctatcgtatgcacaaagtacaataaaggacaaccaatgacacttaaaaagtaaaaaactagcataagagcacttactgctcaaaatccagacatgcaaagagtgaagccattataatataatatataatgttcatcatatggtctatttcaaccatatgaatgatcaatttgagatcaatgctttcagaaaaaatgcatatggacagtaaatgacctacctacagaggtaactagtttaccaaaattttcttagacaagcataaatcatgccttattgctcttccccatgttcttcttttgtttcttcaagtagtgcccaaaaccaccatgaat

SEQ ID NO: 81901 - DNA, 3437 bp, Oryza sativa
accctaaataagaatagtcaactaaataagaattgtggcagcaaatagacaaacccatatattttctaaacaatggattaaaatttcggcctacatcgacaaggacgaaaacagccaaagacaaaccctctttcgaacaaaagaaagaaatcaaactggacaagatcaaattaatcgatgcatggttgcgcaaagcggcatcatatcaaccgatgttgacaatggccgccttgttcatcacccagccctcgagctcccgtgccagctcgtcctggatccacaagggccccatggcgagctcgcacccgagctcaccgatcgccgccgcgctccggagcaggtacatggccagcgtcctctgcgccgcgccgccctggtagtgcaccaggttgatctccctcacccgcctcctcaggcaggccggcgccatggcgccgccgccgctcgtcggcgcggctaggacgctgtgccggttgtagctgaggaggtgcttgtcgtagagctcctcctctttgtagtacgtgatatgcagcatggcgtcgtcgccgccgtcgagaggctccgggtggaagacgagcgacagcgtctccaggttcggggcgcgctcgaggatcatggtcagcgcggcgtagatggcgtcgtcgtcgtcgttggggaggtatcctcttagctcgaggtgggagagggctgaaaggtcgggagcgtcgcgaacgcggcggcgtcgtcgaggccggagccgaggcgggcggactcgaggtggaggtgcttcgcgccggcgaacaggcggaggaacgcgctgagcttggcgagctccgacgacgacgtgacctcctcgccgcagatgtctatcttgcagtaggcgacggtcgtcagcgaagcgccgccgtggatggtgaggaaggtgtcgtccggcacggagcccctgtactcgaacgcttggaggcgcggcggccccggcgaggcgtcgacggcgacggtgcgcagggcgtggcagcagcggagggccagcctgcggaggccggcgacggtggtgagcgcggtcaccgtggcgcaggcctcgagcgtcaggtcggcgaggcgcgggcagccggagatgaggcgctgcacgtcgctcccggcgtcggagacgcgggcgaggagcagcgtctcgagggacggcagggcgatggccgccggcggcgcgagcaggcagtggccgagcgacagcgagcgcagcgccgcgcaggagaagagcccgctcgggacggcgtgcaccgccggggtgtagtcgtatcccctcgtggacttctcgtcggaggagatgacgtcttcgtcgtcgtcgtcgtcgtcatcctcatcacagccctgcggactacagctccgacgcggcggcggcggcgacagcaacggcgagcgcgggatatacatatacggtggactcagacccagattggcatcttcgatggacgcatatcgcacgggggacctcgacctcgaccgccaccgccgccgccgtttgcggctcgcatcttcgtcgtcgtcgtcatcgtcggtgtcctggtctgcgtgatccgcgctcgcgccgcggcggcggcggagagagtaggccttgtcgcagagcggctcgcggtggaggcggaggtcgaggtcgaggccaacggcggggtcggcctggttgacggcgtacgcgatccactgatccaccagggaggcgtcacttctgcagtacccgacggtggagacgtggagggcgcgcaggggcgggacggcggcgcggcggtggcgggcgaggagggcggcgctgacgacgttggtgaagggcggcggctggttggggtcgggcggcgggccccacccggggctgtacctggcgagctcgtagtggtcgacgacgggggggtcgggctccacgagggagacggtgtggacggcggcgaacgtgtggcgccaccgcgacgagagcaccgccgcgcgcgccgcctccttcgccgggaggaacgacaggatgtggccgatcacgccgtcgctcagcgcgctcagccggtcgccgccgccgccggaggtgggcatcgtctggggttggtccagatccatcttgacgcggacggtttcgtttgatggcgagatatttcaggatttttcgggggatgaaccgagacggtttgttgttaggtcaaagaaaaaaaagaaaaagagggacatatactcggattcggagtgtgctccacgatttaaaaaagaaagaccaacaccaggtgaaatcgcagtaacagaatccgagacacgaacacgatgaacgccaccgttgcatcaccgtcggagccagccgccaccgtcaccgtcgcatcgctggacgagctccgcgaggtggccgagcatgatccccgcgcgtcggaggaggacgggggcctgcgcgtggcggtcaccggcgtccccgtcagccaggcggaggagctgcacgcgctcgtccgcgaccatgtcgaggcgaagctctggagcgtcgtcggcgaggtcgccgccatggcggcgctcaggtccgcggccgacggcgccgcccgcctcgtggggctgagccgcgcgctggacgccgtcgcggccggacacggaggacggagccccggcgccggccacggtgccccgcgtcacgctgctgagggagcaattgttgccattgacctcctcccatcggcgtcaatccactatcgcgcgaagccacgtcatcagcctccctcactcattctcctctatcgccaacgtgcacatgcagatctcaattgaacgtcttccttaccagcagccgtaattggaaaaaaaaatagaactgacacgtgggtcctacgtttataggtattttggtctatatgatgacgaaaaatataacgatgataatatgatttgtagatattcggatgacaagtgtacaaatagatgaattgtagtaacatttatctgaatcagcatatttgcaataacatggatccaattaaacaaaaattgggttacacattacgttacgatgaattggagtaatatctggcttcccaacttgagacctcgaggatgtggataacaatgggaggatcctcgaacgggatagtcatccccaacagggcagcgatccgtgccctcgtcttctccgccgtccgccggaagtaggccatcgagtactccagcgactccggcgacgtccatctgtcgccggagtaccgatagtagctcagcgcctccgcctgcctccctatgtccaccgcctcgacgacagcaacgacgtacttgcgcgggaggaacggcggcggccgttgggtggacacgtcgcgggccagctccgtcagcagcgtgatgcggggccccgtggccggcaccgggacgccgtcctccgtgtccctcacgacggcgtccagcgcgcggctcagcttccacgaagcggtcggcgccgtcagcagcggacctgagcgccg

SEQ ID NO: 81902 - DNA, 2180 bp, Oryza sativa
  unsure (1)..(2180): unsure at all n locations
cccccatccccctgtacgtcctctcccctttttctcttcctactacaccataaattttaaaataataaaaaaacaaatttagaaaattttatatataaaaatactatatataaaaaatatttgaattcaaatttaaatttgaatcgtatataaactttttacttataaactttgggtctataaactttaggtgtatagaaatactatatataaaaaaatgaattcaaattcaaattcaaacttgaatcgggtatataaacttttaacttataaactttgggtctataaactttaggtgtataaactttagatgtatagaaatactatatataaaaaatatttgaattcaaatttaaatttgaatccaaatttaaatttgaatcggatatataaacttttgacttataaactttgggtatgtaatatttaagtgtataaactttagatgtgtaaattttaggtgtataaactttaagtgcataaattttctaaaatagaaaagtaatgtggtgtaaaaaaaggaaagtggagagagggggggattgatcgtccggagcgatttatcgcttgttaggattctcgctatattactactcgtattaaagatttgggaatggtttatggttccaactcccaagtcgttcgtgcatcattcgattccgacatcctcgatattttcaataaatgggattcttctgatgttcttttctttaagaagagtactgctgcataaaatttaattatacagaagagtatgggaagaaatccagtttcataacaaaaaaattatgttaagagccctatgaccataagttccgccacctacccatgcataatttataaataatcaaatcaaggcaatgaaaattttaaaaacaacatcaattctgatactatcaacaaactgatggaagggataagttttaaaagaatacattctagagcaaaattagttgagtttttttttctctcaaccaacatttccttcagtcgataagattgattttttttcaaactcttcagctgaagacagctattttcatgcatgtgtccagaaaaaaaaaagaagttccttgtgtgatttaattgggaagaaaattggtctaacaagagaaaagaaaaaaaagtcgctttaccggtgccattacggccctttttgggtacctcatgatagtggcaatattcaatttggttcagagaacttaatttcaagttaatgaactggatgcctctgtttgtcatcttgcatctgcaggattagaaagatagtctattcggcacagtctaattctaggtcttgatattttcaacactcacgaaaacaacttatatatacagttgatttttttttccaaataatgaaaatgatacattcaattgatatggaccgtatttcatcaccatgaaaagaaactgaattttgaccacaccatctagacttgaagaactttggcgcgcatatggttgcagcattgtttgaagcagagaagatgacatttttttggaagaaacatcaatttccagtcaattgtagatgcgaaaattgtctcgagaagagaaaaaaaaccaaaccttaatggaatcgctagtataaacatcgtcctccaaaaaaaaaaaatttttatactacttctaaaaaagtagtggtggtgngagtcntgccannaccaccaccaccattgacatgtggaccatagtatcgatataacttgtgagtgctcagtcagctttatcatgtgctggtatggagtcattagctgctcttgctacaatacagtttttttaattttcttgccatcatgatttaaaaaacttacaaactttttaggtttttattgcagtttaaaatgagatagacaacacaatttattgacaagtacatattttataataatatgaaaatgggatatcgttaacacatatatacaatcatcgatttgtacaaaaaatctagcaatggcatttttctttttgctttttcagacaaaaagtattgtttgcatcaagtagaagctaatattttttttcaacaaggacgtatgcgatattctttttctattttgaataatccgttgcaacacacaagtttttggctagtaaaaggaatagacagaaatagggaagcatcatcggcgtgacagtacgtagaatatgagtaagctctcgtctcaatcgtgaga

SEQ ID NO: 81903 - DNA, 2404 bp, Oryza sativa
gtttaaaaaagtcaacgacgctaaacatttagggaataagggagtatatgaatgtgggtagtgctagatcttataacctgaaacggtggaagtagtacagctctatcggtctatttgcccggaagcatcatgattcgatcgttgattgacatgatgttaataaaacggaagatcgaggttggttcgatcgatgcctcgatgggatgagcaggcaggtcccagcggccacgtgctcgcacgcacgtcatggtactaactgtacgctaatttggtatccaaatcatcaacagcgtcatggaccagtgatgcaggcagcttcatggctgcagcctgcaggcagatcatcaccactgatctatccaaccgagtgggcctaaggctgtgtttagatctaaagtttggatccaaacttcagtctttttccatcacatcaacctgttatacacacacaacttttcagtcatatcatctccaattacaatcaaaatccaaactttgcgctgaactaaacacagcctaaataaatctcttgatccatccgcatgaagatttttctagataataaaacaagaaaaagactatgcgcactaactttttcttactgaattcttaactgatgtcgtaataaaatccgcctttttctttcaagaacttacatgaccgatgtttgaaactaattaagataaaagattaagtaagtgtacgaaaaaataagaaagatattagcgtatgattaattaagttttaattattacaaatttaaaaaatatatttatttaatattttagagcgacttctatatacaaagtttctacacaatatgtattatttagcagtttcaagaacgtgttaatgaaaatcgaggtagaaatctacatctatttctattggttaacaaatagaaatataaatccaggaatcgaggatgcaaagactaataactccaacactttcaaattttttctattatttatcttaagtctatttgtaaatctaaatcccatatcggcatatatccgtatatatgttaatgaacccatcaccaatatatataagcatgatctcatgggcgcggtgccgatgcatgcatattccacaattcgatcatggttccatgcagcatatatatcattgatgccatttcattattgagtggatccatcgtcgatccatccatgatacatacgatgatgagaagttattagcagttaattctcatcatctcgtgatgccggtgcatggccagccaacgcataatgcaaatccccatccatcgatccatccatcaattgtgtccagccagctgggtcgtctctcaatcaccggacaactgctcatgggatcatcttatggctggaaaacaataagatcccccaacaaaaaccaaacaaaaaagaggaagaaaaactaatggctccggtgagtcggcaatgcacatcgatctcgtccagtctcacgagacaatgttcgatcaggtgtgagaatgacgagccagcgacagacagatcaaactagggatacatagttcccggagtagtagcctgccattctatcccgaatttgatcggtgagcatggatgcaagtttgatcgagacagtgtgaagttaagaatctaagttaattacagaaggaaagaaatgaccagtcggcaaatgatttttgcaacttgaataagtaaaatttgaccttatattcttgcgaaggtgatatatttcatattaatctatcttattattttatcaaaaaaatttaataactatttaaatttcatgtatgaaacgagagatgctttctcgagcaacaaaataattaatctctcccacatatatgtatcaatggggcatcgactaccgacatgaaccggtgctttaattttttttaattcctgcttgcagtgcacttttgcatgcgccgggatgcactgtttggattggttatttcagattaggcgtagagacacgagggaactagctggtttgatggcaacagcacagagaagaggggaggagatggatggcatatgcatgaaaactgctaccaaaatatattatggccaataatccacaagatcgaagctagctagcttccatgtgggatcaggacatgcatccaaagttcaggtaaaaaaatacggaattgccatatttcgttcaacggcagaaattcttggaaaaaatctatcaaattgatcacagacctaacgaaaagtgaagtttacgccatcaggtgtaaaaatcacgatggcgtaaacaaaaaaaccttcccctgcccttatcttaaccttcctttacccactagaaaacttcgaaaggtggccacggtccattgcagccatggaagcggtgatccacgggcggaccttgggaagggcttctacacggacacggtggcagcatgcgggct

SEQ ID NO: 81904 - DNA, 776 bp, Oryza sativa
ccccatgcgcacgatatgttcggtatcttcggtgaagtcagttcacagcggacaaaaaccgatctatacatggacaccgatatacataaaaataaatgcaccaaatccaaaaacgcgaaaactagtaattcggttcgattcggtgttcgttttatttgtgcccatacacccctcaaacattttttaatataaattgtgagcgtgttgggattaaacactagacctcgggggttaaaaccacatacccttgccactgcactatcatgtgaattgattactacttcggtttcaaccgctatggactcatcggaaccaaggccatcaccaccccgcatcgcttgagcgcacagaacccctctacgtggcggtgcatgcaacaagaaaaaaaaaggtgagacgagaaagagaaagaacgagagggatggagaagcgatgagaggagaggagaaacgcccatgcgagacccccaaccctgatagtcgccagcaccgccatctccgccgtcatcgtcatcggccgcctccgcaaatcgaagcttcatcgttcaccatcgctgcctttgcctcgcccttcccccagccggcgatgggtaacgaaggggagagagggagattgctgaaacaagaaatatacttcgcatgtggggcccactcgccacgtcggctaagaacagactctatactggttaggatctcgagtataccagttttgtaagttgagaaactcattatatcttgtattgcagtttcgaggacgaaattcgaactcagcaacga

SEQ ID NO: 81905 - DNA, 25806 bp, Oryza sativa
tctattcctcgccttctcctctctacacaacaacggtggggcgaggagatgccaggccggcgcgagggcggcggggcacggagggcggcgcgtggccgccggcggcggcctgcggcggtggcctggcggccggcacaagggcagcgcggcagctcagcgaagcattagtacgccggcagcagcctactggatggggccctgacggtctggcgcgagggcagcgcggcgcgcggcgaggcggtggccgccggcggccgcctttttgaggcgggcagcctgtggcggcaaggcacggatggccggccggccggcacgtcgaggcggcgcctagcagttttttctttctttttttttgagaatctgagctgagattgttgtgagatgtattttatttgtgtgtgatatgaatatgtattttgtagaagttgtgatgtaattttttttaagattttgtgatgtatttgagatgatcaatttgtggatttgaaggaaatttgaggatgattgttttgggattttggggacgggatagggttagggtgaaatcaatatattaaaaataatgaagagaagaaaataataaaaaagcaaccggatctgcctctttagtactaaccgggactaaagataaaagtatctttagtcccggttggtaacaccaatcgggactaaaaatcgatttttactcccggttatctcacccgggactaaatatagcgatctttagtcccggattcgtagtcccggttggaaaaccgggactatataggggttacgaaccaggagtaaaaaccacttctccaccagtggaacaatcctaccaaattcctatgaaatgacttaaacaaatgagaaaagttaggcctggtttagttcccaaaatttttttcacaaaaacatcacatcgaatctttggatatatgcatggagcattaaatatagataaaaacaaaaactaattgcacagtttgcatgaaaatcgcgaggcgaatcttttgagcttaattagtccatgattagccataagtgatacagtaatccacatgtgctaatgacggcttaattatactcgaaagattcgtctcgcggttttcaggtgagttatgaaattagttttttcattcgtgtccgaaaccatttctgacatctggtcaaacatccgatgtgacacctaaaaattttcttttcacgaactaaacaagccatgtgaggtacaaccgcgcgctcacagaaaaaactttttgagtctttaattatctctctaatttctatgtttttcttatgatctatccgaatgtccatttctttgttttatctatgttttatgatccacttgcattcctgtttaaaccttataaatcttatttctatctgtgcgctttctcaatctctcgtttcaaacttcaaagtaccctaacttgccgtggatagccgctgtatgcatgttggaattttgagtacttttattcaggtaaacaacagtgaccaagtcaggagcttagctgttgcatgtacaacgtatgcatgcagcttttcggccattaattcgaccgagatgtttgctggtttgacactgtggtgatatagctagattgctggaagagagactgtttatgatgtggcctttgtccttggtatatgtttttttggtgaaagatttggtggtacaaattaagactccatttggaaggcataaattaatttcataaagaaatagtacgtgcaaggcctagttcttaatagatgacggatggaaatgaaaccgagtttagataaccgtttcgatggcgcaaatgaataaaataaatactatatattttttaaaaatgattatatatattttttaaagatactttggtgaagaaagtttttgtaaaaatcgcacggtttagaagattgggaagcatatatacccccaataatccataagccaaaaagaacgggactaaattgttgtagcaaacaacctgacaaattttattcttcaatttttatttttatctaattttctagggagtgggtatatagggttgtaggaggaacaattaaagaaaagaatgagtatttagagagacaaggatcaaaattacacatttttttagcggactaaattacagatacctaatataggacagaaacatattgttatgatgaaaatgcctttcaccctacccgatactaggtaacttagatttctcaactaatcaactagtcatggggcacacactactgtttgagatagtactggatgttgcctaattgccagttatatgatactcgaagacaaagagaaggattgaatgtgtgtgaattatgcatcgagcagcttgtgtgattggtgaaggacatccacttgaccactcctaatttcatttctttattcgaacacggatcctatatctgaatatctaaaaatctaatagcaatcaaacatatcactcatctgcagtgaagcagccagcaagctgcaagcctgcctgcctccatccaatctgcttggctgcattgcattgcatggttccaggcttccagccagagccttggatgctctcaggctaaaacacaatagacaccatcttgtcctgttgcgccatccggctgtgcacgtgcagacacgagagcgacaaagcaaaccaagtgccacgccataaacaaaaaagcaaagctgtcgtgtagtttatagctggctctctctctgtgtgtgttcagcggccaacgacactgcgtcgtcgttctgaatttctgatactatcgctgcttgtacgtacttcgtatttctgatggcaaccgtgtcgccgtctggttctatctctctctgttttctttttttttcttttgaagagtttgattcttaacttagcactacgtaccagtgcctttttaattaatttcgtcgtctgcacatgagtagatcctccatctgtttgtgtgttgaccgaatttagttttatatttgcaccgtgccttttaaaaacaaagcaagacaaggagaaatggaaccgagtggctgtgtactagagtatatatctatctgcacttgcttttgtttgtatacgctagctcttagaaactccttaatgaaacctataactcgacttaggtgtggggtagcgagcttttcagtttgcaaggcttgccgatctggttgacccgtgctcaagcaaggttggtgatcgtgaagtcggagctgcggtatcggcggggcgcgacgtgcggcaacgataacatgatcccttttctgttgtgcttcggcgtgggtcgggtcattgacatgacttggcgtttcttagtgaagtcggagtcgcccgatcacgtgagtgatggtgtgatgacgataacgtcatgtctttgccaatgtgggagtcttgttttcttcaagtttgctgcaagtttgctgcttggtcttatcgttcttctgttgagcaacgtttgttgtgtgttttgcttggttgtccttttctgttgccgtgattgtttaggctagttggagagtctgtgtagttgtggttttcgtttagttttttctaattaaaatgggatattcttctttgtataaaacgtcggcaatgcactggtagaggaaccatctttgatcggtctggcaaaatccacaatagtcccggttccaaaaagaaccagaactaaatattgtttttagtcccggttataaaaattttgaaccgggactaaagatgatatttagtcccggttcatcccctgtcagatgcaagtcaggggaccgaggatctttagtctcggttggtgttaataaccaggactaaagatcaccactttagtcacggttggtattaccaaccgtgactaaaattgaacacgtagtatataatccctatctgttatcctctcctccacagttacaacttagcggatcgaatctctccctctctcctcatatctcacctctctaactctcttcctcatcccctctcctccacctcctccccttctcatccggcgggccggtgggcatcggggccacgcgcggcggcgggcggcggggtgcaggccgacggggccgcgcccggcggcgggtggtgggttccgtggcggcagccacggccggcggggccacgcccggcggtcgtggcgagcggcgacagcgacatcgtattttctttttttttaaatttgtgattcactgagatgtaaaaatttgtgattcattatttggatctgtgatgtatttgagtaattttttaggattttgtgatgtatttgatttgtgtgtataagtaactttatgatttgtgatgtggatttggtgatgtgaatttgggatgttactttgatttggggatttggggatttgcctacttgattcgggagaaaataaaaaggaaaaaaaaagaaaaggggaccatctggtactgtcgttattgtctctttagtcccggttggtaacatcaaccggctggatccttactcctggttggaaaatcgggaataaaggggttcccaactgagagtaaagatggtttctacaccagtgatggtatgactgttcggaaaaaaaaaaaaagaaacctgtaactcgaacagaagccgtcgagttgtctctacatctaagtggttatcaaacctaaaaaatctaccaaattttgaaaaggttctaaactaaacacatttaagcccgaaatgtgccaatatttgatagcgttcaaagtgtcaacaaataaaccagcccgaaaaaaatattttcactacgtaagagtccagagtgaggctctccgtcagtgagttcaattttggtccctaatctgttctatactgtatttccaatcaccagaaaataaatatcttatggaagtattagtatcaggacaggcaaactcgaacaattttgttatatatttgtcaacaaattttctcccaaaaatttgacagatataattacagtacaatcatagtgtagctacactgtaacttgcatgtaattatactgtaactataatgtaacttgtatgtaactttaaaaaatctctccgtaacatcttatttcagtaaaatggaggtcgtgggacaaattctttcacatgtgtgtgctacgatttttttcctcaccagaacaaatcttgtaatagatctaacgattcaaaattacgtgaaatttacgtacaagttacactgtagttatatgcaagttacagtgtaattacactacgattgtattataattacatctgttaaattattaggagaaaatttatcgacaaatgtataggtggtcccaatacgaatatggatcctctctctttctctctacgtcgtgaaccagtagatgggctggcgcgaataggcctttcagcacgaaagaacatacggcccagaacactgtgagcccatgatgagtcctgcgcggaagtgagggagctggctgaatccgggagaagcccaccgtgcaccagtcgacacggccctggtctaaatgggctaaatcacgggcagatgcatctctacatatttaaaaggaggaataaattcacttaggaccctcgtctttgacgttaagtttgactcacgtcctgaaaccacaatataaaatattacatacgaggtcccttaacttgtcaatgaatccgattttcgtccctcaaccgaaaaaccagacgcaacaggtccctcaactatcaaaaccggtgcagattacatccctcggcagttttgagagtggttttggctgacgtggtgcctacgtggctaatttgactcagtcttcatctgacgtggcattgacgtggcgcttacgtggcaattcgatccggaaaaataataaaaccggtaggacccacatgtcagtttcacacacaaattaataaaaagagagaatccactcagtaccattgagttttcttcacttctacaatctaccactgactttgttaagttgaataatatgccattgtgttttcatgaacctctactgcgtgccatcgccgtccatgagccgttagttggcacccgtttgatgaagtgaaaaattttttaatgactaaaataccctttgactaacatacactaacacttcttgactgaaaaccctagacgtgcacccaaaacgatttgctcagtataaggcggcgccgactcccatcgatggaacgccagccgcccaagtccccgacgcgcggccaaacgcccggctccccatcgacgacacgcagtcgagcgcagggctcctcatcgacgcgcggcggcggtcggtcgccgggctccccatcgacgcgcggccgggcgcagggcttcccattgacgcatagcgcatactccagcgccgccatggccgcgtgcggctgttccgatgtacctgcggatggattagctcgccgagttttctggataacgggaatcatccattttaatagctcgatcgtttttacctccggactccggtgtatgcgaccgcgtcgccatacggtcctgcgtcatccttccgtcaccagtttcttgccgatgaggaagtgacatcacgcgtgtatatatatatatatatacgctcccgatatacgtggccgtatatatatacgccgggatatagtaggtgaccaacgtacgcaactgctggccatcggcccatatgcatgcagcccacacgagctgcttgtatgtttcttctcccttacaaaaaaaaaaacatgtataatgagttaggggcaaatatgtctttttacagctgacggcgatgacacacagtagagatttaagaaaacacgatggtatattatttaacttgataaagttagtggtagattgtagaagtggggaaaactcagtggtactgagtggattctccctaataaaaatggtggggccccacgtatcatgctcacccctcctcttcttcttcctcctctctctccccaatccccatctctcctctcttcgtctctctcctctgctctctccaggcgacggagaggtagcggcacgtggcggccagcggccggcgggagaggaggaagcggtgcgcagcggcggaggcagggctctggcggttgtgggcggaagaggaatcggcgacgggaggtggctctggctgcggcggtcgcggtcgctgcacgtgctcgaccccttcgcggccgctgccgcggccgccgctgccgaggctctgtccggggaggccgccatcgccgcggtcggagcggcggcggaggaggcaaccccgacgctgatcgacgactcccctcagcaagctcaacaaccaccttgataagatgctgaagtaagatttcttatgttatggcaaaaactgaaaattgattccacaacgcttgatgcattcctaaaaaaatgtattttctgttgttgaaatcgatcatatttttaataaatttttggttctggtatgttatgttccttttgaacagagacatggaggaatcatggctggggccatggtaatgccttctcttggggtacgaatgtacgatttaactgaccaacacattgaggcagctctgacaaacctgattgctggtctggaatcagaatacaaatttgaagtaaatccagtgctcatcaaggtcatccttggtgttgctatgtcagtggatgaagtgcaggactgtgtttctcaacttatatcgtgtaaaggctattttggccgaggagggtgttgtgggaaagacagacttagagccttctcttcttgctgtattgagtctgaagctctggagacagtcgaatgcttaataaaaagtacaatgaatgagctgagtgaaccagttgatagagatccagtcatttttgttctcgaggaacctgctgcggccacggccacgaccacgatgacacttccgctcccgagataccgccacgtagcgagccctccgcctccagtccacgccggggtcgcgggcttgggcgacgagcagcaattggagcagctggcgagggtgctctcctcgctgggtacaaacgagatggccttcgcggcgccgctcctcgccaactcagcgttgctcgcggtgtggacagggtcgatcaccgtcttcgcggctcccgacgtcttcctccgctcctcttgcaccatgtgctcgcgctgccatgtcctactggagcacatcgccctgggagagaggaggaagaataggaagggtgagttctactgacatgtggggctcacgtgggtcccccatttttattatttatgtgtgagactgacacatgggtcccatgggttttattattttttcggatcgaattgccacgtaagcgccacgtcaatgccacatcagatgaagaccgagttaaattagccacgtaggcaccacgtcagccaaaaccactctcaaaaccgccgagggatctaatctgcaccggttttgatagttgagggacccgttgtgtctggttttccggatgagggacgaaaatcggattcgttgaaaagttaagggacctcatatgaacttattcctatttcaaaggaggaataaattcacttaggaccctcgtctttgacgttaagtttgactcacgtccagaaaccacaatataaaatattacacattcctcaaatttcaaaacatgtgtaagttaggttccaaaatggtttggatgtcagttttagctaatgtggcacttacgtacgtcgctagtttgacttggttcttgtcttatgtggcgttgatacgatagtagaagcaaaataagaatatttaaaaaattaaataaaatatgtgggaccatatgttagtcaaataaaaagataaagaaatactaggatgcacatgtaagtaggtcccatcctccacctcaccctcctctctatctttttcggccgatgacgcatctttccacttctccttctcactcctaacatttcctcctccctccttgagatcgctcggtggttggacactgctgctgcctccgtcgatcatggaggtcgagcaccaacgatggttgttcccctgctagggacgaactcaatgacgacgcaactgctagggacgagggtctcgaagacgatgttgtcctacttgccagtggtgtctgtgaccttgtcaaggcctacgatgtccatctgcttgtttctcctagcggcggtcggaccgtccttagccgtctaccccagcacgaggtttacgcccaactatatcgtggttctggatttctcggtaggaaccgatggtttagggcaggtttcaaaaattccatatcggttctatcaaaaaccaactacaatattatttcgccaatttttttttgatgtttttcaactttttgtgaatttggcaatattcgtacacatttgactaatttttattaagaacgaataattaaggatcaaaatttcggaaattttgaccatgtcgataccctcgatagaaatggtggaaacagaagattgaacccatgtttagggttgtttctttaggcgatttggcgagcaaggcaacatcctgttgctcgccggtgttggatctgaccgtgaggaggcaaaatattggttgttgagaagggccagctcggcctcacagtcgatttgtttgccttgggttgaggctgcggtggcgattgctgagacgcttcttgatttgagctcattcttgagtttttgcgtggtgatgctttaataatttaatccgtcgccattcaattcttccgtatctttttttttccctaaatccgcgttcttactgtcgtggttctcttgtgctgtttgagatgatcagcaccgccttgaacgaccgttgcaggcttgttgcatcaagatttgctcatctcgttgtacgcaaagtgcttaaaatgtgggcaccctcaccctatataaacacacacatacacataagtattaaaaaaacatatatatgaaactaaagtgggaaaaattaaacttgcaaccacttctcaagcctttcgtgcaacatcgactactactactattaggctatgttcttttctccaacaaaagttggataagcttctagatactcgtggcacgcttttcaaactgctaaacggtatgtttcgtacgaaaactttctatatgaaagttgttctaaaatactccgtatcagattaatccattttttaagtttctaataattaaaactcaattaatcacacgttattaccatctcgttttgcgtgaaacatttaatctttatctttatttttatatttatcttcagaagatttaaacaccaccttagtatttggtgattcaccaaaaggataagaaaacaagagagattttatagcaggtgaagtctttggtgatcgattcacgagcatacgaacataacgagctttaatttgttccggtcaaaaaaaataaaaataaaacggtaatactttaatctatttacagtaaaccataaggccagaaaaatggcgtgatcaacttgattcaatcgtcgttcagggcttgaggaggcatcgtcttagccagcctcaccacgctctgcaccacaccgccgggccccttgcacgacagcccgagcccgagcccggacccaagcccaagcccgagcccgagcagcttgctcccacccttgggcgtccccctgttcccgcgctcggtgcacgccaggaacgccgcgaggaacgggtcctcctccggccgcacggcggcagcggcgccgccgcctcgccggccgccccgacccgccgcccccggcggcggacgcactcgtatactgtgcggcaccgcctccttcttcgccggcggcagcttctcggcttctcccgccgccgtcgtggcggtgccctgcagcagcttcgacacccccggctcgtgctcccacgcgaacgccaccgcgccgccgctcgccggcgccggcgccgccactgctcccgccggcttcatctcacacgtactctccgggctctacctagctagagatctcaaccagcttatatataatcgtggatggtttttggagacggtggtcagagctagcagcctagcatgcatctttgttgttcttgcttcagtttttatagcagcagcagcagcagataaatcgatggagacgtcaggttgggcaaaggtaagggggatcgtcgtttgatcgctcatcgctgacgtggacatgtaacaatggtggcttagggctatttcttttctccaactctcggcttcctcatttttcgttattatatgttttttaaactattaaatggtataatttttacgaaaaaatttaatataaaagttgttaaaaaattaaataaatacacttttcaattttataattattaaaatatgctaatgagttttcttattttgtgtgcgataaaagtttctctctaaagatggatatcgaacgcagccttagacttgaccatcatctcttctctcttcttctctctcaccttgtcgtcagtattttcctttgggcatggcagctggaacggacacacgcaagcccggccggcagctaactgcaagtggttgcgatgcagcttcgtatcgtcgacgtatgagtagtttttttctctccgtgtacagatacagtcgatggaatctgtttcggatcatatcgtcatcatgtagctggtaaatttctttgtcatcgatcgacgacccctgccttgattaacggatgaatgaatttaattgtttcctaattcctatttgttactacgtataggagtgaatttcactttgagcactgatgtttttctttgtaccataatttaaccatttttttaaaaaaaattcgaacgagatagtcttatactccctccgtcccataatataggggattttggtagggatgtgatacatctgtactacgaatctggatagagagcctattcatagtactaagatatatcaaatcccaccaaaattttttatattataagacggaggatgtatttgtttgtactttataccaccctaactatttccttaagcatatgaatgactttgagtatacatgctcctacttgtaaataaactctcaaagtcacagttgtatgtactactcctttaatatatgataaattagatgtagataaaattgaagtgttaatattggtctaaaatgctacaaagataaaattatccgtttcaaagtgaaaatattgagtaaaaaatataaaaaaaaacatcgataataagtggcggacgtaggatttcaacgatggagctacagagttatagactacggactgtgtacgtaatactaaggaaactacttccttcgtttcacaatgtaagtcattctagcattttccacattcatattgatgttaacgaatctagatagatatatatgtctagatttattaacattaatatgaatgtagaaaatgctagaatgacttacattgtgaaacggaaggagtacttggtattccaatgcattttagaaagcttggtaacaaagactggaaggttattgaacaaagaattgagaaaaaaacttagtagttggaaaggtaagtatatgtctgttggtggtagattggtgttgattaattctgtacttttaagtttacctatgtttatgatttccttttttgagataccgaaaggggtgcttcaaaaaattaattattatagatctcgtttttttggcaaggagatgatcataagaaaaaatacatacttactaggtgggatatcatctgccagcccaaagatcagggtggtttagggttcataatttggaaatacaaataaatgtcttttgagcaaatggttgtttaagttaattaataaacaaggggtttggcaagacttattgaggaggaaatatcttcataataagtctattacccaagttgataagaagtaaggtgactctcatttttggtctagtctcatgaaagctaagggtactttcttagacatgggttcctggattgtgaataatggagaacaaactagattttgggaagataaatggttatgtaacttagcctttaaagataagtatccttctttatatgccattgtccgaaggaaaggtttttcaattgctagtgtttatgagatctgttcaacttaatgtttcttttaggagagcttcaattggtcagaatcttatttttgacatgagttgtgtacttctattgtacatatccagttgaaccattcttctgattgttttagatggaactttaatcagaatggaaggttcttggttaggtcaatgtatcttactttaattaataatggctatattgagataaataaaataatttggaagcttaagatgccgcttaagattaaaatcttcatatggtacttacttaaaggggttgtattaatcaaagacaatttagcaagacggaattggaatgggagtttaagatgttttttttatgaaaaatgagaatattcaacatcttttcatggattgccattatgcaaagtttatatggagagcaatgcagtattcttttggtctatgccctcctagtagtatatcacatattttttatggttggcttttgagggtggacaagaaaaagagtaagcttatacttgtgggagcctctgcaatatgttgggttctgtggttgagcaggaataatttggtttttgacaaatcaccatctattacatatatgcaggtaattttcagagcagaatattggttccggtgttgggctcagctacaaaggtgtgatgaagatggcgagttaatgaaggttgcatgccgtaggcttgagacgacagttatgtaactttttgccaattatggttggagattcacaaatagacttcgataacgtgttctccttatcttagatgggttttttttttattttaagtgcgtgttctcaatgttttgttgaactacactcattttcagtgttctccttatcttagatgggtttttttattttaagtgcgtgttctcaatgttttgttgaactacactctttttcagtgcaactttataataattaattgtagctcgttttgagtaaaggccgagatattctattttattagtaaaaaaaaagtggttcgaagtgaaattcacctaataaactccatcgactgcgtcgtaatccaaaacgaggtaataaaaaggtgactaaaatcaaatccgtttttcttcatatgctgataactttagcgatatctctgtcgtgttcggcgtacgagctgccgtgatgaccgatgaaattaatgtggttaatgtgtctaatacacatggcaggcatgcatgcagcttattgcctgcagcctcgcggtcaagtgtttgcacacgtgaaggtacatatgttatcacgacattgacgctaggctacagcacaggagtcaataccccaaaaacacacacatgaagaaacttgacaagcttttggtcacattaattaattagagcacagacaaaactgtctaatacagtgctcgatcgatcgtcacaggccatgaaacaatggagaagacacagtggtcaaattaatgaaatggaattccaattgtcccctggacatctagcttcagaatttttgcatcaggaagaacacaaattggcgatggatgaaccgaacagtttggcaaattgtttcttcagaggttggccgggttgagagctggaagatttgctctgcacaacagggacaggtaggctgatttatcgatctgacagtgactttgtttggctacgctaaacctaacctagcttagttcgattgcaacaagtattagcagtggtaaaattcagatttgtttccacgcataacctgacatatccggaagaactggtcagatatcgatccaagggcacgcagacaaatctttcgcttttatgattcatgaatgcgtttttgccctgcaagatcggccggggaaatccccccacggtgagaaatccaatcagattaccattgtgtttatttcgatcagggggcgacctgatggcgactcgattctttagacagttctgacgaaagttcagtaatcctcatctctaccactttctactaatttaaaagcgtagtcgttctcctttcgtctccttctcaccgtgctcggatgtcgtgtaactattgtaggatccaatactttcatcttagcctacccatccaatcaatctccaattatatttgtatatagcttgtgttttatctttaatccacccatccaaccaatctccactcatatagacttggactatgggtgaaatcggtcacggaaattcccgatcgaccgagtgccgtttccgtatatggtgtaccgtttctgaccgtaccgtttttggctatttttaaattttgttttttcacaattctttctgcatcgtattaatgtcaataccgagtagtttaaatgataaatatggtcaattaccggccgattgagcatcgtttccgaagagatgctaccgattccgatcgtttccgaccgttttaacccctaacttggacaaattttctaaggggaaaaagtccactttgactcccttaaaaataggccgaatctaattcatacccctcaacaagaaaaccggacaggaacactccccgaactattgaaaccagcgcaattttactccctgagcggttttggatggtggttttgctgatgtggagctgacgtggcagggttgaccgggtcttcatctcaggtggtgcttgcgtagcattacaatttacgaaagagtaaagttcatcaccggtctctaaacttgtaccgttgtgtcatcccggtccctaaactcgcaaatcgaccattcaggtcttcaaacttgtccgactgtgtcatcccggcccctaaacttgcagatcactcgtttaggtcctccaacttgttcagttgtgttaccccggtccctaaacaggacggtctaagaactttatataaaaaataattcataactttttcatgtgaactctaatgaagacaaactttatatcaaaattgtagcccttgacgcaacctataactttgtagttgaaaagtttttgaattaaaactgtttagggtcccaaaatattgttgcatgtttatagattttgaaattttaattttaaaattacattttgggacaaaaaatgacttaaaataaaaaaaaattcaactacaaagttgtagatcgcatcgagggctacaagtttaatataaagtttgtcttcattagatttcacatgaaaaagttatgaattatttttaaatataaagtctttagaccgtcatatttgacccagatgatattcaaatccaagtttagagaccggggtgacacaactaaacgatttggagaacttaaacgagtgatctgcaagtttagagatcgggatgacacagtcgaacaaatttaagggcctgaacggtcgatttgcgagtttagggacagggataacacagcggtacaagtttaaagaccggtgatgaactttactctttaagaaatatatgtgggacccattgtcatttacacacaaaatattgtgggccctactgacatatggtcgtcctctgtctccaactcttcttcctcctccctctctctctccctcttatctttctcatttcttttccccttcgaccgtggcggtagtgagcgggacgacgggtgttggagcggcggcgctggcaagcgggcgaaggctggagcagcagcggcgctggcgagcgggcgaatgctccagcggcgtggagaggggtgtcccttgtacagcctccctgcagctgaaatgagccgcgatgattgctcacgctgaaatgcacacgcaaactcccattctacgaatgcacgcgtccatctccttcgtgcctcaccgtgttgggcttgccgttgggcgttgggagtccacagagctggacgtgtcgttggcgaacgagcacgtccgcgccgacaacctgaggtgatgctccgggatgcgtacacgcacttggcggcggacagcgtgtcgtgctcttgggattttgggagctcttcatgagccgcgatgatgcgcacctcgtcgacgccgagggagacgagaggtcaacgatggagtcttttacctctatgccactaaaaatgttgttgcttatctgtgtgtcacaaaaaaatttggagtcacctatatgccatgaggctaactttcgttgacccgtgtgccattccgtccatcttctgttagaacttaacggttccatatatctgacatatgagacccatgtatgaaaatgactaatttgcccctgctctattttcagctctactctcattctctcttctcctgctctctccctgtttttgccgcacgccagccgcaccctaaccctagccgcacgccgctgccgccgcctggcctcgccgtagccatcgccgccgcctagcctcgccggcgccccatcggcccgtcgccccgtcgccccaggccggcacgccccgtcgccgcgcgcccaggctggcgcggccttgcgccctcgcccccaggccggcgccccctgcctccaagccgcctccaggccagctcccgccccccgtctaattttttccctattttttccaccattttctaatttatcccacattttccttttttttcctggatttttaaacatttttaaaacttattctcacttattctggtttttaacttttttaaaaatttattttccatttttttatttttaacgccttttctaaattatttttcacttttctgatttttaaaccattattgtacacaagggcaaaattgtctttacacagcccataacatctctgttatgtctccatccatctaaaatggtacacggatcaacgaaaattagactcatgatatacaagtaacttcaaatttttttctggcacacaggtaaacagcaatttttttaatagcatatgggtaaaagactctcaacgagggcggccgctgcctgctccagctcaagcgagattgtctcacccgcacgcacggccacgccgaggacagcagtgagttcaagtttcaaggactccacggcacgtaccacgtcgacttcgtcacgcccaccagcaagatctctcccgggagttcacgggacagcctccatgctcctcggctcctcgccgtgacgacggggtccccagcgcgtcagccgtggtcatgctaggcctcgacggcctgggcatcgaagtgctctacctcaagttactgcacgacgacgatggcttggggagttcgcggcggccgacgacgtgctctggcgcgggcccgggtgcgtgcaacaattctaggtggagtgcacggagcagtgtccgccacgtggccggtaccggtatgccgctgccgctccggctgaaggggaaaagaaaagagagagataagggagagagggaggaggaagaagggttagagagacagaggatgccatgtgggtccatatgttagtgtggcccataatatttttttaataataaatgggtcccacatatatattttaagttttaataccatatgggacaaagaccaggtcaaccctaccatgtgagcgccacgtcagcaaaaccaccatccaaaatcgctgagggagtcaagttgcactgatttcaatagttcggggagttttcctgtccggttttgttgttgaggggtacgaattagattcagcttatttttaagggagtcaaagtagactttttcctttctaaggcaagcaaaaatggcgagattgggttcctgtgggcctcagtaatgggccgtggcccactatcaggactaacgaggttggcccggccagcagatccccgcgtcgaatcccaggaatggacggccgagatctcatctcccacaagccctaaccctaacgaagtactagcagtattaacaagcggcgagcgctcgagctgggtgcgcgagcggttggcggcgacggccggcggccggcggcgaggtcgagcgaggaggcgggccggcgaggcgcgcggtactttgtgcctcgaaacgagtgggcctttattttttttttggttctgtttcggctcgtcgcggatttcgcacggtttgcttcgttcttggtgattttcttgaagcgtcgtcttctccaatcgatcgcttcctgtagcttctccacccttcttctgtggtggatacagatttgttcttggaagcggctgggatttcggttaacgatgccattggtttctattctaacatatgctttctcttgtctcttgtgtctcttgtgtgttcagattgggcttgttggtgtcggatttgattgtggtttcgtggctgtgatgacaatcaaacctcgtttctcgatgctgagacttgatttgttcaaggaccagaactgtgctgaccttaatttgtgcgtgtctgagccaccccaaacacaccatgtccgaatcgatttctgcgaaagttagtatgtctgcacgatgccactcgatgctactactagtatttaggtgtctttattagctttttcctcttctatgtttattggctgtttcttgcatttgcgttgttgtagtgtggctgtgaggactaactactttgtttctcgatgctgacttgattcaatcaatcaaggaccaaaaaaatttgatgacctttgtgcgtgtctgagccactgcaactcagttttttcagtcttcgcttgtgtgaagatatcatcttgccttccgtgttttgagcctgaacgataaagaagagatgtttcttggtgctgattcgactcattttaggatggaattttgacgaggctcatgcgtgtctgaagtctgaaccattgtaaaacttggatgtagttgttgttttaggtgtctgaagtctgaaccattgtaaaacttggacgtagttgttgttttttttcctaaaaaaagagaacttttttctctcgttttttctctgctgtatttgaatttgttcattttttccagctgttgtacacttgtacttcatattgggatactgaatgttaggtgcgatcaatgtagtagtgcttgcatgtttgacaaactcatggacattaactcaagttatctaaaacattgagatccttggaatagttatgctggaactattgcatggaaattttacaactcgctatatgctagaagcgaatccccgtagttcattttcctcaatcagcccagtagatttctagctaatggtatctgataaggggcaaattgttttttcaaggatacagctgaattcataagaactgaaaatcgcaattagctggtattacattgcagaagcttgagaacagaaagaagggaataacatgcatgggtaacgccaatactaaagctatcccatggtgagctcattaacgacttgatctccatttcctgaagattcacattgcatgatcctcgaggttcagtaaccaaccatatggccttgcttctggtttcatgattgaatcgtcaggatttttggagtttgtcaagatctcacctagaggtccaccttgaggcatctcccaagaacttgagatgctatcctcttgcatttgtgccatattaggtgcatggcagctgacgcgtgggtcctctggcgaggaatagaaagttgatggaactgtcatgacattggaatctttgcttttctgaaactccattttctcgtccttaggcaagctgaaattctgaaggactgactgaaggcatccacgatcatgcatcttggtgaaaggaatgcttttgttgttctgctggttgctgctctcccaaggcttcaacatggtatttgaagaaatcgattcactgtctcctgctgtattgaacttctccggtttgttctgttgcttcaactgagagaacagggacaatgttggctgttgattcgttaaatttagcagtgggccattgttttcttcagcagctttgtttcctttctctttgttcgccattgtcctgcaaatgtgtacaggtcttcaaattaaatgattattactttctattaaaactgaaataatctagttgttttcctttgtccctgactatattgcagcatttgtattccattctttataagagatttttttccaccagaaccacaacgattaccttctatcatgaaaatgtaccagaaaatcttaaaccatcaataggatatgcaaaaatggtggaaaaaaatactgtgattcagtctgtagcactaaaatacttgcacgttgagaatattaaaccaagtttaaggatgtattaacctgttcaaactatctgtccaatagctgatactgcgtggcttcatttcattaacttttgccttcttgaagctgccctgcccgacagaagatggcaatgagccagcacacggtgtctctttcacagtctttctactttggttttccacaggctttcttgaacggtggcggtttctgttgatgtgcctctcacaatacttgtggtcggccatggcctcctttgaacaccgccatttcttgccatctgttcgacggcatcttccaggttctgggtcagagtctgcatttgggaagccttgatagagaggcctccagctcactgcagtacaataagtatgtcatgtttccatttgatttacatatcacgttgccttttgtcataataaacctgaactggtgagaactgagaacgtaacattgatacagcttgtatgcagctcctttttgttaataacatgctcacttgtacactcagatttgcaatattcagtttgtgaaagcagtattctttacatacacctaactgacacacatattggtgtatgtaatgtatgtatgtaacttgatgatcgtacgtttcaagttgatgtaaaatactgcatttctattttgctcatttatacttaacatgtgtttcatgtatatgcagtaacataagtaaacagttttttttctgttctacccaggatatgaaaatgtgagttttcaggtttaaagcatcaagatatttgggtttgaatacatacttctgttagctgatgatctgaagcttttgctgattgaaatgagcaggctggaaggtataggggcctttgcattgagatacttgtaaatgagagcctggtgctccagctccatccactgtgagggagtgaaaggcctcttggtcctagacaacaagaacctctgctcattttccctcccaaaatccaaacctggataagtcaaggaaaaacattttagtgtggtcaataatatattcgaaagaatcaaaaaccttatcttgagatagatatggatatggttaaggcatgcaccggccagagtcaagacaaaagtgtaaagttaaaataaagcaatgaaatgaaacagccttaggtttgggaagggggccccagggtttgtgctcatccccatgactcgttctgtagcactcatgagagctcatcaagttcaataaatgtatcacttgatttatcttttctgactttttttccctctcatttgtgcaggtgaacagaaaaaaacactgtccatcatgagttgcagagaaatacacagatcaatggccttacatacatacatgcacacatgatctttgcttctaacctattgcaagttaataacatggaagtgtgtatgtatgtggtgatgagcaaggccagacctgatggcaatgtgtgagcagccttggcgaatctgagcatcttctgttcatcaagaaagggggaagggtatgatgcagcagcagcctgggtgaagctaccagcagcagctctcttgatgaggctcagatcaccctccttggtggatggcactgtgagtccttgcaagcccaacacctctccaagctccatggcagcagcagagaagtcagcaaacatcttggaaggacaggaggaggggagaggaggaagaagaagaagaggagggggtgagcattgctggggacagtcacagtgaggctgaggttgagagtgaggagggtgtagtgtgtgctttctagtaggaggcaggaagtgtgtggtgatatattatgggatggtggctctttgggagactagaggtagggctaggtggtggcccttaaatagcaggagtcctttcattcttttagtggagtaactttttttgctgtcatttctttattttatttttattttattgattttttgggctcaatgtttctgtgaagtgatactgctgggtactgatggggaggagtaattggttcataaaaaggtagtagtagcagcagcatgtttattctcttcttttctaattaaggtctggtttagttttccaactttttattcaaacttttaacttttctatcacattaaaactttcctacacacaaacttctaacttttccgtcacatcgttacaatttcaatcaaacttttaattttggtgtgaactaaacacactctaatatataaattttatcttggttttcattgggaagtttttcaaactgtttaatggtgtattgcttcaatatatcaaatagaatcatttttttattttatgataattgaaacttaattaaacgtacgctaatgattttctcattctgtgtggatacttaatctccatccttgtcgtactcccttcgtcctaaaaaaaagctaacctagtattaaatatgatgttttctattatctgtccagattcattgtactagaaaacatctcatccaatatttgttgtactaggaaatatctcattcaatattaggttggttttttgtgggacaaagggagtaggtttgaacacaagcctcaagatcaaaatgtgattgaaagcaatgtatgtactgttccacaaaagcggagggagattttgcggccaaattgattgggggcaattacgtgagctgtaggggcaaatcaataactacatggctgtacacatcgctcagaattaaccctctatgcagtactactactacacttccaataagtgcagtgacccttgtgttctcttgcaagtaaatatgctcgaaatgaatggtcgagcttcatgtgatggtcagaggctcttctctcttgctccctccctgaaggaattgtttagtttttatgtaggagtatttattgtgtttttttgaagtcacacacacttcagtgcttttgccatgtcccaggacagacaaatttgattattcaatttagcaatatctgtacttcgcgccaagaagaagctcaatataacgcagagtttcactgtgctctaaggtatactcctacgtcgcaaagaaactaaattcagtacaattttatttttttgtgaaccattatctgtgtgtataaaatagtgtgattccgtgttttttaccacaacaccaaggatggtaggacgtccaaccaaagcgctgtgctcaccacaacaccagcagtgagtgactagtgaggcagacaagtagcagcagagctagtacccctggcatcgacgcgattgagcctctcatcgttttcgtattaatttttcagtcgtaactaaattctgaattataaaaacttaaattttttagttatttcaacgtagttagtttttaaaccgttagtgacacgcacataaaagttctacccataaatttattccacagcgatagtgagtttgctcttttttataatgcttccgtcctaaaaaaacattaacttttagggataaatcaagataagcatttgtctaaaattcatcctctattttatttacttatattcagtttactttctccgtaccaaaataaataaacttagcacataacgtgatacattatagtactaaagaatttgaataaacatgtagccccattcttttcttcaactccaaactttaactttttcgtttttcgtttttcattagcatgcttttcaaactgttaaataatactttttttctcttaagaagatgagatcgaacatactctctccgtttcagattataagatgttttgactttggtcaaagtcaaatagctttaagtttgactaagcttataaacaaatatagtaatatttacattaccaaattaattttattaaattaataattaaatatatttttataataaatttatcttgagtcgaaaatattattattttttttctataaacttggtcaaacttaaaacagtttaactttgatcaaagtcaaaacatcttctaacccaaaacatagggagtattagatttttatttttaattttgagatggaggaaatatgtgtgttgttggatggggggtggactcagactctgcatcgccaagtacggtagggcgtaggcgagggggcgcccccggtgagacgcgaagaagctgatagtcggctggtggcgctgcgcgcggtcacgaggttgagatgacgcctttcattcattgccggcagccgcccgtggccgtcgtccgtcgcgcgccctcgcccgccttcattcatgcgcgtccaagcaacaagatactgagacaccgtgctaccaccaccactacaggctcacatcacagcaacatgctgctactggaggtacgtagtaccaagcacacacatctctgataggattttatactctctctctctctctctctctctctctctgtgtgttctacctgaggtgtggagtgagtgagtgagtgagtgagcagctggcaaatctggcatgcatcatgtgagtggaaacagggggggtttaattgggtccccgatccccacactcagatacgtaatctacgtgtacggggctgcattctcctcgctccaatgggtgtacgtccgtgcttgatgatgttactcatcgggggaccaacaactgaagaaaagctcactacagattttacaggccaaactatcgtgccggaaattgtgtgcgccggtattttgaactacagttacgttaaaggagtaaaatttcagaaaactacggatctagttgatattattctacctgtgtactataataattgtatttttagaatttgaattaatttgttctaaaaaatagttgtcaca

SEQ ID NO: 81906 - DNA, 19757 bp, Oryza sativa
  unsure (1)..(19757): unsure at all n locations
atgaaaaagtacggccaaaagatttttctatgttatgttaataataaataaagaagtatttattggtaaaacttgttaatattgttataaaaatgtattgaagttggttgttgcgcaatttcaaatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaattttaatatgctaagttgtccgataatagctaacccctacgtgaggatccctctcctctctcaaaccgcgctttcaggccggcctcacgtagcctgtaataacaaattaatatgtcattataaaaaatattacagtgcaactaacttatagtaaaacactgttcgtacctcttgacaaaggagtcgtgaaccgtgagtagctcaccgcacgtcgtgcccggaacgtcccaagctgagccccctgcaccgcagtaaggtgagaccggtgtcggtgatctatcgccgggtccaacaactgaggtgtatcctgacatgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagttcgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacacctaggacgtggtcgagtggaggtagtgccttcacccgtagggcgagctccatctgctgctgatcctgatagtcctgcctccgccgcacatggtttctccttgtctttaggacaatgcttgtaggtgtgcccatgttcatcgcatttgctgcaacgcttcaccctgccagcctccgactcgtccatatcgttgcggatgcgatgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatggctgcatggcctgtggagcagcttcggctttgcacaagagcaatgacatgtgccgtcggctttgagaacacactcctgcttcactctcttgcggtagatacccctacctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatccagttcttctaaccaatgttggactatccgttgggagaggtccaagagcttgagggtcagcaacggcggtcgatggagccgctgcacgctgatcactgcatttggctgtcaactcatctaatttcttccaaagctcattgaattttttctcatggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaataccatcttgcatgcatgtagagctaagaacgccctttgcagcacactcttgctaggatgttcaattgaggggaatttcttcaattcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccagttcgacttggcaaccctaaactctctatgaagtgacactgcaaaatgttttaccgcctccttcatatcttctgctctactataaatcgctccctgaataacctcattttctttgtactcccatctcacactatcctcttcagagacaatcagcccagaaaaatcctcactagcccattctgctggattaatatccgtctcatcatctgacgaatcaccttcctctacacgctcgttgtcagaatcctccctctccatttcatccacaatggcaccaacagtctccccctcgtcggccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattcattgttatgtcacttgtctgtggatcaactctcaagcccctcattaaccatccttttatagaaggtacactcctctcagccggtctatcaattcccctttctgatacaataaaatctgacagatctaccccagttggcccgtaacggaatatttgtttgttcgacatatctgtcaacgaaataactagatcatattactctttcatgcaataaacatctacaacgtaatatcttcttgtgtaagccaatgcaacggtaatgtattgattccaaactagcatatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatagccggccccgactggcttttttgcgttcgggccccttgccgccccaccagagggcggcaagggttttcctgcaaaaaaccctccctccgtcaccgcccgttcctcccccgtttgccacgtcagcttaccgccccagaggtgggcggcagggtctatttttgtaatttttttggccgatagattatttctgtaaatattaaaaaaaatctaaaaccgaaaaaaactcccttctttactttgggcatcatggcagggtagggtagtagatagagagactattgttgttaatgactacttcaagatgaggaaggaagaagtcgatagcaattgccagcttgctagcggcacacacaaacatatgcactggtatgatactccctccgttttaaaatgtttgacactgttgactttttagcacatatttgaccgttcttcttattaaaaaaatttatgaaatatgtaaaattatatgtgtacatgaaagtatatttaccaatgaatcaaatgatatgaaaagaataaataattacttaaattttttgaataagacgaattgtcaaacacgtactaaaaagtaaacggtgtcaaacattttgaaacggatggagtatattgcgcgtgcctcgtgggtaggatcagaaggaagcaaggattctggggctttgctaatcgagcatcctttcttctccgtcgtctgatctgctcttcgacaaatcacggtcgtccgtgtggccatcctgtgctcaccaggcgccgtccgatcccgaccgtcaatcggccttggtcgatcctagccgttcgtccctgccaatcctcccggtggaccgggttcacgatggacaaccatcttccagttgttgatgcttgggacccacttgtcaccatcgtcaccggcttcgccacggctgatgcaataagtttcatttattgcatcataaatcgatatatccttgtctcagcacttttgaaattaataactaattcatgtaaactctaaaatagattattcaacttgcaagattcatttaaattcaagatctacatgtttgtttatttttatatacggttttatttcgcttttattagagttttttctcgttttgcgtgccaacgtgttagaatccacaatctcagaagaccggaaaagggttcaagagattaatcgaagatgccagacaaagtgacatatttctccttgaacaggttgaacctactttgtaaaaatgttttgtcgtttacaaataaaatgcatgctctgttaattactcgatgttggctagggctgcttgcccttagctcaatcaactcgtgagcagctcgcaaaacatctcaagttgactcgatattttaaacccattgaaacatcagctcaactcgtttagaaaactcaatgaactgagctgaacccaagccacgagcttttcgtctaggtccgtatacactacacaattcctactacacaattcctgagttcatgttggtagtaactaaattatacatgaattatacatgctatccccctgcaccatcacatattagtttctttgcgtatatatatctgactagaaaactgtcagtgcggcaacgggtaaatatgttttttatggtacaataactattaagagtcgagtaacaaattaaaacattgggatcgctatacattataattgaaaacgttaacgaaatattttcttggttttgggcaaaaagccaatttcttcgttccttttaacccagcccagttcgttacctcctccgctcagcctgcctcccttcggcccaacctacaagtggagccataggcccagctagcacaaccaaactggtgtctttgatagtgtcgtacccatatgattccggaaccgatcctccccaccaaatctgtctggatatttgttgatctctcaaaattggttgagagcttcttagccactcaatctcctctttccattttttccaaaatcggaacaatccgcaaaattggagataaaaacagcctagaagctcgtcgaccgcctatcattggcgactgttaattggagattaaattcggtgaattaaggccaaactgaagggaaatcatgggacaaatgatgagggaggagcggggaatcgacttaagacagatcaacatggtggtggcggtagggtttggcacgcgcagtggctggaggcaccctgtgtgctagcggatcgaatcagatgaggacgacgttcggaaaaacagaaacattgctattttttattaggtatagatatagataggtatgatctattagcttaactatcgtagataaataataaaagtcttataaaatcaagctcgttagaagctcgagcttagcccggtaaagctcacgagctttagctcggtaaagttcgtgttgagctcaagccgagctcaagtcgagcctgccacccatcaagcttgagtgacttgtgagcctcgcatgtttttcattacagccctagcgattcactatggcctagtttagttcccaactttttcttcaaacttccaacttttccatcacatcaaaactttcctactcacacaaacttccaacttttccatcacatcatttcaatttcaatcaaacttctaattttggtatgaactaaacacaccctaggtcagccctcaaaataaaaaatatcaatagcaacttcgcttatacactatgtaccgtgccaccaactaactagattacacatagaaaaacctactccctccatatataacagggaaatgctacataattattctgactattcgatcagaatgatacgtttgatatctggtaggtatcaactaatacaccgtctgaacaagatgatacctctaaggtattgtctgatatttggtatgtattggctgatattaaggtatcaggtgatattttagaggtatcatttaatcttaatgggataccactacgtagcattcctccgcataatatagaggcagtaaaaaaaaagaaaagaaaaactcatgagttggaagggtcccatctcatcgtgccggtgctccataccaattttctcgaatctacaaatacacaggagacgaccaccagccgcgtcacggccaagcacaccgaaattccaacgagaaccccacgcattattccgcgacgcgaccacgggaagacacgggacacggaagaggggagagagcgagagcgagatagagttcgagttctacgcccaaaaccctagcaagctcccccgccccgccccgcgtctccagtaccttacanaagcttccaaccccccaccccccaccaccaggtgagtggatctcccatttccccccctctccccgcgagctcgccccgggcgggggatcctagtcttgacccgtgtgcgtgtgtgattcattccgccgcaggaagagcgtgcttggatcgcgcgggggaggcaacgctggcggcgcgcaggtgatggcggatccgcctggcggtgggggatctagcgcttgcgtctgtgagcggagggaggcggaggcggtggtggtggtggtggtgccggagctggggagaagaggaggagagcagcggaggggaggatgctgagcgtggtgcgggtgcacctgccctcggagatcccgatcgtgggctgcgagatcacgccctacgtgctgctgcggctgcccaccggcgtcgtctccaccgacgatgtcccggaggccgcccctgcggatggctacttcatgcggtacagatggtgagtaactcctcgagactctgaaaatcttagttgaatcagatgagagctgtggattgtgtagttctgcttgcttgattgctaaatgttgcgcactaaacttattgctgaatgttgcgcactaaactttgaccaagcaaggggaattttcgtagctttggtcaggcagatttctatgtgcttatatagttgttaaagtttggggaatgctcatttattggctcaactccttcataaatgaagcatagttggatgtattcagattaaatggtctaataagcttatcgtttgttttgtctgaaaaatggagccttagagattgtaaaatttagatgcggaaacatctatactgctgagttggaaacatagtttgatgcatatgaattgaaccgtttggtacatgtttttcaaattgcattatgacatatcaggaagcacagtttagctaatattaattgctatcatgagtgattcattgaaaagtgccattaattgggtggtttctgatgataaaacaagtgttattagaactatgggacagtagcaagtatttttgatatggggtatgttatgatggcttgagaaatgttgtcgtgcaagaatgttagtagtatccatcttcgatggaataggtatataacacactttatggtgttctgttggatcatcctatagttcctattgaaaggccctgttctatgagttctatgagtttctcctcattgtctgttgagttgttgtagaattggatccattacgctgataataaacatgattttatatgctcaagatgtgcaaatagcactgatgtacacgatgcttatagctagtttctgtgagctgataatgcaaaacactagctctttaggtggcctttgttggtttcaacacttccagttccaatgggatttggttataatgttttgatttactccttgaaggtaccgtatacaaagtgatcgaaaagtcgcaatctgcagtgtacatccaatggaacaagcaacaattcagtgccttggttgcgtcaagtcaaaaatacctgttgctaagagctaccattgttctgctaagtgcttctctgatgcatggcagcaccatagggtcttgcatgagcgagctagtagtgcattaaacgaaaatggagctgaagaagaggagctatttggcagatttggtagcactggttctggggttcttagtactactggttctggatcgatgtcaaatcttggacagagtcctggtttgaataatggccccgtgcctttatatccttcaggcactgataagaactcgggtgaaacttggtatgaagtggggcgcacacggacatatacaccaactgctgatgatattggacatgttctaagatttgaatgcgtgtctgtggatgctgaaaaaaaggtacctgttggacctccaacttcaattatgacatcccgtgtgattccagcaccaactccaactccacgtcgccttatccaagtgaatggagatgttttgagtcacttagatttggacagccaaacatctttcgggacattctcagtgctgtcctacaatattcttgctgatgcatatgctacaagtgacgcgtatagctactgcccaacatgggcactttcttggacatacagaagacagaacttgatgcgtgagattattggttatcatgctgatatcatctgtcttcaggaggtatcatatatatcaactaaatttccctattaacttttttggtgatttgttctattatttcccccacacagttacagttaattgaatgctatgctagattatggtggttgggctgctgtttcaactgatgcaaattttccacacttacctagagttttctgaagcttcttgtcatattatgctctaataatacttgattggtctcatcattttgaactgaattcatataataaaaatgctaagaaacaaaactgccctaaaatagtattgtaggttgacttctttgtgaaattgaatccataagtaatctaccttcataaaattaagttgaatcctactgttttcaggtgcaactgaaccacttcgaagattttttttcacccgagcttgataaacatggatatcaggcactttacaagaaaaggacaacagaggtatatttgactgcatctggttctattataatacgcatttatacgcttcaatttcttatttgattctgcttcatgtttttaaaggtatatactggagctcctcatgccatcgatggctgtgccacctttttccgtagagacaaattttcacacgttaaaaaatatgaggtacggccactgctgatttgagagtggtatgctaatctgcaggctgcagctatctaatatttcttgtacctggttgttcaggttgagttcaataaggctgcacaatcattgacagacgcaattattccctctacccaaagaagagttgctttgagtcgattgattaaggtatgataaattaatagaagaggatattgcatgctaatttattccattgctgacttttcattattgctggttctgttttctttgaaggataatgttgcactgattgcggttttagaagctaaattcggcaaccatggaactgacaatcctggcaaaaggcagcttctttgtgtggtatgtcaacaactctgcttcagagaagcacttagatgctaattgttagcagcattctgaagggatcagttaaatgttttctttggacaacggatttggactcattcaggcctcgtttggatgtgtcgaaatccgaaagcccagtccatatatgcatgtatgggatttcagttcacttttcatggcttacatgtggatggactgggattgaggcccatccaaaagatatgccttgggagaactatgcaaggtttacatgaaattaagatgcatccacatctctgaatcttgatgcatggctttagtattacatgtttgtcagggtgacctatctttaattgactttttttttggtgggggaatgggggttgggggttttatacaattcttcataccgataaacagtcttgacttgatgcattatggcgtcatgggggtcgcaggtctcatcactttttcaactgttctcactctgcaggcaaatacacacgtaaatgtccatcaagacctcaaagatgtgaagctgtgggaggtctgtgccatcacattttctttatgctagttttgtgtaacatcttagaatttcagattgacactgtatggcttttgcaggttcaaactctcctaaaagggttggaaaaaatagctgttagtgcggacattccaatgttggtctgtggggatttcaattcagtccctgggaggtgtgtataaatatgctatcactgtagtatttatttggtaaaattattttgaaaccatggacttctaagtactcaattatgctttcagttctccacatggacttcttgctatgggcaaagttgatcaattgcatccagatctggccatagatccccttggaattttacgccctgcgagcaagttaacccatcagcttcctctggtacagtaaaatatattggtctggtgatcccttttatcccatgatcaaagaactcttaccaagggtcttgcttgtttgtaggtgagtgcatattcttcatttgcaagaatggtcggtgtcggctatgatttggagcaccagcggaggaggatggaccctgcaacaaatgaaccacttttcacaaactgcacacgagatttcactggaacggttgattacatattttacacaggtcagttcctggaccagtttatatctgtatgctttgatattataattttgtagcttcagtaaacatcttttaaggattacacagctagtgtcatgaaacatttaatgatggcccacacttgctttcgtatttcagcggattcattgtcagtggagtcgttgttggaacttttggatgaggaaagtttaagaaaagacacggcccttccttctcctgaatggtcttcggatcatatagcactcttggcagaattccggtgcaagcctagaatcagacggtgacaccttaggtatgtcataagggcataaccacattttaattatactgtaggactgcggtgctctgattttgctagtgcaaacagcacatggctcaagtaagatttggtgcctgcttcgctgtcaaagtgccacatgtgcaaatacctttaaattccagtggtttacatttgtaacaattaaagctaagaaaattgttttttgcacaataactcatctgaaagtacgcagaaatcgtcattctagtcatgtttgttgttgtccatcacctcatttcatctcggtgaaaagtaacataacatgtagtggatcttgtctattatgcgcaacacacgacaccctttcttcatttgatgttccaagctgactgactttcttcaggtcgcgaatagatggttaacttcagcacccatgcggtggaacattcttccatggtgtgtgggacttgaggagggatggacgaaagcggatcctcggggaaggaccaccagcaccagcaggcttagggtagtggcctcatgaaagggaggcttgtaatgttgattacctcttacatttccaactcatgatgtttttaagcggccccattgtaatatcactttctatagaaggaaagatctcctgagagagagacatttttatgacagattcagatgccatcatggctaggccatttcaaattttcaatcccttctcttctagtactatactgcagtttttttacccaaccctgatcgtgcagtgtgtacttgttggaacttgtcaaacttttatggcaaattttagttgttgcagggttgacaaatggggagatgaatggttggtgctttggtgggcacctgatgtcttggccatttatacaggtactgtggttttgctgtttgtacgtagtatagatggtagttagccttggtgtccatgtgccaccgtgtcatgagttggctggaacatgttacatgtatttggcttattctaatttggcttgtctgatctgatcgccaccaaacgctcaacatttaggcgatgaaaacagcgagagatcgctggagataacataaccccgtggtgttaatgaccatcgggtatcaagctcaccaatcttgatttggtcatggacattactaatcgtactcttggaagtttctctcttcgttggttggtcaggtctattgggacccacttgcagcgagaggagtggtgggcccacccctcgtggcgcaggtcgatgctggactgggagtgacgggcgcgaatttttacttgtttgaccccgcaaccgcgtgatcttcctccggtgttttgtcgctgacacctgggccccaccagggacaacatgaccgctgccgtgcgtggccgccggggacccacacctgcggacgtgtgcaggtgtccgctaggtccgtcaacggccgtcgggcaacggcaaaggatgcttctattctggagttattgctgctgtttgtttggacggtttcatgatagtcttaaagaaagctcgttccactaagagcacccgtaatggtaaagtaaggtgctctctataagacatgtacatctcagcaatagactagattaatagtaaaccacctcaatagtatgtctacatagatatctatagctctctaatgcattgtctcgtttttctctatagactatctccaggttagtagatagttttgctctctctcttcatttaatctcttccaagtagaaaaatatgctgacatggatctcttgtagagagtctatagataactattgtgggtgccctaatggcatctcggagatgagaaattttaagacacatgatcgagtatctatgtcaaggggtgtctaatactagttattattacaggatcaagtcactagagattgtttgtagtggctatattggctatgtatgatgtataatataaagcataacaaataaaaactttgccacatttagtagtttgaaaatataatatgtacgcaatggccaaaaattgatataagtatgattatattatagttgtggtggttaacagggcatttttctaacatattacgtggtagttatgtataggcaactaggcatcacaagctttcatcactacagataacaagttctacgaatcctatttgatgataataggaggttttatgtttcttaaacacatattaacaaatgacatcaagatctatttcctttgaaacaatgccatgtattcaattgaacaacatatacaataaaagttagagaaaaactcacaataaggatttagtgataaacattgcaatgaaagaaaaatgaaaaatatggtggatgatagatgatatggctctagcatttacactcactctctcgttttagtaaggataaaatggtaacctcttcctacatactactatctctctactcaatcttacctaatatcacagtctcatggtgcgtcgcgaacttgatccaacaacaggatattactatggtaagccaattgctccatctaaggtgcgtctccttgattgaataatggacatttgctctacctttatatgaagtctatcaaactagttgtacttttcaatatgatgataagtatagagtaatgcttaatccagatacgggctcatgttttagtttaagatcgtctccttaacattatctttattctataattataggcctattgtttgaacaacaagcacaatgtacttgtcaaagtcgaaaatagcataggttccaagatcaagtggcaataattacaatagataccacaatgtgttatataaggggggggggaatgtgacatactgtcagacaatggtaattattatagacaccacaatgtgttatatgtaaggaaaaaataataaggggaggttcacctaaaaaaccattgatccttaacctcccatgacatctccctgcaacaaacaatatataaataatgcaattaatttgcatgcagcatccaatagccatatcacgtagtctcattcaatacttcttgctagataatatgaccatattttttatttttacccaaatttctattaattttagttatcctgatcagatggcattgatacatagtacattaagaaaaatcaatttaaaactggatatgacatattctagtataatgaatctagacggatgtatgtccaaattcgttgtaagagcaaggataataataggctataagcaagttatatgcttatgtggaagagagagataaaaaaaagtggatagtgttggctctcatgcaagagccagctccacacaagctccaagaaatatgcattaaattcatagagtgagaaagagagagaatggagaaaataaggttaaccttatagctgacctattatacaagttagctctaacatagacatagtaagcagtgagctctactattaaatctactctaataggatgtgtcacatctaatactaggttggttttatatgagacgaaggagcaggacagtaggttattctcccaaacaggaaaaagcagaaaacaaaaagtcattcgttcatatcatcatacgctgtactgtactccctccgggttgataatacttgtcgttttagacaaggacacggtcttcaaaaaataactttgaccattattttctattataatatgtagaaaagtgttaacaaatatatgatcttattaaagtattttttaagaccaatctatacatgtagtcaccatatttgaaatacaaatattttaaaaataattcataattaaagattgtaaagtttgacctcacccttgttcaaaacgacgagtattatcagcccggagggattacgtttcaaacttgacaaaaaacgccgttatcgaagcctccgtgaaattccaatcaaattcagggtgcaaaccacaaatgccccccatttggaccatttgcctctcttcctcctctccatctccacgagaggagagaagaagaaaaggagccaagcaaaaaaaaaaaaaaaagcgagcacgcgaacgccgcgtgatccaaatcgaatcgaatcctcctccgccgccgacgagggcacccgccgcccgccggtgagcccgcgcgagcccggccggattcgattcggccgccgcccggttgatccgcccccccgaggcggcgggtggtggttccgagatctcccggcgagccggaggctcctccgcgtcggatttggcgccgcgggggaggaggatgggctcgcggataaaggagatggtgcgggtcgccaccgcgcggctcggcggggagccgtcgccgcgtgggggcgcggggaactccgcgttcggccgcggggagtcgtcgaggacggcgcggctcggcggcggaggggccagcctgaggcggcagccgcagccgcaggcgccgtccgtgcggaccatctgctgcaacgaccgcgaggccaacgcgcccgtcgggtacaaggtgagcgcgccccctcctggcggtttgatcgatctgttgagagtttcgtttggaggaggaggagggggctggtctaggtctagatctcgttgcttttcgcgcgttccttgctaatatgtggttgtgctggagataggtgtgtcaatgagctgacacagaagttttttttttttttaaaaaaaatttccctgatgctacatggttttgcttagtttttctggactggattttgttagtcatttgggttgcattaatggagaactatgaggtcattgggcagatttgagcttatctagcttttggaattagtaatttaggtagctattgctaaaaatgagatgtagacaccgctcggtttctaggcttgaggaattatagtacaagagctgaacgatgctattcattcttgccccaatattcaccagatgcatgctgtgtcggctactgaacctggatcagtccgaccacaactagctcaccctcaccacttgatagcaccaagctaaattaaatttagtttttacttgtaagacaaccttatgtttcaaataacaagattgtggatcatgccctgatattgtgagtgcattgatgccaaaatgccttaatggaagggtgtttcaggtgtttcatggtcataccggaaagttctcaatttattctctttcatttggttgaatcctatcggtcaaaatgttcccttttcctccctgcgaaactgctttgactatgttgtactccctccaggttgaaaacaattgtgtttatggacaagactgatgtccaactttaaaaactgactatgaataacttctataaaatattttctttagaaacatggaaaccatatgtatagattgatcttaaaatatatttcaataaaatcatatatttgttgatatttctacatatattgtaatagaaagtagtgatcaaagtttgttttttggagaccgtgtccttgcccaaaacgacaattattttcaacctggagggagtaaattggtgtattcatgaattttcttttcaccacagctgtatttgcccccttgtttcatgtgttgtctctaaggattaaaatgcatcaacaccattgctatattgctaacgtggttgtagtttgtttgaccatttatgcagttctctttttaattgattttgcagtttcccgcattttgggtatcaaactgtcaattatgcaaatgctaatatcaggacgctacataattttggttgttttgctgttgaggaattactgatatatttttctctttttctataacgtggttttttacattgcctgttctcatttgcagggaaattctgtgtcgactacaaagtataacgtcctgacttttctacctaaagggctgtttgaacaggtattacaacattgtttctttgtccattacatatgttgccaatagagaaaatttaggtttaatctccttttgtgatgaatctaggtattgttacgagcatcataaccatccttgtcaaatcaataaacgtttaccacagtggatgtttcccatggctagattgctgctttgcagttattgctgtgacatcaactttttgttccataaaaaaaataatatcaacatgtgaaccttgtgtagtttatctgtttattttgctttgacagttcaggcgggtggcaaatctgtactttctcatgatttctatattgtcgaccacaccaattaggtatctctatccgacacacccctgcacgcacctgtgctacttttggaatccactggtttcatattgacatgttgagcacagcacttattcattggttaattcagtcatcgctgttttctttttgcagtccagttcatcctgtcaccaatgttgttccacttagtcttgtgcttttggtttctctgatcaaggaagcttttgaggactgggttagtattccaccattcctcaattctctattttgttatgctttctaaactaagataaccgacagccttacctgtttctttttgctgtttcttatacagaaacgtttccagaatgacatgtcaattaataacgcacatgtcgatgtgttacaaggtcaaaagtgggaaactactccatggaaaagactacaagttggagatattgtgagggtaatgtcttaaatcttccttacaactacttttttacccatctgtttgtttacggaattattgcgcattacttcttattgtgtgcggactttaactctggcctcaaagtaaataagaaaaactaatagtgatggcatttctttagagcagatcaaacaagatggttatttccctgcagacttgctcttcttgtcaagcacaaacccagatggtgtctgctacatagaggttcatacattcgtttttaccttttccgctattctgcacattttcaaagtgtagtaaataagctacagagatatctttctctaaactgaagttctgttgaatatatttttgttcatcttagacagcaaatcttgatggggaaaccaacctgaaaataaggaaggctttggagaaaacctgggattacaaaaatcctgaaaaggcttttgaattcaaaggtttgtgcatttttgttctgtggcaaggtggttgtaacttatagttgttgctttgttggtttggaaacttttcccttcagtttctctggttattcttccttggtgctgttttgtacttgacttccataaaatgggtttacaggtgaaatacagtgtgagcagccaaacaattcactgtatacatttactggaaatcttattgtggacaagcaaaccatgccactctcaccaaatcaagtactactaagagtatgtttattcttgccgtttagttcatttttgtctttttttttgtccattataaaatattttgacctatgttttttgtgtattcctagatttagcatgacatgtttttttcacactccaatgtatataaaaaaagagtgttatcacttatcacgggattcatgagcagatacgtgtaacttactaactttgattaactcttttatatgaatgttggccacacaaaatgatgtcagtatatttaccacagaaacctctgatgattatactctgtccagaagtataaggatacgtagagtttgaaatttgtcaaagaatacaaggacacccacacctacttcgttatctcagccaattataaccatccctcacctcaaccttaatctctccacaaaacacgggagtacaagttttgcaaataggataactgtggtgcaaacactttaaagtactccct

SEQ ID NO: 81907 - DNA, 31601 bp, Oryza sativa
gcaaaaaaaacaaaaaaaataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggcatggcggcaccgggagatggggaagagaagaaggccgggagcgggaggaacaagcacgggttcccgcgcggcttccgcttcgtgccccgggaccaggagctcctcgacatcctcgacgacaagctccgcggcgccccgctcgaccgcgcgctcgacgccgtcttccacgacacgcggatcctcgacttccaccccgccaagctctacggtagccaccgcctctcgatccctctccccctctctctctctctctccttcttcttcttctccggcgacgggctgggtgggtgctcttggggatttgattttgactcgggtggattggactggtttggggcgacgcagggatgtacgcggaggacgaggagaacggctacatctacttcttcagcacgatagagttcaaggcagccaagcccaagcagaagaagtggccgcggcgcgcggcgcagggcggacggtggaaggccgtcctcggctccagccagatggtggaggttggcggcgtccccgtcggccggaagctctccatggagttctacgtcaagggggtcaggaccaactggggcatgcacgagttcgtcaggatcatcggccccaacatcgaggtaaactccccatgttgtatctccttgtgatgatcgaattcatttggtctgatttggatgcaatttgtgcgatcttgagttcttgactcgtacaattttttctctgaactttcgtttcgccaaggttgcggatcttgccgtgtaccgcctacacaagctatggacgaacggcgaggagaagccgggagacctcgccgcggacgttgccaagagcacgaaccagagtggacaagcgtcggcggcggactactaccagacttaccagaacgcggtctctcaggcgtatgcgtatgcgccgccgtacgtcctccagccaggatggagccaagggtacccctacgatgtcgcggcggcgccaccgaccgcgccctggcctgtctgttgggcgccgccgtccgcgccgggatcctatgactgctgctacgcgtccacgttttcaaggccgccgccgccaccaccaattgctgcgagcacgctggacaaggcgccgataaccagtaccgaccacggcgcatcaacgaacacttcggcggcgacacccgtggcgaacaacaagccgccgccgccaccagttgctgcgacagcgaccacgctgggcaagaagggggagggcaagggcaaggcgccgacgaccaccagtaccgatcacgccggatcaacgaacacctcggcgccacccgccgcgaactaccagccgccgccgacgacgactacgccgccgctgcagggcacgcagcacgtcttcgcacccggcgtcgtcgtcgggcatgaggacgaggagggctacctcatcgtcgacgaggtcaacacgtggcgcaacacgcagcagctcgtgctcgaggatgacgacgacgacgacgacggccgtgccgccggcgccggtgcaggtgagggtggcgcttcagcctcagggcggtgacagtctgacatcagcagattaagagagaccctgaggcgtatcagttaatcatgcgtgtagttactagttaggctccgatttgagcattggaatttccagatttcccgactgcttagcttggttttgatctgcccgacaaatttccgccaaattcgtagtgttcaactgatcaacttcatgctctttctgtccgttggttattactttacttgttctacgtgagattgcaattctgatctgcaactgcttgtaatctggatgatcaatagctgcttccctgctttatgattgtggttttgctggttttgaaatgctcgagttaaattggctctccgtgccacttgatttggggtaaattaatgtttgatagatgaaccatacttttctaacatgggagccatcttttaattttatgatattgatatcaaagtgacatgcatattcatcaaaaagcttttttatgaaaaggtgacagaaataagtttgtggtggtgcgtgcctggttaaatcatgaaattttagctttgggctctaattgattgttcatagtccaaagtactattcagcaaggaaacaagatcactgaaattcgctccagtcaaaactatcttgggtgaactcaacttaggccctctttgtttaggcttataagccaacttataagtcgaaaagtctaagccaaaacaaacaagcagtttttttatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccttagactagagagagagagagagagtagctacaacctacaaaatcctagaatttcatgcgattaatttaagtgagcgcatgattttgtcaacatctcgatccatttgtcaatggactggggctgtgttcgggagtgagggttgggaatccactccctagcacgtaaaacgaagcagcgtttagtacatgattaattaagtattagctaaaatatatttaaaaaatagactaatatgattttcaaaagtaaccttcatatagaaaatttttgcaaaaaatacaccgtttagcaatttgaaaagtgtgtgcgtggaaaacgagtaaggtgagttgggaaagtgtcgacgtttgatagtcaccactacggtattaggatggtatggggatcgtcggtaccagagtatatacgagattgaagtaaaagagattgagacaaggatgtttatataggttcgggccccttatttgacaggtaatagccctactcctattggctgaagccggtgttgctcttattcatcataatcacaccagtacaacaattgagataacctatctatatgttgtcgacttggcggcatggataaccaactcgcgatcgacgacaaggtagtcttcctccttgagtatgaacccgtcgagatcagagatggtgctagatcccttttgccggcctccgttggcatcggatggggtatgtctaggctaatctctaatgtcgatatttggtggcatattggcttgtgtgtatgttgtgtcttgttggtcttgtggcttccgtctcccctctcctcctaggggagcttgtatttatacccatagatgtccccttctccaactctaagtagaactagaaagacaagtatggatacgattcgagtagtccttatagtatccatataaaactctatttgtcatttcttatccggaactccctctatatatgaggtatgattccgtataagacttggtatatggtaggccccgccgagcttagtcgattactattgggtatgtggtatccataaatctgacaaaaagtataggagtaccatgtaagagcatacccaggagctcatctatatttgatcctccaaatacccatatggtgtatcatccaaaaaagattcctcatccatatcccttttaatccaacagattatccatattacatcattcatatcccatcatcctatattttagtaatatctttcaactaatcttacatttgtattttaagggatatattttgaatgacttaattttaacggtgttgtttatcgcgataatattttgaaatgagtaaactttaacggatatatttttaatgggtaatttttaattgatatatttaaaatgagtgaagcattttttatgtgttgaacggctacatttccaacggctagctagctcattcaaattgtccaacggctagtacatacatgtaaagtttagctctatatataccactacattgcttgctatctttttgcaccatccacattattgtgcatagttcttactcaatgagcttccttttgagacatgttttattggatgaatcatcgtcatcgacgatgaaatcattgttgcttcaagaagatctagttaaacatctatggcaatttcatggtaggaactagtgtagtatgcaacctcccatttatgtagtaggcaagtctaattatgtatgcaacctcgtttacatatgaaatccatcaattatgtatgcgacctcatttatgtatgccatccatcaattaagtatgcaatcctaatgtatgcaacctgtatgtgctcacaattaatcatagcattcttgcatagtacagcataaaggtcacaaaacattaagttccaacaataaccattacataatacatcaaagcctacacggcatacaacataaaagttcacaacccattagaaaatagtaataaatagtacatatccatacatcatgaaatcaatccatatgagcctttatgatctcctgctgcaaacgcaagtaatatgtttttcttggcccatccatagcactaagatccatattcataattctttcttctctttcatgggtttctatatctaactttcgtttttctactttcaacctctctttctctagtgaaataacttcaaccaaccggtcatttctttcctccctagattgtgcactcatctcctttttctctgaccacatgttatttaatgcaataactacaggactactctcacttgagcatgaagaagtattacctcgcgggcattttgccttttccaccttcttcccaggtggtctcactaaaggatcagaggtattaatgtcggggctgtaatgaaattcactagagtttgtgcttgcagatggtctcactaaaggatcgacatgagccttctgtcttttctggaacaacctatcattccactttggatgatgatgcaaaatctcccaacagtgcattaaagaaaatgtcttcttctctgctgacttgtacaaagtaaaagcctgagttatctgcaataattggcaaagtcgataattggaaaaacaatatttttttaaagcaaggtactagctgaatgagatgcttacataatcttgaacaaccattccactttgaggtccattaagaatctgctcataatatccacaaaacttgttaacttgttcttgaatggtaccccaacagttgttaagtgaattttggttttgatctgaggggaaatttttgttttcatggaagtattgatgaatccttgcccaataagagtcacggtgttgctcaacacctgtgattgcatctaaagttgtattcagccaagctgacaccaacatttgatcttccgcagtgttgaaattttttgatcgcttattgttgggtctagaggaccctccaacttcagcacttggctgttcaccaaccataggactatgttgtggctgctgtcctgttgggggaaaattttgactaggatcccaattttctacatcaatgtttgaacccaacaaattaacatagttgtccatgtattcacatcatagcaacataaataaaatgaacataaaagcacagtacaaatatagcaacatgaatctaatttgtactctattcttattacttttctctactatgtgaatataaaatcaaagtaagtaacattccaatatattttctctccttctctgctattactacttaacattccactgtattttctttccttctcttctacttttcttctctaccttctttgctagtactactttgcagcgggatggccgataggcggcggccgagctggcaacaggcgacggcgggcatgcagccaaggggcggcggcggacgaccggactggcgagaggcaggggggatgcacgcgacggccgcggaggcggacaggcagggaagagccatggatggtcgggaagaaggcagccggcaacgggtgggtgagaggcggaggaggcaagcgacggctgcgcgcttggcaacagcggtaggcagctgccgcgggcagggcgacggcggaagtctgcaggcgtgcgcatggcgacgacggcagacggcagtcgcgcggctccagatctggtacgcctctccctctccactctcactccaccctccctctccaccatccgctgaaaaaacaacccaaaaaggtgcatggaggactcaccttcgctggccggccacgacggcgatggagaggaggtcgcggaagtttggataggggcgggagctcgatccagatgcggttgttacgatttggcgtgaggagagagacacgctatttttggcttttctctctctctgtttagcgcatccgacacttttagcgctttggatggcacatctcctggaccttgttttttcgctcctatacgccaaaatgcggatggagtagcgggtagcgtatgtcctgggatgctctgacagggaggtacctagtgtgcttatcgcctctgcacccgctctgcctctccttcacttggtacgccgtacgtgtatggtaaaaaaaaaaaagagtactagctggcaagctgctgtttgttaatgggcctaccccaatttgcgtgagggccttaatgggctcaactggcgcgcctcggaaagttgggcctcacacaggcccatatcttacggggaaagtaaagctacggcctaaatggaataacgtctttgcgccaccgttttcttccgcagctggccaactcgagccacctcatcaggaaaaaaaaaaagaaagagagaaaaaaaaaatctcgcctccctttcaaatacgccgccgcggccgcaaagctttcgctcggagcacacgcacgcgcggcgcgacggcgcgacctcgcctcgacacgagctctcgtgatctcgtctcgccgcgtctagctcgccggcgccgccgcgcgcgcgcgtcccctcgccgccgtacgtgtagcggagcgactccctctctccctcccgcctcacctccgggaccggtcggtcggtcgatcgatcgacggggcgaggggatggcggcaccggaaggccagaacaagttcgcgggcgtccgcttcttgcccaaggacctggagctcctcgccatcctcgacgccaagctccgcggaagcccgttaggccccgtggaagccatcttccacgacacgcagatcctcgacttccacccgtacaagctctacggtatccaccgcctcgatcgatcgatctccctctctctctctctttgtcgatctccttcttcttctccggcgacgggtgggtgcctggatcagatcatgcagttttggggattttgattcgggatttcgggtggatattactcgactgattttgcagagatgtatgctgaggacgaggaggaggaaggctacatctacttcttcagcacgatgcagttcagatgcaggaagattgtggagcgcgcggcgcagggcggccggtggaaggtgaacaactgcgagactctggaggttggcggcgtcgccgttggccggaagttcaccatgaatttctacgagcatatcggcggcgacaacgacctcatctggaccaactggggcatgcaagagttcgccaggatcatcggcccaaacaaggaggtattccattcggaaatccacttctgaatcttcgttcaatgatcggatacatttgatctcatttgggtgaaatttttctgatcattttggccaaaagctcgcggatcttgccttgtaccgcctatacaagaagaaaataacaagggggacaggcgaggagaagccggaagacatcgccgcggctagcgatggcgataccgagagcagcatgaacaagcgtagacgtgtagaagcgtcggcggcggccatggcgctgccaccgccaccgccatcgccaggcctgcctggaacaatgatgttcatggcggcggaccaggcgaacgtggcctcgacctcgcaggaatggcacggccagttcgccaacggcgctgcggcggcgccgagtcctagcggctgctggccctgggcgccaccgccgacaccgagcgcagtggagcctttcagcttctgggccagcgcgtcggcggcgactcctcctgccgccgcgaactaccacccgtcgccgcagccgcagccgctgccgccgcagggcggcgagtactactccagacacggcgccttctcggtggcgcccgtgcccgcgtccgcctgctcgacgccgtccccggaggcggcgaccagctgcctcttggctacgacgtcacctctgccggcggcaggtactgagggcagtgacagtcagcagcaagaacccccctgcgaattgatggaattttgaaattttggcgaattgcttatagctgattctgatctggccgacaaatttccgtcaaattcgcagtgttcaacttcgtactctttttctgaccgttggctgttacttcactagttctacatatgtgagactgcattgttttttgtactagtattaatcttggtgatctgttgttctgaaatgcttataaattttgcccttgtgccttgaagaatttgctatgtgcgtcacttgctttgatttgggatgaaatgtttgatgaacaatcatttttaattaccacatgcataggagcttcaggaagggcttgaatttgacagttgctatgtgtttagccatgatgcatgtagttttgtgatagtaccaacgcgggatattcataggatttttgtggaggttcctgttaaatcattgaattttaatttggaggctctgaagtgttcatagtccaaaatactgtcaagtaaattcaagtgatgaggtcatgactttaatttttcatagcaaataactagattaatagaccggcatgattttctctaaaacaaaatagttagattctgtttctggcaaggaaacaagatcactgaatttcgttccggtcaaaaccatgtagcttgaactcaacttggactctagagagagaaagagatactatatcatgcaagatatagtagatacaacctacaaaatccaagaatttcatatttttcatacaatgtaagtgagcgcatgattttatcaacatctcgatccatctactgatgaactgaagatatgtagtaccagctaacagggaggtgctcacgctggtcgcctttgttctacagctcgaaataaaaaaaaaaattaatatgtaccaattcttttgaaacgtgtatattttcttaaaaccggtggaaaaaatatttccaaatcttatttgctgcagctctgcctctccttcagttggtacgcgtatggtcgaaaaaaaaaagacagtactagaaacagcggtttttaatgggttgagcccaattttcctgatggacttaatgggctcaactggcgtccctcggaaagttgggcctcagataggcccatatcttgcggagaaagtaagcttctcgccgtgctcgtccacattccgccagctggccagctcgagccacctcatcaggggaaaaaaagggaaaaaaaaatctcgcctctccttccttacaaatacgccgccgcggccgcaacccgcaaagctcggagaacgcacgcacgcacgcgcgcgcgcgacacgcgacgtcgacacgagctctcgtctcgccgcgtccacaccaatcggcgccgccgtgtagcgaagactagctagctccctctcctccgcgagaccggccgatcgatcggggcatcgcgcgcggcgcgcgcgggcggggctagctgggcatggcggcaccggaggatggggaggacaagaatttcgggaagaacaagcacgggctcccgatcggcttctacttcgcgcccacggaccaggagctcctcgccatcctcgaggccaagcgcctcggccgcccgctctcccgcgcgcacgacgccttcttccacgacatccgcatcctcgacttccaccccgccgagctctacggtatccacccttctccgtctctctccttgtccccttcttcttcttctccggcgccggcgaccggcttggtggtggggatttgattcgggtggatttggaatgatttgggggcggcgcagagaagtacgccaaggacgaggagaagggctacttctacttcttcagcaagagggagttcccgacgagcagcaagaagcggccgctgcgggtggcggagggcggcgcgtggaacagctccggcgccgtttacaaggtggtgaagagcagcaagtccggcggcggctacgacgtcggccataagaaaaccctcgtgttccaccagcgtttccccggcgacaaggaggccgtcaaaaccaactgggccattcaggagttcaccaggatcatcgggccccagaacgaggtataaatcaaaaatcaagccacgatttattcccacatttcatcttcttgttgtgaggattgaattgatcgagttcatcttgatctcattcgggtggtgcaaatttgtgccgaattttgactcagagttttcttgaactttaatttgccaaaaggttccggatcttgccgtgtaccgcctgtacaagatgaggaaggaaggcagggagacgcctgcagacctcgccgccgacgaggccgcggccgcggcggccatgaacaaccgtggacaacaagcgtcggctgcggccatggcgctgccaccgccggcgacgggcctgcctgggggaaggatgatgtccatggcggacaaggcgaacatggcctcgacatcaaaggcgtacgggccgtcaaagtcaagctcatcgcaactccagcaggatgcggcggcggcggcggcgccaccgaacgcagcaggggctagcaactgggcgccgaggccttgcaactgccgggagtgcgcgccggcggcgggacactatggctacttcgcggccgcggcggccatgaacaaccgtggcggacaagcgtcggctgcggccaaggcgctgccactgccggcgccgggcctgcctggggtaaggaggatgtccatggcggacaaagcgaacatggcctcgacatcaaaggcgtacgcgacgtcgcagtcaagctcatcgcaactccagcagggtgcggctgcggtggcggcgccgccgaacgcagcagggcctagcaactgggcgccgaggccttgcaactgccgggagtgcgcgccggcggcgggacagtatggttacttcgcgtccatggttccacggccgtcgctggaccggaagggcaagggcaaggcgccgatggactgtgccgagcaggccggcggcggcggcggctgtcacgcggagtcaacgagcactccggcgccgccgaagggcgccgagtactacggatgcagcgtcgccgtcgaggatgatgacgaagaattgctgaagtttctgcaggcgatggtgaggggcgaggaggtggagggtgatggcgaccacgccatggccgacgagcgcggcccgcagcagggctcctccccggtggcggcggcggcggcctccggctccgcgcctgcaggtcatgacggtcgccgtggctcgctgcagggtggccaccatggatcctcctcccccacctcattggcggccgccgccgccaccggcgacgacgtcacatctgccgccagtgcaggtgacgacgtcagtggcagtcagcaggaagaccaccctgcgcgttgaacactgaaatttgaaatttgaatttgaaatctgggacaaattttcgtcgaatttgcagtgttcaacttcttactcttttctgatcatttggtgttgttacttcactagttctatgtgagagctgcaattctttactagtaatcctggtgatctattgttgctttacgatggtgatttgcttgttctagaatgctcgagattatatatttgttttgcctgagatgaattggttctagtgtactgtcactgatttggtatgaatgtttgacagatgaacaatcatatttaccatatctgggagatggatgaagggatttgaattgactgcttttatgctaacctgtagttttatgatatgaaagtgatatgcaaaagccatcctgtagttttatgaaatgtatgaagcagaggtctaagtttgaaatggacaaactgtattctgtatttctgttttaagcttatgtctctgtgtaataatggtgcaattgaacaaatgttgatctgcatagatgcaagtcttgatcactattttctgtgtggtgacacatggagcaattcttgcaccgtactactttaggcttagacgctttctctcaaaatatcatgttaatagttatgcaatattctcaaaatatttggcaatattcatgtgccacccgaatttcatatctaaactcaattcaccagagagaaagaagagacaaatccactaaatgaacaacaatgcttaaatactatattcacaccatggagtagtgtatgctggtgtactactcagtatcagctagtgcaaactcatggtaggagatcactgatcattggttacagagagatatttgatcaactcagaagatattctagctatcaaattctagattttacatgcaagctaaggccagtgcgtctgtgcgtgcatgattttgtccaaacactagatgctgctcctatacatgtaaaacatctagatcggccttcaaatgggccgggcccaatttgcgagagcaaagtaagcccattaacacccaactaaacacgtcttaaatcacggagacgctccattgatgccggccaaatcaatcgctagttttcacaaccgtcttacggcgatggccgccggcggcggcggcggcgacgacgaccaacgtttcgatctccccgacgaccctcctcctgcgcatcctccggctcgtcccatccaaggaggccgcgtcgaccggcgcgctctcgcggcggcggggctcgctctggcggcgccgtcaacctcgccgcgcgcgtctacttcgacggcggggtcagccgcagcgtcagcctcgacgaacgggaggaggccttctcctcccgccgcgacgccttcgtccgcgcctcgccaggcggcgttcgcggcggccgccccgccggaggcaacggcggctgccgcggcgtcaccaggctcaccctcgacgtgcaggcgaactgccctgcaactccttgatctccaagttcctgaacaatggcggcgagacgacggcgaggtggacgtggttgacctcgtggtctcccaccctgcggcgcgccgcgtcgaggatctccgcgtccgcgttgtcccctgcaggtaccgctcctactccgacgacgacgaggagaaagaggcgagatgagacagcggcgtgtacagcctgtcagcctcaccgtcgagtccgcgtgctggacatcaccgggtgcagtgcaccaggctcgctctgccgtccgccgccgccgccgcgttcccgcgccgctgcgtcgtgcggctctggcatctgcagcgcctcatcgacgccgcgccggggctcaccacagtgcacctagagtccgtgtccgtctacttcgacttcggctgttcggcaaccacccctactagtactactacgatgacgacgaacaagactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagcacctacgacaacgacaacggcggcggctgcatcgcgatcgacgcgccgaagctacgctccttgcacaacctcgagtcctcgtcgccggcaaggcgagacgagagccgagcacctccgcactttccccgacctcgagcgcctcaagctagtaacggaggcgcggctgcccgctgccggcgatgaggacggcggcggcagcgatcgccaacctactcgatccgttgctgcccttctcttcgagacctcagcctcaagctcgacacgttgcctacaccatactcgatgtcatttcatgcacaattaatttcaacaagatttcgacaagtccattggtcccttcacacgccggaaatggatgccggcgacggcggtttcattatcggcacggcagcaatggtgatcgtcatgacgacatccccgcgcgttgagtgaacgatcgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaatgtaataaacagaggtctacgatgaaacaaaacaattcttttttttttgtttgtttctaaagcctatgcgcgttgagcgattctttcaatttactatagcaggcctgaggcaaaaaatatactataaacattagagtttaggataaggttcggtccaaaatttaaaacattgatcatcaattttatattagaacaagttcagaaaaaaaaatctaataactttacgatattacgataatacttttcaaggcaattcacatataccattaaacttaagcatctgagaaatcattattggtcaaagttttaaaagtttaactaaattttatcttaaacattaaatatttatgtatggagaaagtatcatgataagtaggagtaatagacacatcaacatagttttgctacaaaaagtactgcaatatttttttctttacttcacgctttttcaccatgtgattaattgctaactctacctactaagtagtaagtatatgttcgtctctctcttatctcttattttttgacttccatttttcattttttaatttatcagtccattttgcaccgttaattttcaaggaatctagtagacaattaattatttatgtcctagttctcactagatatgagtactagaaaaacataggcttagttcggcatcctgagttcccaacccatctccctcgtgttccgcgcgtgcgcttttcaaacaaataaacggcccgttttttacaaaaagtttctatacaaaagttgcttaaaaaatcatattgatccatttttgaaaaaatagcaaataattaattaatcacgcgctaatggaccgctccgttttccgtgcgcggaacatatgtttccaactagcagcagcgaacacagcattagtcatgtgatttgcaattcatagttaaatatataaaattccgtgtaaaataatacaatgttaaatatatgctgaaaaatttgagttttctattttctccttgagatacttcttcttttaatttacctttttttattggaattaatgtttttggactagttatttttgttttgtttttattttggatcatctaaactctgttttgtgagtacattagcatcctcataccgacaatcatcctttttacgtgcaactcatcgtcaagaagagtggttgcatatgcctagataaacgcatttgggtggtccaaagtgcattaaatgaaaaaaaaaagtaccaatccaaagtgaaaaagattcagtacagaatggtttaaagtaaaacagagaagctaatggagtagcgcactgtcttgctcagcttgcaagacggtcgaatcagtagatagtgtggagaggggaagccccaacgtgtgtttctgagcttttggctcatgattgtactcctaatacttgattaataaagctctctgtttgcggaaaaaaaaggggagtaaaacaatcggtaatgtttggctaatagaaatgggaaataattttccacttaccaaaagacatctttaaatcctaaccatttattccccctcttccatttaatcctaaccctttattcattttacaatcccgatcctttccctattttccattatccaaacacacccattgggtaataacaaccggtgcaaaagtgcgattcattccttttcaaaatgggtgtaggcacaagtaggtacagtatgtgactacgagcccacaattacccaatgaagtttgtcctgtttttattgagttgctataacgcctccctactttgaagcatccatgaattatccaatcctagggtattacagtgtacacttaatttcaagtagctagcatgccaagtggcagagtagtcaaatcacctctttgttacctaacctacgtaccatgatatggtactcctaagagtgacatatataacacatgctaatctcaaagagaaaaaaaatcgaaaggattggatagaagctttggccgttgctgggcagtttcggcgatccatccggcacgtatatacccgccaccactctacgcacgatagaattgcaaccaacgacactactaaagtactaaacgttaacttgacccaggtcaacaacgtgactgaattaaaattttataatatagctgaacttggaccccccacgttaacacacggagcagtagcattgcatctatcagcttaaaaatgttagatctgacggtaatggtgtttactttgaaagataagcatggaccagaagagtaatctagtcgtcgatagcaattagcaaagggtcgatcgaagctagaatatatatataatatataaatgacacttgatgaatacaatgataagcatattttccgagcgtcttcgttagctgttactccctcctgcctacaatataatataacgattttgagtttttatttgtaacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgccctcgtgatcgccgccgccgcccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatgaatcagtttatatgacattagaaaatggccgtaggaaacagacctgatcaactgactttatgctttatgctttatgcagtttgcagttgtacctgatatgtaagcgatctctctctatacttaaaaattagtaaaacattagacttgttcactttgatgccaaaaaaaaccttaccaaattttggcatagttgtcaaaatttgccaaaattttgataaaatttcttatatagttaccaaaatttggtagcaaactaaatgtagccactttttttggtaactttaccaaaatttggtaaggttgaaaatggcatcaaagtgaacaagatcattgttatatactccctccattctataatataaaacacaactatttttttaggtgttccataatataaggcatgcatgtttgcatacaattaactaggacatcttctctattaaattattacttttttaaatcctccacccttaagatctctaattgtaacatcttgggtatttagctatagtattaatcacgctaatgacttgatcacactggctgagagcggtattgattgagccacgattctggctaggacctataaatatgttgattgttgttctattatggatcttaaatgatatttcgatcgttttcttgtcatttatttatcaagtcatatccatatgcatcattgatttattgttagttagactaaatctgttgaggagtgggataatttagtttcgatcaaactatacgtagattagttgtcacgaagctaggtatacatgcacagtagaaatcagaactgaaactatagtaaattattcacaaactatttggttataggttgcatacatacatacgtacgtacgtacgtacttacgtacatacatatacagactggcatacatccatgtgtacacatattcattataaatcttatacgtatgcatctcatatattgtgcagatacatggtgcttataaatacaaactgaactcatacgctctgcattcaagtaaaaggagaaattaaatgtattaggaaatgtttatatgattttagaccgcacaatttctatttaggaggttgcatatttaaaactttagttgtagtagcaataaaggaatttttgtgttgtctcaatctacaaattttgcatccaaccaaataggggcacaaaagatgtagggcctgtttactttgatgccattttcaaccttaccaaattttagtaaagttgctaaaaaagtggctacatttagtttgctgtcaaattttggtagctatataaaaaatcctgccaaaattttggcaactatactgaaattttggtaatgctaaaatttggtaaggttttttttggcattaaagtgaacaggcccgtaaaccgagccatctcaagccaaattccaaaattatccatttttgcataaaactccctgaattctagggcaattattaatcggtcccttaactctggagtaacctccaaaattccaaaagcttatagactagaatgcaaaattactaagtattccaatttcaccagatttccattaaattgtaaattagtgaaacctctcaaaattaatccaccgaacatgtcatggtgaggtgtcaatcaaggaagcagccaccaaacaacaagtaagtgagtcactggttaagttccaccaagttaactagttcagtgtgaaaccattcattccaaccaagcaactgtatcgtcgataccaagagactgttcactttaatgctaaaaaaaccttactaaaatttagcatagttaccatactaaaattttgacaggatttcttatatagttattagtaagattgaaaatgacattcagcagtaggcacagcagtagtagtactaccattttctactgcaaagagcagcagcggcagcggcagatcgccatagtggcagcaacattaggggcgagtagcagctatgaagaacaacagtacaagcagtagaatctcaactggagtaaggcagtcttgactagaaatcagtagaggttagggagataaagagatattcaaccagaaattatacacctcaccaacaccacagctcaaccatagtatccacagtaaagcaacttggtagagagaaagagagagatgaaccaaatctgaagaaggagaagtaggggtgttcggttcctgcatgaacagtgatttcagctctaggaggagatggtacttcagctcaagaaacaagatggatcagtaacagcagaagcaggacaagaagaaaggaggagaacaggcaactgttgtaaattggatcaggaggtaaaatcagcaagaacaagaaatcagaaaaatcgttagcaagggtgcaaatcaagtaggaggtacctgagcttcaagaagagaggggtttcagtttctggaggagcaggtggtgcttcagctcaaagaggagaaatcagagttccatcaggagaacccttgaatcagagtccagaagagtagctgcagaaccagagttccctatatcagtcacctaaaatcatggcaggtaatcaggagattgaaatgaaagtacaatcatatcatggcatgattcttgagtgatgcatatactagtatgtgtaggagttgtgagttgcatttgcatccattagaatatgaacaagaaaattaagtaatttgtgaaggataagtctttgtagtccttggtcgtggttcttcctttgcttttgggtagtttcaccttttaaggacagcatctactcctttagcatactttcagttgctaggacagctgcggttagtaggacaacagcagttagcatctcctttatgcctcatttatactttattcagtttggatgccttctaggacagcatcctattcaaatttcgaattttagactagggtgcagcaataggcttacagccagctatggctatatatatgtatccaacctccctcgggtaggtatggctttgagtttatgaataaagaaaaccagaaaattgccccatcctaagtgccatcctcttctcaatgagagtaactattaaaattctaacaatttgagctgtagagtaggaggtgtaactagtaggacataaatatttttttatttaactgataagtaaataggttaatgttagtttataattatttggggttagtaacaagaaacattttagtttttctagaatcattatgtaaatgcatttaggtaaacagctgcgcatgcatttgtttggtgaatcctgaaattataaatagttagaattaatgagtagagttataagtctctatagcagagcatctagggcaaatgattctagattagagcatggcatatattagttctgtaagtattacttcctccattttataatgtaagactttctagcatttcccacatttatgtaaatattaatgaatctaaacacacatatatatctagattcattaacatacatatgaatgtggacaatactataaagtcttacattataaaacggagggagtaatcaatataaatcgtattccactgtgagaaacattagcagccttaaaaatcaaccaatgcattagttcttaatattagtgatactgaatgtataggattactctggatagcaagtgcacaggtatatctttagttcgaataaacctaaacttatgggtctctacagcaagtcatctagagaagagcataatatcagaatctaaactttagtagttgatcagcataaccttgctaagaccaataccataaacaccattatttaactgtgatttcagtagtaagtatactttggcatcaagatgaagatttataatttctaggtcattaaatccctcaagtgatactaccattatgcatcatgtatgaatgaaatcatattaatcctctagattactattcagcatggcaacataaggatctgatcatgttagtttattagtttgtaacaaattttaatatttagatgtgttgctttttctaatacaaggatctaaatcactaatggaaacgatagagagcaagagaatagagtagagcaaagaagctacattttcatatattacataagccgtagacaccatttacataggggtatatgtccttttataggacttttaggtcggtttctacaataagcgacccgctacaatagcatgtttttacagctcatgttacagctcatctaatagcacaaaactagcttgctaccaagacagacgtgctgcttgccaagcacaagcagtaatgaaactacctgatacagtgtacacctttgctagctagtaaaatttgctttgtatacttccatgccaacacaacaaagcatataactcacttgtgtattctacagcccattatcactcatttacaactaaggttagctaatttgtgctagaaacttcaagcagcaacaagcaaccaacttgaccaactagtagtcaaatccaatttgactttgttatctcaagaacacaaattaatttccaacattctcccccttaatttgtattcttgagatcttcactttactccggtcgcttctttatacttgatgagtgctcacacttgatagtcagtaggacacatcttcaacttgactcatgtgtttgcctgagacggtgacgcaacttaacacgcctcgaacaaatactcattcagtcagtcggtcacatcttcgacttgccaaactccctcaacttcaagatgggtagtctgtcgcttctacgacttgccaacttgaacaaaacacacattcacgttgtcctagacacaactcttggcaccaattcagaacggtgaacatatcttcctcaacgtcctggactcaactcttggaaccaatataggactacaaacacaaactagctactactcaccctagacgcaactctcgaatccaattcaagacgaggagcacatctacctcaatatcttggacacaactcttggactcgaatcaggggactcttaactcaggatggcgtcacatcttctcaagatccggagtatcatcttccatcgattctagacagtgactcaacttctcatcttcccagactcatctaccatggtattaactctacaatcccaattcaaaatggtgacacatcttcttgtggacacacattcacaaaaactaacacacaactagctggtatgtatatggaatcaactacatacacataccgagatgacggttcaacaacatgcggtttgcacctcatcatggagccacatgctccgtactaggcacacaccaccgcacaccatctcaacttctcacaagttgttgccatcggcctcactgccacaaccaccatgacgataggtgccactccacagcattgtcatggtgtcatcgggggcgtgctccttacctccaccactttcttgctcctgctatgcccaacttaaaaacaaaggcttgaactctcaaatcttgctctatctatgcctcacctgaactaggctctaataccaattgttgctttttctaatacaaggatctaaatcactcatggaaaagatagagagcaagagaacagagtagagcaaagaagctacattttcatatattacataagccctagacaccatttacataggagtatatgtccttttataggacttttaggtcggtttctacagtaaccgacctgctacagtagcatgtttttacagctcatgttacagctcatctaacaacacaaaactagcttgctaccaagacacacatgctgcttgccaagcacaagcagcaatgaaactacctaatacagtgtacacccttgctagctagtaaaatttgctttgtatccttccatgccaacacaacaaagcatacaactcacttgtgtattctatagcccattatcactcatttacaactaagcttagctaatttgtgctagaaacttcaagcagcaacaagcaaccaacttgaccaactagtagtcaaatccaatttgactttgttatttcaagaacacaaattaatttccaacacgatggtcattgcataagcataattaaggatttaatcatgctagagtgatttctattttagtaatgcaattcatagacctattcatgtcagcattcattcatcatgaacatataggcatcatccatcttagcaacccaatttctctagaaccctagatccagtaaatacaaccctaagtataacatcatcaagtgaatcattaggacaaattcacaagcatcaccagtacatcacaatttacataacaacaccatacaagagaggacaccacactagtatatcacaatagggatcagagacgggaggatggaataggtagctcacctatggagcagagggatgcagccaccggagttgcctgtgtttccaccggccatctccacggtggctgcagtagcaggagaccggcggctggggttagtttaggggcagagaagcgaggatccaagaaaccgattcaggccggcgacggttgcggggcggtggctagaagggtcgccggagtggggtgtggcagcaggcgcaagggagagcgacggcactgcctgggaagcggcggcgctgggtggagagcctggttatgtaatctggatgatattctcaagtttggtattgaacttgtttgttctcaaatggttatatgtgcattatgggtacatgctaccatttttttatctatgtcaagtgctttcttgacttgtgtcaaatgctctacaaattgcaaggtacatgttgccaaaatttagggtacatgctgtcaaaattttgcttacatgctgtcaaaattttgccatcggagcaacagtttatgaatacacatatatacaatacatgcagcaatatatgcagcagttatatgcagcaatatactccctccgtcccataaaatatcgaatcctagaagcccgatgcacttttagtccaagcggtgaaagatcaaaatacccccatcaagtacaaccatgattagcacttttgttttgaaaaaaatctctgtgaacactaaattgttcccagccccttcctcgatacccaggcatcccaccaccggatgttcgccgtcgatgcatcactgagtaatggtgtcacctgcatttgatgacaacgccaaataccaaacgcatcaacaccaaaaaccagcaagcctccacctttgccatctggatcgtgcatgaagccacgaactagcaagtaccaacaacatagaagaaccaagaacatgaactagcaagtaccaagaacatagaagaaccaagagccgagaagaaccaacaacagagaaaaagagatactacaagaactagcaagaaccccgacgcatgaactagcaagaaccctgacgaggccacgtccgctggtcgccgccgccgccgccgatgccgcgtccgctggtcgccgcagccgactaggccgtgtccgctcgttgctgccgccgccgaggaggccgcatccgcctgttgccgctgccgccaccgatgccacgtccgctggtcgctgtcgccgacgaggccgcgtccgtcgtcgcagccgccgctgccgccaatgccgtgtctgcttgccgccgccaccgatgaggccgcgtccgctcgtcgccgcggccgatgccgtgtccgcttgccgccaccgcccccgcagacgaggccgcgtccgcctgtcgccgccgccgcccccgccgtcgaggcggcgtccgccgccacatgatggtggagcgggagaaggctgaggagtagaggagagagagatggggagaaccgctgggtgggagaggataaggattgagcggtgtgaactgaacgcgaggagagagaggccatgggcccatcgatgtgctcgagacgacgtttctcgttttgtgcgcaggagtcagttttttgtgggacaaactccctcccctagaattcgactttttgtgggacgaagggagtatgccactatcctgctcagagaagaggaacagcagggcagcaggcgtcctgcagtcctgctcctgacgccattttgatctctatggcgagagaggcagagcagcagccagcacgcgctctgcctccccttccccccttcccgatcccgatccccttctctctgtatccctttccctgacaagtggggccaggggtaaaagagtccgaaaagagaaggaaacaacagaaaacgaaaaagaaaaagagaaaatgatggaaaagagagaaagtgatatgaaatcaaaaaattagcactcctagtagtgtattagagaaggcatgcggattgggtggtaagtttgcaaaggcgcacatatttagtggcttattgtcaaaaatctcgtggagagggtgagggagaggaagaagaacgagagaaagagagaataggaagaaggtggtctagatgggcttttctgttaggctttgacatgtgggctgtatatatgtgtactattgaatttaatgactattgaatataaatctctctcaagtaaagtaaaacttctttcaattaaaataattactcttttaaaaataaaaagtgcaatgatgtttgttttaacactaaatattttagtccaaaactaaattatgttatataaatcatagatctttaccaaatcaaaacatacaaatatatttaaccatattcaacttaaaaatacatatgggtcatctagttgagtcttgaggtgagagtggataacctatagtgttgtagattagctatgatattaaggttaggcatatcatgtgcatcgcattcatataaacattctcgtatttagttgtgttttattgtttctttcagtttggcgtttatcttggatttcttgggattcttcattaatttattcgtcttcgatttcaggtatcttaggcaagtccaacacctttgaccaactcttgttctattttcgtaattgcaatctatatgtatcacattgcattaaattatactttctatgattaaaataaatatgctgatggattggattgactggtggagcagtcggtcatattataggtgtgttctgaacttgccatggtggtgggggttcagttacatatatttatcatcataaggttaaacaacaactgttatatggcattcaagcgccgtagcgatcgtggcaaccacatgacctggaatggaacaggctagcttagtagttctttcttaatggctttatcctgcgggcttaaggacttccgcgaatcccatgagcgtggcctagcgatgagggttgccgttgttgcagaatccgattagatgatgtggatcgctgttgttgcgggatcacatgattcgccgttgttgcgggaatcacctgcagagataattgacagatgggattgatgaaaagcttgtgaccttagccttgccagcatacaccatgaagtgtgcttcaagcgccgacaggcgtgggcattaaaaggtttaaggcgtctgtgggtacagcgacacacctctgcagagtatatgaattatgatatgtcactccgacactccctgtttcgggtagaaactgcgaacgcggcaggaaaggaacctatcggaggttctaatacctgtggtgccttatatgcaatagattttataattacttaatatgagtttttactacactgttttatgaacttgcataaaactacttgttcgattatgggatttggagatatatatattatgcaggtgaattataggcatgtatttgttggattgctatagttgtacttgttgagtaccattcgtactcatcccttatatatattattccttgtagtgttgagctaacaattaggtgaagaaatgttctacatgattgatcaagatcaaagcaaagactcgttccatatctctacatcaactgagagttgaaggtcacgaagatatagaatagcaaggtattgttagtgattattttagcaaaagctaatttctttagtttttatttaatggttttcgctacagttgtttctgttatgctactctggtgtactcatttcttggtaagttggttcttactaaggaatgagccgtagaccggtattctaccccggaagtagaatacgagggtcactacactaattctattggatgcatgcattatatttattagggtaatctaaactaggggatgataataattgtttcttgatctttgggctaagagtggttgtgccttatattttagaatggaggaagtactactaatgtaaaagtaattataatcaagcggtttaccatatttgttgggacaaggactactccctccaaagactttaccagatcttatcccaaaaagtcaaatacttataactggagggagagggaccgagcgagtataagaaaatgacagagtacatggtaatttcacatagaattttttctatcacaaatcggactcgctcttccgaagtttggccgcttggcaatttcggatgtagatagtcatatatctggcacacacccaacgtacacgtaaagataatttgaccgaggtaaatagagtagaccgtgtgtacgccgtcgacttaattagatattcatctgccagtgcctcacaaagttcgtaatcaaaattgttaaatattaccacgtttgcagatgaaacattacatcaaacacaaaaaagagcttgatgttctttttaaaagctataatcacatatactaggtacatcgaagtgcgtacgcgcacgacacaccgatatttgtgcatgtattgtaaataatactccctccgtttcagtttacaagacattttaactctaatcgaagtcaatctgttttaagtttgactaagtttataaaaaaaatagtaacattttcaaccaaagacaaatttgtcgacgtttgatgtcgcgattccggtatttgcatagtatgaggattgttggtactaggatatatgcgagactgaggtaaaagatggcgacgaggatttttatacaggttcggacccctgaattgtcaggtaataaccctactcctgttagccgaagccggtctttgctcttattcatcataatcacaccagtacaatatttggggtagcctatctatctattgtcgacttggcggctataaaaccatcccgtagtcgacaacagagtagtcttcctcctcgaatccgtgtccggcgagatcagagacagcgctagatccctcctgacggtagtcgtaggaaccgtatagggactaactatgcttatcaccgatgtcgatatccggcagcttgtcttggcgcatgttggcttgtatgttgatcttgtgtcttgatctattgttccgtatcccctctcctcctagggggccttgtatttatacccataggtgtccccttgtccaagtagaattaggaaaaccaatatagatacaatccgagtagtccttatcgtttccatgtagaactctattcatcctttcttatgcggatctcctcctatatccgaaggttgtttccgtataagacatggtatgtggtggatcctgccgagatttagtcaactattattagatatatagtatccataaccttgacaaaatttattatgaaaatatattcagttattactatatttatctagaaacttagtcaaacttaaaacaatttgactttgatcaaagtcaaaatgtcttataacataaaacggagagagtataaaaggaatatagaaaatatgatacaaatacaataaattgggatgacatctttttagtgatagaagaaatcctacctatatatatccatatgaatatatttagagttagagtaatatgtagactctagaactaatgactgagaaacaataacatacaaaatgagaagacggaaacactaagtttcgtatattttttcgacttactccaaacttgctcctttattattatgcattaataaccaaaacgttacttgtttatttattagaaactttgatgtcgaaatcatcctactaaagatcaatcttctacaagaaatacttttttaaaaaaaacaaacgagactttttttaaaaaaaaaataattgtaatgacgtaggccttgtttagatatcaaattttttttacaaaaacgtcatatcaaatgtggacacatgcatgatgcattaaatgcggggaaaaaatcaattacacagtttgcatgtaaattatgatacgaatcttttgagcctaattacgccatgatttaacaatatgttgctacagtaaacatttgctaatgacagattaattaggcttaataaattcgtctcgcagtttacaggcggaatctgtaatttgttttattattagtctacgtttaatacttcaaatgtgcgtgtatatacttcaaaaactttacacgcaaggaactaaacacacctgtaaataacatgcgtctaagtaaattggcaaaatttgctacatgacactcaaaaaagtgtaattagctaggagacaccgtaaaaacgtgatacggctgatggacactaaaaaattgtgtaattggctataggacaccagaggcaatattttataactactgggtcaaaagaggcgagaaatttttcaaaatagcgaaattgcccctaacacggagcgccgccgcagccgcctcacgcgcggtcacctgctggtcgcgctccacgccatcgacgtggccaccgactgccccccgcgcggccgcctcctgctcgcactcctcgccactgctgccggtctcgcgcacggctgcctcctattcgtgctccatgccaccgccgtgaccaccgacgactaggaggacgat

SEQ ID NO: 81908 - DNA, 7559 bp, Oryza sativa
acataactaacagctgagattttcattagttgaactgttatcctgaaggacctagacccattgactgcccatggagtctttagtccttagaaatgcgtagtgagtacattttattgtctaatagcatcaaaactatgaaattgagactatcgatctatttctgctggacgagctattgtatggctagaaaaatcctggttgtttggggtgatcctgagagctgaatttctatatccaaggtagaagtggttgtggtgatagtataaggtagcatcataatttgccacagaaaaccttgcaatctcttagctttcaagtccgtatgtttataacttatgatatactttttttttacttttgttggccattgcctatctctcatgactcatctctgggcactaacctcttcatcccatacttgtgatattcaattacaggttggaagtgctctgtcagatccttatctttcttttgcagctgcactgaatggtttagctggaccattgcacggcctggctaatcaggtatatgctcagtttgttgcactggatcttgtttgccgcatcctgctaaaaaggactcattgcgctattcaacatatgctgcagatcatttttaaatcgatttttagtttgtgtgaactgaccatagtcaacatgtaatgcaggaagtgctgttgtggatcaaatctgtaataggtgagacaggtagtgatgttacaactgatcaactcaagagtatgtgtggaagacactaaaaagtggaaaggtagcttatctcactgttatatctatttgatgaggaagtgcatatatgatcgtgttttaactgcaaatttattttctcgggaagtttgaaatgaaaactcagctttctaagagttaattgctaagcattttgtgttatattggatctctaatgatctgcatacagttttaccttattttttgttgaacatgaattgagaatttagaattactaaggtcacagcgcattcatttgtaggttgttcctggcttcggtcatggagttctacgtaagaccgatccacgatatacatgtcagagggagtttgctttgaagtacttgcctgaggatccacttttccaactggttagtctaaaatgtctgtccaactgcatggctctcttgcagtccaactatctcattgggattcttatcgatctatatcctgtcaggtctccaagttgtatgaagttgtgcctccaatcctcactgagcttggcaaggtaatgccactagattgatcatgattgctaccgttttatgtccatcttattggctaaaaagtgacaacattgtccatatttccaggtcaaaaacccatggcctaatgttgatgctcacagtggagttctgctgaaccactttggattatctgaagctcggtatgtttacctgtcctggttaaataatttagtaaccaaatttaatcttgaacccatgatggaatagtaaatgtacttcagaacgagtacttaataaaagcggccatctaattacgcaggtattacaccgtccttttcggagtttcgaggagcataggcataggatcccaggtatatttcttcccttcaactgtctacctctttcttcagatcttgtatcaaccaattctgacttgtgatacattatgtatgacagctcatttgggaccgtgctcttggtctgccgctcgaaagaccgaagagtgtcaccatggagtggctggaaaaccactgcaagaaggctgctgcttgaagctacacacgcctacaccgctgctgttaattcttctaacaattatcatcttggatgttaataactgaggataaactcgaaacgttcagccacattttaatatttttttccaggccaataactagaggaagatgctctcgatcggctggtacatttttgtagccatcgctgttaggatgctcatatagttaatctgccattgggcaacaatgtgattagtttaagttgcttagagctttatcctttgatgaataactttttcgagccttctaagttagctcgagttaacataccagttgtggattatggcacatttcttcatttcctttctgttgttaaatttacaagtacgattcattttctttcgcctgcgccctacccactggttcatgtccagctatcagcattgtgatgtcctagtggtgcctagttggcttatgatttgctttgtgtcaaactaagtttactaagtgcaataatttacccatctttggctgagtgagtttgaatcagcttctatattttccgtagttttctcaatctactaggcgtaatatttcgcacaaaaaatttatatgtagaagtttttttagaaaagaaaataaatatatttttcaagtttgcaatggttaataatttattaatcactcaccaatgacctttaaatttatgaaacatagtgaaggcacattgaaacatgttgctatcacgtatgatacattgagtattaacgggctaaaatatatatttcttttcatcagaacataatcatgcgatattttgttgtgaagatttaattataacgaatacaacgtacgattagataaatagtttaggagaaaaattattttaaaggttattaaatccatgcatgagagaagagagagtaggagcaagtacgatcggatcgtaaatcggataagtagtttaggagaaaaaattatctgatcggatcgtaaatcggataagtagtttaggagaaaaattatttaaattgatactccccccgtcccaaaataagtacagttttacactattcacgtccaacgtttgaccgctcgtcttatttgaaatttttctatgattaacatttttgttgttagtagatgataaaacataaatagtactttatgtgtgactaactttttttaatatttttataaatttttcaaataagatggatagtcaaacctttaacacggattcctacgagaggattctcgtattgttgtggccctgcagacgaaccgggctttcggcccatcacagcctagtttgtttcgccatcaacaccgactttgactcgcaccacctgcaatgcatatccctcgcgttgcgccacggataaatttccaccgccttcgccttcgcgagatcggatcacggcggcgtcgaccgcatatcggcgctccccgacgacctcatccagcgcatcctccgcttcgcgccggccaacgaggccgcgtccaccgccctgctctcagcgcggtggcgctcgctctggcgctccaccggcgccgtcaacctcgccgtgcgcctccccgagcccgacgacgggcgccgccacggccaccgcgtcagccacgacgccgtctcctcctgccatgacgccttcgtccgctccgcgcaggcggcgctctccgccgccgccgccgcagccggaggccgaggccgccacgtcacgaggctcaccttggaccttcgggcggcgaccatggatgtgatcgacaggttcgtgcacacggagaggccgcttggtgcggacgcggcgcccgacacggacgtgtggctgcggctcagcgacgacgtcgagcgagaggcggacagatgggtgaagaggggagacgtggtccgcgacgtggtctcccacccggcggcgcgccgcgtggaggagctccgcatcagcgccagcgcgccggccgtcgacgacgacgacgacgacggcgaggtcgggcgtctcgtcggggtgttccacctggacctccgctacgtcccgtcggagaccctccgcgtgctggacctctcccggtgcagcggcctgcgcatgccgcccgccgtggaaaccccgcggctgacgacgctgcggctgcaggcctgcgccgtgaacgtgaacgacctgcagcgcgtcatcgacgccgcgccggcgctcgccaccgtgcacctcgactccgtctccttcgacgggatggagcacggctgctaccgcctccgcctcccggcggccaccaccgcgctcgtgctggcgaggtgcaggacggacgcggagccctaccgctaccggagaagcggccgcccactggggaccagctccgtcgagatcgacgcgccggggctccgatcgttcaggtacgcgggctacgcgcggcgcttctccctcgcctcgccgccggacatggcgcgtgccgacctccacttcttccacgacatgtacgcctccgcctccacgagccgcgacctcttctggcgcttcgtccgcagcttccgcggcatcaggtccctcaagctcaaggtgagcgacctcaagcacgtcgccgtcgccggcagggcgacgcgcgccgagctcctcgtcgcgttccccaacgtcgagcacctcgagctggaagggcaccacgaatccgcgagcgagacggccgccgcggtggccatcggcaacctgctccggtgctgccccgccgcgcgccacctcgcgctccacctcgccacggcgccgccgcgcgagcgcgactccgccatgaacggcaggtacggccgcgatctcctgcgagcgagacagcaagccgacctcgccgagtctctcgatcgcttcgctcgccgccgccgacgcaaacccaatcctccgccgccgccgccgccgccgacgccggtgaactccatggacgaacacctgagcatcgtaggattgagtggccgatccttcgcctgcttgaagaactcgctgagaagattcgtaatccagtttcggatggatcgacccaactgcattggcgtcaagctgatcaagttcttcgccgagaacgcgattcacctcgaagagatgcgcatcgacggtggaaatcagaggatgcacgatcacatcaaccacatggttgagggatggatctccgattcatcgtcagcgaaaaagagggcgaatcacgagagttcgcagggtatcgacgcgagtacgccacgctttagattattaccccttgagagacggtgaaattggattgtggtgttagcaagatgtggattgcaattcgataaactattgttaatttggattgtcgaatgttcttgaaattgtagatttggattgcaattcaataaaccattatttctttctaatttatctaagaaaaattataaattacccctgagctattggggtcgatcaaattacccctgagctattgtggtcgatcaaattaccccctaacccgaaaaccaaacattgttcaccttgaacttataatgcatgacaaattaccctggtttatcctaagtggcatacgcgtgaaatccagtcagcactttttttaaaaaaaaacaatgatgagacccacctatcatacctcatcttcccctcttcctctctctttctctctatctcttagggtgtgtttggttgctcgtatgtccctagcctggctcgtatccctcatccaaggtgccctcagcctggataggataatgcaattggctatgtttggttgtccgcatgggtttatcctggatgatatgagatgctgtttggttggttgtatgacaggatgttgtacaatagagatggtgtttggtttgttgattggaccttaggtctgggtgacctcttcttacatatggtaaagttacccccacgaagcacactaacaaaaattttctaagtctgactcttgtgggtgaccatggtgttactatttaagccaagttttcgaaaatctcgttaatttcatatatttgacaattttaaacaactagctgtcagtaatcatgtaattttttaacaagaaggaatcaatgtgaaaatcatgcatattttttaacaagaaggaatcaatgtgaaaatcatgcatgccggtaacctcagctacatatatacaagtattaaaacaaattgatccatctgtgttctctacctctgtacagccgtcgtcgatatcattagcatgtatatctgcgaatattctgaaaaaagtggtaaccatctagctatggaacataaaccataaatttagtcatccagattaaaaaacaaaatcaaagtgaccatctttcccaatctctaacatcaagggaaaaaaaagaacaagtgcagaccaaaaaatcatgcccaggcatgttaacaagttacatggatctgttaacattgatcacaaagagcagtcaagtgccaaacaaaaatctgttaacatggatcacaaagcgcacttaatatcagaattcacaatccatttgtacgcatcacaaatcatcacatttgttctaaatcagttgcacccttcacagcaagaaaaatggcaagtgcaaatagctagaccaagtttgtatctgtaagtcccagtggaggaacaaggataaaacaagtgcagaaggatgaaatttatcatgaagcatagatcatgcaacaataatatggtgatggatcctcctggtttcagtgaggatcaattggaccttgttctaactcatctgactaatgacaaggcagcaagccttgtgtacattcagaagaatgaggctcgccgtgctcgttgggttaagaagttcctagaacagcaccaccctgacagcatctaactatttagctaactattcaggagaggtgacaatggacaccatattttgtatgtaatgatgattaaggtggtagtggacaccatttgttcttttggtaggatagtactcactgcttaaggtggtagtgtgacaccaaattatttacattcggctatgtgatggttaaggtggtagtgggacatcaaattatgtatatttggctatgtggtggttaaggtggtagtggaggtccatcactgagttctccaaatcaggctgcacctccgtatgtgttgtagcgagtattgttgaagccacattgttcacagaatcagtcatgttggtgatgagagcaacttcaccttcagccaaagccggggttctcttcctcttcttatctggattagatcctccagtcggctcatcactagtaggcccaactccactagctcgagcagcagtcccaccaccttcaacaccaacaccacttggtccagcagcaatcacatccccaataatcccatcaagaggtccaagagcactgtcagccatgtctggagggttgccaagggcttcatttgagcccatggcaaatcttcctgtggcttgcccattgccaaagataatttgcatctgtgtatagttctctaaagggacattcagatactcagcatccttagcatggtcctatattatcagaatcattacagttaaagagagaattgaattgtactaatgccacgaattgaacaagtgctagttagacacaaaccttgatataaagcatgtagtgctcctcatctaggacaatcattgacagtgtatcatcccaaagagccccactgatgtctttgagcctagtaatacgcacccaccttgtgcgccatttgcgaagatggttgtacacttgggtcccactaatctcaaacccatagcggtcagagacagttctagcaacttggttaaggtggacttccttgaaacccttgtcagtcttaacaccttgcgctataagctcaaccatacgcctaagcataaag

SEQ ID NO: 81909 - DNA, 1948 bp, Oryza sativa
ccaacctcgccgtcgacaacctcggcggcgtctgctccctgcttttttttttgtgtgtgtgatttcaggtggaggaagatggaccaggggcaatcttgccatttcgaaaaaattcttgcctcttttgatccggatattataaaatattgtctccggtgtcctatagccaattacataatttttgtagtgttcattagccgtgtctcgtttttacagtgtctcacggctaattacatgttttttaagtgtcctgtagcaaattttgccctttcagaatccctttttgtgaaaaattgaaaccagctcattatggtagtgcccgagttgtgaagatactgatgaaaacattcaaactgaatttggttgttgcatttaggatgtcatcggtattttcttttcaatctctctcgctgatttggtttcatttcatttaggtagatattgtgctaaatttattccaaatcaaaattatcccttccccatcaggattgtcatgctatctgctctctccaaggtgagtattggaaaccttctcttgtgacaatttcattcagttatgtatttcattcagctgatgaattatcctttgatcatggccattataatgaaatataaactgaattgcactatctgcatgatataacttctacaattggattatgtttttctgaatttggcttatattgtatatgaatttcatatacttggacaaccgtgtttctggttttcttttttttttttgggggggggcatgcttctgaaatttaccatcagggaaaaaaattctgacatatactccctccgtttcacaatgtaagactttctagcattgcccacatacatatagatgttaatgaatctaaacacgcacatatgtttagattcattaacatctaaatgaatataggaaatgctagaaagtcttacattgtgaaacggaggaagtagtatactaagattttccacaaaaatacttacgtatttgcagccttttagcacatgagtttggatgcttgttattgcctgacataatgatagcttgcaatattaaatcagaatacaaacagtgagtataaaaacaagaagacttttgtataaatggaaccgtttgtgttattagagtgaggtttacatttggtcaatattatattcccgtttataggggtgggcagaaaaagaccgaaccgaaaagaccgagaccgagaaattcggtcatcaattcggtcctaggtagtgaaagaccgaattttgttcggtcaattcggttagtctcctcggttaaccgaaaagaccgaattataaaaaaacgtctaaatgcaacctacaatccactatgtttaataggattgaactctaattttcacatccctacttcttctaggcatgcaacctaacaagagtctttactcataagtgcttacgaaatttttttgtgatttttgtgttgaaaatttccattatttctttgcatatatgaaaatattgttgaatttcggttaggaccgagaccgaatttgtcggtcctaacatttttgcgctgaaattcggtcttcacttttcaaagaccgaaaagactgaaagaccgagaccgagaccaaaattttcggttagaccaaatgcccacccctacccgtttatgctcatgaaattcatcttattgctgttcagtgcagcccaatccaactatcgacgcaggccaatatcaacaaggtccttacatgcaagtaatatgcgctcacatccctgcaagtttattctgttcatttatactcaaattatgtaataatcgagtccatatgcctatgagaaatataatttccttactgaaattgatgactgggtgtacaaaacatgactcacattttgggatttgaacatatatttcctatatatattaagaaattgtgtattcttacttagggatttgatctgttggtttgtttaacat

SEQ ID NO: 81910 - DNA, 19673 bp, Oryza sativa
aatcgccctcccagagggcggtaggcgactacttccgtcaattttcaaaatggaaaattatttttgtaaaacttttaataaaaaaaattaaaaataaaaaaaattcgccgatagaggtggccatgcgtggcccaggcggacggacgggcgcgcagcccatgtgtggctcgtgggcttttccggcccagcccatctaggccaggccaggccagttcgcttgctaacgcacaaacacggcggcgctggcaaagcggcgggtggtcgtcgcgcgtgagtccgtgacgttgacacgacgcgacgctacagtatggtttgcgaaagcatgcaattagcgcatgattatgttttgtaatggagtggttttaataatgcgaatagtaacaatatactccctccgtctcctaaatgtttgacgccgttgacttttttaaacatgtttgaccgttcgtcttattcaaaaaatttaagaaattattaattcttttcctatcatttaattcattgttaaatataattttatgtatatatatagttttacgtattttacaagagtttttgaataagacgaacgatcagccatgtttaaaaaaagttaacggcgtcaaatatttagggacgggggaagtatttaaaaccatagtactaccttcatcctactagaataaaagaaattttcgagttaaacgttattattaagaaagtagatagaattaaatgagcaaatattgtgattggtagataaataaatatatgtgagaaaattgaatggtgaaaggttgtgcttgattaggaaaagaatgttggtgaataaattactccctccgtcccataatataagggattttgactttttgcttgcactgtttgaccactcgtcttattaaaaaaaatttgtacaaatttaaaaaacgaaaagttgtgtttaaagttctttggataataaagtaagtcacaaataaaataaataataattctaaatttttttaaataagatgaacggttaaacagtacaagaaaaaagtcaaaatcccttatattatgagacggagggagtattatttttcaaaacaaattctgtgtgtaatagtggccgtgtttagttccaaaataattcttcaaacttccaacttttccatcacatcaaaactttcctacacacataaacttccaacttttccatcacatcgtttcaattttaaccaaacttccaattttgatgtgaactaaacacagccatttcggaaggggggagtagttataatagcatggatcaattaatcttaggctgtgttttgtaacatcctgaaaatgtgtcattttctaatattgcatcatactgattcttatgttcttaataactttctaaacctaggaaaatataattagcgggacctcctaaaactaacttgcataaaaacctctatgctatttaacatcttttgtgcttttcatttaaaaacatatttggtatttcttgttggaactctattttcgaatattaaactttctttcgactaaaactcttttattcaaatttagtttgaaaaccatttttactattatgaattatggtccaagaaatcctccaattttgcccttgaacctaaaccaaagtaattccaatctcattggaattaattgttagcccgtcctttgattttaaacccatcctttgattctcgatccaaatatccaaattcctccttttgatctagtcaccaatttaatctctgtggcttaatttcctcttcggcacaagaattgtattattttttttgactgaacacaagaattgtattattgcaaatattgtgaataattgctcttgtgctaagaaaattccaacttatactcttcattcaattttcccttttagctacaaatatacataataccaattttagaataggtatcctatttattgtcttcaactaattcccttctatatattcccaaaaatattttgaggaatattattaatttcccttcctatttaagtgcttccaaataaattccctcaaactccacctctaaatattgcacccaaataaattaggaaatctcttttgtgaattctttccgaattcaaattctttgcaaaacctagttatccaaatcaagtattcaaattagacttctttctttttgtcatcgggccaaaatttcctttccttcttcccttggcccatctctcccctcagcccaaataagccgaaccgccttcctcctgcaggtgcgcgcgcacgccgccgcaaactcccttccgtcgccgctaagaaaacgaagccggcgctgtctccttctcctccactccaccggcgtcgtgaccctccttgccgtcctcctccaaaccgacttccaccgcctataaatagccggccatccctccccttctcaacatataaaccaagcaatggcggaggacggaaaaaaaaacaaggtgtggctcatatggaataacgcgagagtgaaaacccaacaagaataaggaaataaacaatctcaattgcacgatatcggaaaaaaaacaaggtgtggctcatatggactagcgcgagagtgaaaacccaacaagaataaggaaacaaacaatatgaattacacgatatagtacgacaaaatattacgtcaataagcgtatgttaagcatggcagcaaccattgatcgtaatccattgtccatttgcaaacaagcataaataaaagagtatgcattgaagaatacttaaagtaatgaagtatttttattttgggaatacaagtaaacgctgaagtgcagcaagtgctaaacgctgctctctccctgcttggttgcttgccgcgcggtgccggtgccgttcccagccgcagcccgcaccagtgccgcccgcgcgcctcctgttgctgccgaccgtccaacagcatcggcaacgccacgcttaatgcatacgagtactgagtggcccagccgtccaatagcaacggcaacaccgtgctgcgcctgcgcccttacgctcgtggaggggtaccggcggccggagcgaggtatggcgagcgccagacctcgccataccgagcgctccgccactgaaaccaagctctctctctctctctctcttctcatgaccggccattgccgccactggccgatctcctcttccacagctctgcaagccaagtccttgcgccatcatgtttgcctcgacgaggtgaacccatttttcccttttcccctctcttttagccaccacaacaagccaccaccgccactccttttgttgccacggtcgagctcttgtcgtcgccgttccggccttctccttcactctctccgccagccaccgccctcccaggatgcgtggtgctcgggaacaccaccctccgccggcttcgccatcttccagccgccggaaaaccggcgcccctcctctccttctcctctgctgctcgtgctggaaagaggagaaaagaaggaagagacgagaggaagaagaaggagaaaaagaaaaagaaaagatactgacaggtgggcccctgcacagtactatttcgcattttctctatttaactcaaaatccaatctttagaagcccatctctcctaaaccgtagatccgattctagtgaaatttggacctaaattcatctaagttcaaactcttcattttcataccaaatttgctattttaagattttatttgaatttccttaatttattcaaataccatttgaataaatatttgatttaatcttataattgaatttacaacttaaacttatatttgcttttcaaatattttcttttatctccaaaataccctttagccactaaaaagccgccggttggaactttacgccttccatggggacgttcgcgcggtctacggacctcaacgtcggaccgttggttgtaaagcccggcaaaaaccaaacccaaggccgaagtgctgctcctggcaccccacgccttgatgcgtatagcggtcggagcttcactatcctctcgacctccattgcacgccgcacagttagctctcgagctctgtgtgatcctagccgctccgccgccactcacggttgtcggagtaacacttccaccccactaaacctgcatcacctcctattcttctagccgatatgttgtctatcgacaccggctagaaatgataccaaatctagtcgttatgctgtccaactctagcaacgactagcaaacacctaaaaccctagccgatatttatcctacctcgatatcggcctaaacaactaaaccctagccactattctacaaaagcccaaccttgacccatattatccacatacctatttaaccatatcaactatccagtatatttcctatcatccaaatcacgagagccttcacataaaatataagcaacattagttgcttgattccctttttaccttagcctccaaccctctagaacctccacttaaaatattagcccagtaatccctatgccctacaaaagagataggttataccttaaaccctagccctcttaagctgtttatcgttttcttattattttatggcttttattgaatttggttcttcctctttctcagtagagtttattgtcttttggatggcaaactttggtatttcgagaatcggataatcaggttgcctatcttggatttatttgcgttggagcaaggcaagttattattcctcccctttgagcataatgatcatatattcttatatatctattctatgcattagtcatacatgatttcaaatgcataacctgaacatagcaaattagatatgatagcttttgcttagcccttcctagttagactgcataaaatataatgaacttagattgggacagtacggtagaaatggttgatttccgggtggctagtactgttccaaccgacataagactgccaagtacatgtgaagaacatacgagtacgaccgcaattctcgtatgggcatagacctagctgattaagttatctagcaaaggtggtacctctgtgtagtggttcttatttaagtcctcgcgcaggaggcaaatttattccgcgaagggcaatattgtgatatttaccgtggcgcaggtaaatatttgtttgagataaattatgatgtcatatgacttgtttgtgaaccctgattgcgatgacatggtgtcatacaatcagatctctctaaagaccccggaaatgccagaactcctctcgctgctgataatgttacgttcagagcgtatggggattatagttcatggaacaggtaccactgatgttagtaaccgaaaagctttgtaatgacaaggctaatgtgtttggcacgtcatgtattgcgggtaaagcgtatatctactgcagtatgaatatcctcaaaactattcgagtagccgtgctcgcggttatcgggcattgggactcactatggcatcttggatagaaacctaattcgaaattttattaaatactgatgcatttaaaacattacaggttttctacttctacattctctgctttctgcaagtaaatctagctctatacagatattacccctcatgcattcattgttgaataatataatagcttgctgagtacgttgtactcacccttgcttcaacccctctttttcagagtctatttggagtttttgtcgaagctgggagttcaattacataagttagttccctttaaaactagtcttcaagtctagtataattagacggtttaattctatagtaaaacggcagaattgggtcatagtatagcttctgttgtaataggtagccacaaatttgtaaatgccctattattttatataaatatatctcctttggagtcttgaccaaatttatgcgataaagatccaaattgttgaacctgtatcaatctactgattcagggcttgatacagttaaatatgtcggtttctgaatcgttagttttgggacccgacatgtttagttcacactaaaattggaagtctggctgaaattggaacgatgtgatagaaaagttgaaagtttgtgtgtgtaggaaagttttgatgtgatggaaaagtttaaagtttgaagaaaaactttggaaggtcgtgtttagttcaccccaaactttcaactttctatcacatcacataacatccaaaactttattacacacataaactctttttttttctaaacttctaacttttcctaaacttttaatttttttcaggagctaaacacagccttagggcattaaagtcggaggatgagtccgacgacgctgacatgagctagcaaacgcatgagtgtttctgcctgtagcctgtaggctgtacggctgtgttcgtttgggatggttgggaaccaaactcctccgcacggaaaacggagcaatccattagcatatgattaattaagtattagctcatttttttaaaaaatggaacaatataatttttttaaacaacttttgtatagaaactttttacaaaaaatgcactaaaatagtagtttgaaaagcgtgcacgtaaaaaatgagaagggagagttgggaacaaggggaaacgaactgagccgtacccagctttggcgttggcgcaaacccattcgaccgcgttgctctcggttctgccaaagatgcggttaataatttactactctctctgtcttaaaaaaaagacaaaccctaagttaacgtgtccaacgtccatcttatataaaattcttttataattaatattttcattgttgttagatgataaaacatgattaatattttatgcgtgactcgtttttttaatattttttataattttttaaataagactaacgatcaaacgttagatacgaaaatttagggtttgtttttttaacggagggaggacattactccttggtgcagcctttgcagacgtgcagtatatcgattgacatctcttcatctacgctctccttgtttttcttcactgcagcagtacatggggccagtttagttccaaaaattttccccttcacccatcatatcgaatttttggacacatgtatggagcattaaatgtggacaaaaagaaaaaccaattgcacagtttagctataaatcgagagacgaatcttttgagcctaattaggccatgattagccataagtgctacagtaacctacatgtgctaatgacggcttaagtaggctcaaaagattcgtctcgcggtttccaggcgagttctgaaattagtttttttattcgtgtccgaaaaacccttccaacatccggtcaaacgtctgatgtgacacccaaaaatatttttttccccaactaaacacacccatgatgcagagctgcaggcgtgtcgcgtgttactgcccagcctagctcgatctgtagcacgtggccggcgttgcatgccgccgtactggttgcatcggtacatcctgactcctgagtcccttttttttttttttgagaaccacatcctgagtcctggaccttcacatgcatgctcacacgaaccgatcttttctcgttcaattcctccacgaaaaacttctcaaaagaagaaaataaagaaaaaaacaaacaaaatctgcatgatgttgaagcaccgcgggtgtactctacgtgttgcattgatatccgggtttatcgaatcgttttaaatggggttaccattatcctaggtttcggtggttaccatggtagccgtacggttatcgtgagatatactgtagttctataaactaagaagattattacacccgcggttttgtaaacctgccatggtcctcatcggtaaccctacagctttagttgatcagtcaaagttggcctttttagtttagcataatcagtcctaaaaagttgtccagaaagatcggatccactaccaatagctggtgcttatttagcccaataagctaaccgatgggtttagtgttgaatatcagtctcagcaacagcaaaccgatgaggtcccatgacttctcacactgctcctcttctgacattcacaagctctcattcaatttgtgcataatgggggtgcaagatatgtaaaaagaactgtactcctgctgctattttgtctgcataagtcataggctgttgccacctcgcagtgcgccgtttcatgatcatgaacatactgccgatgcgtgcacccggccccatgttccaacaatatcttgccctcggattttcacggaaaatttccaacgaaacggttgattaatttcgttcttttatatgaatcaactgcaaaaaggtgttcccaattaccataactaggggggccacacatttgcattatcatggacttaattatctctgtaatgtaactccgttttacttttgaatttttcctaattaaactaaaaataagtttaatcaagattataaaaaaagaaaaattggcaaaatctaaaacatcaaattagtctcattacaatttaacatgaacgcattccagtaaaatatttgttttgtatttaatttgtctcattacaatttaacataaacatattccaataaaatatttgttttgtgtttaaaatactactgtgttattttataatcttaatcatatagtaatttaaaatggagggagtaataatatataataataaagcactgatgagcatttgcttcgcacaacgcaacataccaaaacccaaattaattcattaattaactctgaccgatcgaaatcgatcacagcgcgcgtatatatatagtacaagcgaaaccaccaaaataatttggcaatacatatatcacgcgcccaattcagcacacctggcacgacgacgatacatacatgcatacatacaatcaattcaagcccaaattacccccaaaacgttacccattaattaattaactgcacgcactcaaatcatgattaatcgtagccgtacacgtactcatccccatccatccatccatccatcggacggccagcaagcatcgatcacagatctcgatgagatctcaggcgtcgcggtcgcggtggcactcgggcgacatggcggggtagcgttcgcggtcgtcgcagtagttgtagatggtgtgcgtcttgcggacccaggcgaggcggcggtactggtcggcgtcgaggtcgcggaactccggctggtcccaccaccgggcgccctgggtggcgcagtaccgggcctccgccgacgcctcgcagccatcgacgtggaagccccggtaggaggcgacgaacggcgcccgcgaccagtcggtcttctcccgcccgccgcgggtggcccagtcgtcggcgttccacaggctggagtagagcttcatcggctggttgaacgggtaccgcacgcccaggtccttgctgttcttgaacaccctgatcggcgtgtcgtccacgaagaacctgcatatattgatagatcgatacattcagatttcagaacgtacgtatgaagtttacaggattttcatgtgctccctccgtttcagattacaagttgctttgatttttattaaaatcaaactgctctcgtttcatcgtcgttttgacttcgatggaagttaaaatgttctaagtttaatcaagtttgtagaaaaaaaatagtaacattttcaacccaacacaaatatattatgaagatgtatttaaattgtagacttaataaaattaatttgctactgtaaatattactatatttgtttacaaacttgatcaaatttaaagtagtttgacttttaaacaacttataatatgaaacggatgaggtagattttagatctgtttgagatagctgtacattttttcataacattttgtgtgtataaattgatgggaaataattaacctgcacatgtatatatatacatttagaacgtatgaattttactggatttttatgtagattctagacccgactgagacagctaaaattggttcataaatgggtaatctataattttctataacaaaacttatgtgtataaataaatgagttaactactataaaaaaaattaaggaaatgttgcagaaatgtattacaagaaaaaaaaattatatagaaataaaaacttgcactggaaaatctgaaatttagaaatataatagggctatcataggattttactggaacacaggaaatacatagtattttcatcaagtagtagtaggagtagtaatttcagttaatactactactactagcttttaatttattgcggtttgctttcaataaactgttagcgcacagcggctatccgcttcttgttcgcactgtgcaacgctgtagcatcggcgcgtgtcagcgtgtgggccccaccgccgaccgacccatccctgcttttcatgttctttctgaactctgctggtcagggacgacatgtacacgcgcgccaaaatcaattgcacatgcgcgccaatctctcgtctcaccgtgcaggtaccttttgctttgctcatctttacggtggattcaaagcatcttagtactactgacaccgcactaattactcttactactttcatcccagtctaaggcaggattagacccatcctacctggctacattttgaggaaaaaaaaagagaaaatcattctgctaatgtaatactctcccgggctataatatactcatatactagtttcaaagttttttttcaaacttccaactttccatcacatcgaacctttcatacaacacacaaccttttagtcacatcgtctccaatttcaatcaaattttaaactttgggccaatctaaacacagcataattctacaactctatttgtcttaaaatatactgtctgtattttaatatataatacattttttataacgtttgactattcattttattcaaattttttatgcaaatatgaaaatatttatgtcatacttaaaatcacaataaaataaatgataattacataatttttttataagacgaatgatcaaacgttagataaaaaattaacgacattataaagatattataaaatattttaatactacgaatctcaaagtttaccagagttgatagttgtagattgtgcttccttatttttattttcttcggaaaatgagggagtacaatgcaagtaaataagtgggggtgttaatgaggggtaattagcgtacgcgatcatgtagaggttccagaggacggagtaggagtggtagtccttggtggggtcgaaccagaggtagatcctctgctcccggtcccccttcccgccggagaagacgttcgtctgcaggatgtacggctcccccgtcctgttccccaggaactcgaagtcgatctcgtcgtgctccgagttctgcgacgacagctgcaaattccccaatgcaaaaaaaccacacatcatcgatctccgatcaagaagcagaaggggaagaggatcagggagcaatggcggcggcgtacgtagaaggcggtgacggtgccggcggagtcgccggcgacgagcttgatgtgcatgctgaagtggccgaagaggtaggagccccgggtctggaagccggtgccggtggacttgtcgaggtagagctgcacctcgcgcccgccgtccacgtagtggatgtggtcctccgcccacgtcggcacgtagttcttctcgaacgccacgtccaccggcttccgcggcgccgccgcctcgccgccacccagcagcagcaccgacattgccaccaccatcgccgccgccgtcgtcgtcgccatgttggtggtgagtggtggttgtgtgtgctccgagcagaggagctcgcgagtatttataggggctctgctcttctcggcttccgttttctgattatcttttgctaattaataatccacctgttcctcttctagacgctacagtgaactgtgaagctaactagagcaagtttaatagtactgccaattgtaggctacaaatcaactatagtcaatttaatagttaatttatataatagttatcaataaacatgttatgcataattaatgtctgttcccacgtatgatacacacatgcatcttgtggtccgtgctgtagctggctataaatctatagcccgctgctcttatctcttttcttttatatgcttaaaatatgtttatagtcagcttatagtctactattgtacatgctcttagacgaagagtgtgtgatttgggataaaatttcttttaactttcttatttctcatcaacacgtttttcggtgtgttttaaaaaagtatataaatagaagttgtttagaaattcaaataaatcaatgttttcagtttgaaaaatatcctccaacggacacttgaggactgaaagaaatcttaaccattgatttatagttactacataagagagcttttttctcatattaatagttgctggtaatatacatagattagtaactactacagtaaagaccatggtgaaacatccgttaaataaaagttgttaattaagtactcgtgattagctagctgatgaccaagttgtaaccatgtaataacgggtgagtgagtgagtgacagagtgatcgagcaagttcatagcagctgctgcgccagctgcggccagaccaccacatgggtgcactgacgagcctgtgaggcgaaggttttgtcttgtgcgtcgtgtcaggttggcctagtggtgagatgcatgatgcatgggagcagtatcaagctgacgccatgggattatattgaatttaatctgaatcatgcattgcatacttttatattagatatatcagcacacaagttgggggcattcttgcagaggatgtttatgtaggcgtctcgaacatgaagttattaacaaaaagtgcttatatatatgtttcttgatagtgtgtgtatatatatactactactactaactacaccgtagtgtacgtgttgtgtgcgctgtcacaactcacaagaagcttctaagcacgcacgaacgcatcagcatcaatgctccatgaaatttgtggtacaagtgattagcgcagtagtatatattactgcatgagtgtgtttgtttggttggttaatctttcagtaattgaaaagtgatttgctcgcggggagtactagtatatatattggtggcagcttaattaagttgcaaaacttttttggtcagtcgctggccaaaatgttcctgtctggtagtatatcggcgatgaatggagctagctagctagctacaaccacacgctgtagtggtgtacagtaggtcagtagcagtgctacagtggaagcgcgtgtagtgaggccagttcagtgcagtgcagtgtgcaggcaggtcggtgaccggaccggacaggaatgaatgctgtggccgggggttcacatgggcggtgaactcgcatcgctatcaggagccgtccctacgtacgtgtaccgcccggggatacatcgagctaggccgtgtttacttcctccaaatttccaaatttccatcgcatcgaaaacttttctacacatataaactatcaactttttcttcaaactactaactttctcccaacttcctaacttttctaccatctaaacacagccatagtatatccaagtcctaatgcctcaacgctcgctacgtaccgacatgaacaacgtcgccgactgtccggtgattttgaggttctctaaaccttaaatttaaagtcgattttgaggttttcttttagaagtttattttttagcgtttgctttaaatggttaagaacaagtatgtaaaattttattcacaaattatttttcgtttacaaataggcttatttcatgaatatgccaaatgatggggctgctcagcttttccatcaagtctatttttcaatcttttcttccaaactatgataaacgatttacttataattttttttaccttggtttattttttttcagcttattagcggtagtttaactgatcaaaagttatataattctatatgacttaaaaggagataacaagtttaaggctaagctgataacgagcacgtaaaacaaggtgtgttattagcaaagtaattaattaagtattagcggttgctgcccgcggcggcgtcggccgcgccgatgctgcccgtggcggcgtcggctgcgccgttgcaatccgcgacgtcgtcgatggtgcagatgtgtcatgcaatggcgtggatgtgactcggatgatctcctcttcttcaaccttctccatcgagttaccaagacagcatgttcttcaccaccatcttcggattaagtctttggttggctggatttggggaaattcttcctctttgtctcttggcagcaataaccatgcagggtttatcgttcgggttgagcccagattggatttgcaatcttggtttacaggtttacagtccgagctcctcagattcaacgatgaactccgtggaaatattttgcggagtccggtgatgctcacaccaaaatctacggcttcgcaacaaacctctcgtatgtgtcgtttccgtggaggcagccgaaggggtttaccggttcgtcaagcagagtacacatcaatagaggcccttggatgcaatcgtcgcggcattgccgcagtaccctgtcgatttgctccttctttgctgcttagtttcattaggaagtttgcttcctattttcagttgatctctcttattaaagatggtacaactcttatgtttatcatggacgatgtatttgggaattcaattcccctaaatgctgtcgtttaataaagcgtgttatgttttaaaaaaaaagtattagctgttgcaaactcaaaaataattaatatgcatgatattaattcaaagaaacttttagatagacttttttagaaaaaaatacgccatttaatacttcaggaagcgtgctcatgagatacgaggggagatttttgccgactctgctgtgccgaacagagcatagggctcaaattcaaagactatagtgtctccggccggcaccaatgctaattattttgggcatcaatacgatcctcaagatatactatctccttcccatcgtcgctttgactttttctggaacatttgaccattcatttttttttaaaaatagtgtaaatataaaaaataataaatcaaatttaaagtacttttgataataaaacaaatcacaaacaaaataaataatagtttcaagtatttttttaataagacaaataatcaaacattacaaacaaaaacttaaagcgtcaagtaatatgggatggaagtagtagttttctacaactaactgtaactgtatgtacaaatttaacaaaaaatatagtgcatatgttaatttatattgtattccctcagtcccataatataagggattggatgtgacacattctagtatgtcacatctactcaaaatatcttatactcccttcatctacttttgatagtcatatttccaaatctgaaaattttatttttgataggcatatttcaatctaacaacttattatcttaatgactttcttggatttaatgcatgactcttcattcttccacacaagattggttgcatgagcatcgagaaatgtaaatattaatgaatcgcttgtttacgaggaatgactagtagcatatttaaatggatgataagtagaatcacttatccttggtctgtgtgtcaagatgaaatatgactatcaaaagtagatggagggagtattatgggacggagggagtatatatcttccttttcccttatgttagtttattttctgaaaccgaaagtaatattgtctctacgtgcgccgtagctagtaaacgtggcctcctactaaccgttgcaagcagaattaactaccagtgctaactgccaccaagaagagtataagccatgcgcccatgtgcaatagtttttggggccagagatgaacaaaaaaaaaagaagaaaaatgccggtttggtacaacatgccgaggcgcacgtatataacgttatggcatgaatggcgcggctgacgagcgaggatgtcggggagcatatttatttatttattaacccttagcatcgatattaagttaaacaaaagaagctaattaagcaaccctccattcacaaatactaagctagcactttaggatattgacattaaggacaccaacaatgtatatagatgaagtggtcaggtggtattagttgttgcaaaccccacacaatgtatatggatatggtaggaagtaggaaataaggtgggtcctacgagtaaaaggcaggagagaggagacagtagtaggatggagaatacatatgtttttttttatttcttatgggtggtctttatacctaagggtagcccatcataatgtcacctagaactactcctactgtgtataatacccaccctaaaggcttaagacccaccttatagcatacattgtggatgtcctaatatgccacattgaccagtaaccaataatactatatataaagacaagttattttaaatggaaattttgtaataatttatttcacaatatatatctagcattatcatttttatacacttttttgttactggttggagttaaataaaattgaccgagataaacttatttgaaggtggaaccaacgggtcattaaccaaatccaaaatgtccattatctacacgtagtactaactaatgaggcgatgccacatgctgagagcctcattggttggcttaataattaagccaaatcaaaagttgaaattttaattttcaaacttaattttatagttgattttaagatattttcaatgtaaatcttttccttggtttttaaatcgctacgaataaatatataaaaaaatttattcataaatcagtttttattctctaataaactttgtgacttattagggaatatgggcaatgagtaattacagttatctgcgacggtaacacagatacatggtcccagttaggggcgattgatgtgctgttggatgatgacgatagagaggtgtcaagatacgaattgaccggcacatgttgtcggtccggcaggccccatgttacccattggacctatgttttctcctcctcaaattttaatttctttctctccaaatcaccaaaccagactccatccgtccactatttttcatgcccaacattaactgtccatcttatttaattttttaaaaaacttaaaagtatactccctccgtcctaaaaaaagacaaaccctggtttccgtgtccaacgtttgaccgttcgtcttatttgaaaaaattatgaaaaaaattaaaaagacaagtcacgtataaagtattaatcatgttttatcatctaacaacaatgaaaatactaattataaaaaaaattcatataagacggacagtcaaacgttggcacgggaacccgcggtttgtcttttttaggacggagggagtaagtcacatataaagtactattcatattttatcatcttataacaataaaaatgctaatttaaataaaatttaaataaaacgaacgatcgaagttgtatacgaaaacttatggttgcacttataatgaaacggagggagtatctatcaatgtaactaacattatgtataaatataattaagcacatgcttgcatgtgttctctttgtttgttcgcgccgatggcgctatcagttcctcgttagggtaaatccacgtgcgtctgcctgagccgttggatcgaaaaggagttaagagtatgccacaactaattacatactccccaatgaataagaaaggctgtccaaatttaaatcaattgattatctgttaaaatcctacatgaactatgggtgtgtttagataatgggaaatgagaggtgggattgagattgggaaatgaatgaagggttaggattaaatgaaagggggagaatgaatggttaggatttaaagatgtctattggtgggtgggaaatcattttcctatcccatttgccaaacatggcctatatgatatagaatgacaatatcaatttcattgtttcctcttcgacttatcaaccgtaacaaaaaaattaaatcttaaaacaaaatcttagagttgattttaacgtttttctcatgctaagttgtttttcaggtttggctttcaatacactaagaaacatacatataaattacttattccattgcttatatgacatgtccgtacgcaatcagctgtgtcgagacatgtcgtctagaattaaatttcattttccttttatttatcgaagagagacgcaagaacatctccacatttccattagaatgaaaaacaatagttcagagcagagaattaaagttaataaaaatgtcaaaaaaaaattacacccgcttattacagtacattgattaaagtctttaaaagggccccacgcagcagtcaaaaggagatccatcatcatccagcaaacaacgcgatctaacctgtcctgcaaacacctgaaaaaagcagggggaatcctgcatatgcatgcatgcatcgctatcttcttactgttcatgcagcatccatccacttgcttggaataatcacatcattacatacagctagctaccattttttttttgttttttagtctgcatatttgtccaggataatccattcataatagcataccccatgtaaagccacatttgcatccatgcatagaagcttgtttcgtgaagaaaaaatgcatttgtttgtaccacagggaaaattgaatcaaagaaaaattttcaagagatcaaacctagcatcttgcttttttttttcttaatatggaattgaccatagtaatgtaggggctagctgtatggttgagtacttcaatttacccaagcttgctataatttttttttgactaactagcctaaggtttggttaacaaaattagagcgacactttagctagcatgactatacgtacttgccacacttgtttttatctcaatggcatatggggtctacatagtgaagaagaaatttggtcataagtgtggctatgaaccaaataggcatctagctcggttaaacttatgtaacttgaggtgtggtaaccttatacaagttatgtgtcaaaccaacagcccctactcatataaattttttttccatatgaaccaatggggcctctgggaaaaatactaagcaaattgaatgctccaaaaaatatttgccattcttgcatttcaaaatgaaccattaaactaaactttaaatggaagttcatctagcatcctagaaagaattataggaacaactgaacgaacaagcattgcatgaatattttgaaatgtggaaattttatagaattatcacaagattcagttcagttcctttaaaaatcttcaaaactcctccgtttcaaaccaaggccatagatccacatcttaaaaggaacattcacatcttaaaaggaactttgaatgggtagatcttctacgcatgatgctcgggagctgtcttatcccttgtatgtcaagttttaaaaccggccttagctatatatatttttaaagataatgaaaatactcccaccgtttcataatatagcaacttacttaattaggactggatgaaatattttatagtcttattcagattcattgtactattaaatatttcatttggttcggttattatattataaaacgaatgaaaataatttacttcctctgtttcatattataagattttctagtattgtttacattcatatatatgttgcctagatttattaacatatactctttccatccctaaatgtttgacgccattgacttttttaaacatgt

SEQ ID NO: 81911 - DNA, 3887 bp, Oryza sativa
aacggttttgtaagttgagggatgtcatatgtctggttttgtggttgggggacgattttgtaactccacgacaagttgagggaccttcggtgtactttttccttcttcctgggcagcgtcggccattccactcaggcacaaccgcacaagccggcccagttgttcattaatcccttatgtttgctaatttgtttagagtagtataaaagttgttaaggaacatagaaaataacatcgccacgttgaaaaaaaaagaattggggactttagagcttaattttaaattaaattatattttttatcattttatatttgacgtaaaatatttcaatattgtatcattactattactatgtaataactctatccttttagaaaaagagagcagctcggaaatgataccccgttcggacgggatacttaagtaatgacgtcatattcatgttaaaattgacgtcaccttatacttacgtggtactccctaacgttttaacttttcaaatttgactaagttacaaatataataatatttataatgctaaattagttttatcaaatcaataattgaatatattttcataataaatttctcttgggttcaaaatgttactactttttcccataaacttggtcaaacttaaaacaatttgactttgaccaaagtcaaaatgtcttgtaacctgaaacggagggaatatcatgtatgatatttattggtacaaaacatgatacccgagtatcaggtctaatatactatatctatcacgtcaatgatgatgtcaatgtatacgtatgtcggtatgtggtaccatgtagtatacttaatagtaccaaacataatacgtgagcaccaagtcttgtacctataaggacccagtacaagacatatatgtaccagccgtagtacatgagtaccatgtctgatacctataggtaccaaaatatcatgatgccactaaagtatcatcgcaataagaacaaaaaaatcatatatttatcaagagagaggtcaataaaaaccgacaaaataaatcaattatagaaaaaagttgccatagctataaaaacacccatagaatatgtaaaaagccccaaatcaaacaccaaaacaaagccaacatgagtgctttggggtcatgagcccaaatctgtcatacggatccacacctcgagaggccttgtccttcatgtcagtgatctcgtcgacgatggccacctcctagaatgtggtgagtagcttcgcctccatcatttgcttggccgggcacctaccccacaaacagtttcacgatttcctcctttacacccatgcctccaccaccagcagcgacggcggtgacggtagctttctccacgcccaacacacctccctgcatggccagccactaccattgcctccgtgcacatgatagttgaagagagagagaggaggaggaaaggggaagagataacatagaggataagattgaataggtggtgtgaggataacataggccggataagattgaatagatatttacgagtattggtagttattctgtatttacaggactccgttccttagatttcctgttaagaaaacttgcatcatcagccgttcataaattctactgtatatttggttttatatataagagggaaatacatgtgggacccacatgtcatagttttaagagttaacattccattattcacattcaaagtacatatgcttttcgaagaaagtcacccaccgttaggaatcgacttaaacatagtaagaaaataaatttagaggaggaagactaaaatacctatatgggattgaaatctctgggcgctcgctgtcttgacttcaaccagaacactcaaagcatgtacgctagggagggttcgaataatggcggcggcggcggcagaggcgtacgtgcggcagctgccagcacaggtgcagagggaagcgtacgagtggcgaggagattgctctcgatcggcggaggaaggcctgcagcgaggagccgatcgaggagagagctagctaggcattcggcacagggctcggagggatgtacgtgtgggtgctcaccgtcgtcggccgggtgcagagggtggtgcaaaagctcaccgatgctacgcgcgtagggaggcgccacaagcacacctttggcgcagacaaatccagccgccagatccgacggctgcgacaccggccgttgaggcaacgagaagctctaggtctgatgcagatgtcatcggtttagaatacaaaatacaaatcaacttgtagatattatttcatatgtatcgagggtattcatctaatatatggaccaaagagggactacttcttctggatccaaaattaataaaataaacaaatcattttttttcaattttaaaataaggaatagatcatgtatacatctaaacaaccctttcataaatccaagcaaacttttcgtaaatctaagcaaccttttcgcaaacccaaacaaccttttcgtaggcgtcctcggattggcccgggggatcaaattaattataaaaacatgagtttaattaatcgatttattgaacaaggaaaaatattatcgagacgaataaatagattaatcttgaaacaacaacaattaattactcttgctataaaacaggctcgtattttatctttcgtactatttcgtaactagtttcaataattacaggtcctagacctagaaaaaatagacatattcctcaattaacacaaaagttcaattccaatggaaacttaagaaactctaactagactttaagaaacaacaatcggtacttaagttccgattgttgttgttttattcgaaagggccagagtatatataaagaaagtaatccaatttagattcttgggcttgttataagaaagaacaatagggaagaaaaaatagtttttttttatttattgcaacatgctggttgattcctaccacttaatcttaatttattgtatcttcccggagtaactctccgggaattcttttttaattattcttgtatattactttttttatctctttaattaataatctttattttattgaaatcgtgtaaagcttatttggatttaatatagcttacttgtgtaaggattttacgattaagaatccattctttcttgtaactcaacggtgctttgcacagaggattataaagtgctaattactgtccaagttgataaacatatccttatgtttgtatttgaataggatctgttagagtgtgcagcccggcccaccctccgtgggccacccaggtttacacattggacctgctccaccacatgtccaaccggagccacaactttagttcctaggcctacacaaccaaaaaacctagtctgatgggtgaggactgcccccacattttaagtcgtgctccacacaacccaaaagactagtctgatgggtgaagactgcccccaccttttaagtcgtgcccccaccatcaattaccgatgtgggactaaacacaacaatctcctccgtcacattaacccatgtgaccccgaagacttgttacctggcctccccaccatgtaacccgtggaaattgttctgggtttcatacctgggctttgataccacttgttagagtgcgcagcccgacccactctccgtaggccacccaggtcatattgggcctgctccaccatgggtccaaccggagccacaactttaggttctaggcctacacaacctaaaagactagtctgatgggtgaggactgcccccatcttttaagttatgctcccctatcatcaattactgatgtggtactaaacccaacaagatcaaatgagtaaactttaaaaagtcaatgtttgtctcaacaatgcaatagaccctctcgctaaatgggttctatatata

SEQ ID NO: 81912 - DNA, 768 bp, Oryza sativa
ttcctgcagccccacgcagcggcacaaatcagatgagggcaagctcgcaatagtcgatcaagacgtgtagtcaagctctttgtcagggcaaatctacttagagcaatggcctcaacaatagagaatctgctcgagggcgcggtggtatctatggaggatctgcccggacaatcagatgactcaccacctcatcacattgtttatgcccctatcttcttttctccgccaatcatagttagaggcaaacaggagccaaggctattggtctagttgctctccaaaagttcagtggatacgtatagagagcacaaataataggaaaaggaaaacgagagaagatagagaagagaaaagaaaagaatgcaatttgtacctgtatctcgcttaggctgggggcactttgggtccccgtaactgcccctatagatcaatctctccctgtctttctctcgatagatcacagtcatctctgccagtgtgtgtgtgtagctcggctccttttggagaacagtggtaggtgcctgtgaatggcgagaccggctttcatcactcgagtactagctagctaccccccctatctagcgtcgcatcggctgaccagtgaccaggacgccgtacgccttgctcttgcaggggtttggggtttgggttcccctttctctttgagcagaggcagagtcagactgtctcagagactcagagtctctcagacccagagagagagaggtggtactgtcctacgtacagtattcatgtgagtgatggaga

SEQ ID NO: 81913 - DNA, 2057 bp, Oryza sativa
tgtgtcctattctgattgggtgtggttggtttgattttctgttaagcaagctccaaatgatttttttctcctaaaccgtttatctaatttatgatttgattacaccattatatttgttacaattgaatctttaaaacaagatctcggatgattatattttgataaaaaaaaatatatatgactgttaacaaccaaatttggtaatatctgtgtcaggaaagaggatctgatcaaagtggagtcggaggtggagatcgagtttggaagcagagcaggaattggctggaatccagatcggctacagttaggatcggctggatctaagtcgggctaaataagccgatataggcgattccgacaatacaacttgtacgcgacatcgggttcaagttaatgtatttcaaggtgattgccacgcacagatagagtcctaggaaggtaattgtatctattaattagtatatcttatgtaaattccttatagataaatgtgggcaaaagtctgccgcaaagacttatagtatcttagagtttgttatagataatggtcgtgtccggtatgggcatatcttgtaattctcgggtataaatagaccccgagccctatgtaattttttaacacacacgttcaatacaatctcggcgcatcgccacccttttttgctttagttttgttttgacgaattcttgctttcgggttgagctgcatcgatttcgatcttcaacaagaggtaaaattcgttatgacggattgcgttcttaggattagtgcttccatctttatgacactctaatcttgtttatgtaattcgtcgagttatcatatgtcttacataatctctagcaatatcgccatctaatctactatcggccaatatctgtatgcagaagacagctgattaggttagatcttgacgttgatctagattatataacatatctaccattctatgaaacttctagcggcttgattgtctaaatatcactcttcttttcatacttaatacttcatcagttgagtttgatctattaagtcgtgcttagaatatcgatctctagcctgccttctagttgccgattagaatagcattggagtttcagccgatcgtatctgatttaactatatttgttttatatgctttactgatatgttaaatctgccctttatatcaagatattgttgtatctaagtatgttaggcctttgattgatatattatacctactttaatatcctgatatagagttgtatcggagtattagccgatacatgctagatctatctgatcagctacgctacaaacatatatagtcttgttattgatatatatttcgatctaggtgatttatattgtctcggtatggtgaccgatctatcccaatcatttgatttaagtatatatcaacataaggagtatatatcgttaatatctacagccgatcaagtagatttagttcttcttcacttattcatgactgccgatcgatacacggatgacatcggcccaaagataaatgatatgtcatcggcatatagccgatcggctatcatttatagatttaaccacggtttctttgcttctatttcttgttgattacaggatcaaatcaactggcacgctaatacatccgaaggcaagcttttgacctgcactggagttaagcagatctcccaggccacgtgttttctgtcaacacgcttttggcacgcctggtgggacctgattagaagtcagacgtcagttcttcctcatggccgataaacagccaccaccaccatcaagcccaggttccattaaaggcaaggcattgaagctgggattgactgacatcattgatgacaacgtcatgccaatcgatccagagaaattcacgcctgagcagaagcaggagtttgaagcaacgctgcagcaagcacgagatcagttcctgaactcgttcatgcaaactcgcaaggggacacttgttcagaagtataaaataaaagtggttgctaataatcctgggaccggttcttctaaagatggagaggttaaacaagctccaggcggctcggct

SEQ ID NO: 81914 - DNA, 2940 bp, Oryza sativa
tagaaaacttcgaaaggtggccacgcccattgcagccatggaagcggtgatccacgggcgccagccttgggaagggcttctacacggacacggtggcagcatgcgggctcgagaacagcggatccaccgtcggcaggatcgggagcaccaaatccgtcctcgtgcgtggtagagaggaggcggaaggagccacggcgaccacgaccacgacagtggcgtgcatgttctagagcattggatccgccgccagcgtgctcgggaagggcggatctgccaccggcaggctcgggagcgacagatccaccctcacgcatgatggagaggaggcatatggctgtagtggcgacgcctgacgacggcgacctagggttttggatttcttttattattattattattatttcaaagtatcattgcagtcgggcatccttatttggttgcctgcaaaaatcgggtctttaaaagtggtctccttaggacgctcatctgcaaaaatggtttctcacatgcggttgtgatgaccacatgtgaaaatgctgatttttgcatgtgaccgccgccgggccaccgcccgtccctgcgtcaccgtgcacgccttgcaactaagggcgtgtttggttgcctggaccgcacttggcccgcatctggcgtgcaacctgcaggttgtttggttgcttggacgggggactcagccaggcccagcagatgcaaaaaggcccgtcgagccaggctgggggaaacgaccaattcgagcttcgctgggcggcctggctcgtggcgtgcagcgacaaggcacgaggctgcacccgcgcatgcagacagaaagagatggggtcaccgcgcgctgccttgactcctcaagagcttctccctcttcctcattttttcacagtgaaaaaaaagctagggttttgggctactcgtcgtgaacctcaccgcgcccatcctccgtcgccaggcggatgtgagcgccggctccctccgtcgccgggggtgagcgccggctccctccttcgccggctgctcctctccccccgtcgccggctgctcgtcttcccttcttctccttttagcccccttcttccttacgccctctcctcttcagctctctgcgtcgagatcttaggtaagtgcaaggatggtattcctcttccctttccaacctccttcaatttcgtctccactctttctttgatttctttgtttggatggatgcacatctgcacatgtccccttcataaaaaagtagatctactaaaatgtgatgtattttaggttgatttgggtgcaaggaaatgttgcataggcctggattttgttatatatgtttgcaatgttatgtactgttggtatattttctagatgtagctgagcatgactaaaaatgtttttctttgtcgatctactcatcaatcatatttgtacacatgaatatttgttaaatcgattgtctcttagctcagatctgcactggttgtttgtgatttgctcattcaagttagatctatgaccttgttagttgtgcatattactatgcctttttgttatgtccgagcaattttccttggtcgatgatgtgtttgtcactggaggtagcatcccttggatgtggcagccgtggcatgggtccataaaaattggatttgcaatacttaacagtgtcaacaccatcatataaatatgtattgacaatgtactacatatgttatttacatagatggaagaaatgtgacgtattcggcgggccctaattgctaaagcagctggtttagtttccgtgatgtgtgcttatgttcttttcattgtgcgaagagctagaagaaacacccctaggatctcctatggaccaatgtctgaaagagacatagctagacaatcgaaccttagattcatctatcacacagatgatactaattgcttgaatcagcttcgaatgaggagggcccccttttttcaactatgtaacttgttgcgagaaagagaacttttgcgggacatcatccatagctcagtggaagaacaagttgccatgttcctccttgttgtaggccacaaccatagatttagagctttgcaacccacctttaggaggtcaattgaaactattagtagatactttagagaggtattgtatgttgttggtgagctacgacacgagatgatcacaacaccttcatcccacactcatttgaaaattacatcaaatacaagattcaacccttattttaaggtaagaacctaatgtttttgtatttcaactactgaataaaatatatgtttttcataagcttgtgctaatatatctaattgatcattaggattgcattggtgcaatagatggaactcatgtcgatgcttgagttccatatgcaatatctgctgcatttaggggtaggaagggtgtcactacacagaatatgatggctgcggtggactttgatcttagatttacgtatgtacttgctgggtgggaaggatctgcgcacgacgccctcatacttgcagatgccctagaaagggatgatggtcttagtgtccccccaggtaatagaagtgtccaaatttagatgattaaggtttttttggaaaggttagataatgattacactcaaattatttttatctcataggcaaattctatcttgttgatgctggatatgctgctaggccagggttccttccaccataccgtgggtgttgataccacttgagggagtatggtagaagaaactaccctcgtgacaggagagagttgtttaacttaagacactcctctcttagagtcacaatcgagcgggcatttggtgctctcaagaaccgcttcaagatactgtacaacaagcctttccatccatacaagacccaagtcaagttagttctagcgtgttgcatacttcacaactggatacttcggtttgggcatgatggccatgttccact

SEQ ID NO: 81915 - DNA, 20718 bp, Oryza sativa
taactcttcagatattttccaagcaagagaagatctgactagtggagtagtaacaaacacagcagtgatgcttgccatcggaatatttttacatcatattaattactcccaaattcaggtcaaaacttgcaatgttttctcactgtcaagatcgtattaccgtaagcatgggcaacttaatcaataatatagtgagagtggattgcttaactgctattcattccattcacaaataatggttagttttggcatcaagtaaataaactttgattatttttagcgacatcgaactattacagcgagtatatttgaatgtaaaaagtattagttaactacttataattacaaatataatgattcaacttttatgctaaatagttagattatttaaaatatatatttgtagtcaaagtaggataacttaaaattaaactacacatttacccgtgaactgaaggagctgagggagtacttattatactacttatcccatatacacggaaaacaaaacggtggattactgcataaaaacttaaaattttttaaagcaacttttttgagaaaaagtttaaaaaaaatatcgtttaacagtttgagaagcgcaacagtcttactctgcttatgctgtcaccttctctgttttaactgaacagccctgcttgatcagcaaactcccctgaggtcaaacatctgacagggtctttgcctgtcagctaggacagtcatctcaggcatattacatgcatgcatgttggatcttgtcaaattgtttgacctaatctaatccaatctaatctgcatcaacatctgatcagcagcaagaaagttcatggaagctagctgtgtccctgctgctaaatactcttctcagtatcccactatatcagcatgaattcatgcatgcagtttcaggtttggtccattccaaaacttagttgctgcttccatgcaggcatgtttccacacgtgtttaatttaactgtggagtttggacttgatttgaagtttctcaatctgcacgagcttgaattcaacaactagtacgaaatatagaaggtccttgcaagtggcatgaagaataaaagagaagcttcttgagaaaatacttgtcaagaaacgttagtaatgcttgtattattagtgctttaaaaaattgcaatttggcaactaatccttgttttcttcttaagcttcagagggaagtactagtagaactataggtactcaaatagtggtgaaaggtaatccattaggaaaaatatataatctttttttttcaaggagcccattgaaacgtacgcctcccctggtttctgaccattgggaattctatggaaatgaagtgactcacctaccatgaatctggcaaaatttcttggtcataaatatagtttgatgctattttttggagatgggtttatagttatatactttgatgatgcactgatcgtacaagagctgatataatattaacactatttgtttttaaaaaatagacattagcaaaatcttaatcatggtgcttaagtactattgtttgactaggtatctatgctattcaaggaccaaaacatcacctccatttgattctttcttgatagatggaaaagttcagaaaggacttaggcccttcaaacttgcaaaaattctatcacatcaaatatttggacacatgcatggagcattaaatgtaaacgaaaaaaaaaccaattgcacagtttgcatgtaaattgcgagacaaatcttttgagcctaattacgccatgatttgataatgtgatgctatagtaaacatttgctaatgacaaattaattaggcttaataaattcgtctcgcagtttacaggcagaatctgtaatttgttttgttattagtctacgtttaatacttcaaatgtgtatccgtatagttgaaaaatttttggcacacgacctaaacacggccttatttcaagttggttgcatttagacatcagcaaccaactttaacaaataaaagcagcaggagaagggaaagaaaaataaaatgttaaagtcttaaagacatcagcaaacacttggtcataggacttgaactacagggacctggattctttggatattatagtagtagtacacacgtcatacattaatttaacatactaaagttccatttgaaatggaagaatcaattattccaccccaaaacaaaaggattcagtttattggagagcctgtcgatctgtcccattggttggattagcaaatataaaagcaacaaaaggaaatgttttctaaaactcagtagctacattatctagatgatatagtacacacgtcatgcaatatatattaattatgggccccatttgaaaaactagagaatttgttttttttgtgggggttcataatttggcatttcgctcttattggggcctaattttcaaatgagaattcctcataaacattactagtctaatttcgcgcttaattttcacaggaaaagatcagaaagaattaattggtcgtaatgtgtcaaagccagagacagtagcagcccggaaatggacaagttgatctatgggcatttggataaccacacatgtaatgcagcgtatgtgatgtatttaaactagaattgacaaaagcaattgggcttttcctatcgatggattgatcacttgatccctatcaagtaacagttccagttgacaaaataaattgcgtgcctgttttgaattaggccgtgtttagttccctcctattcccaactttccatcacatcatatcatatcaaaaacttttctatacacataaacttttaacttttttaaactcccaactttctttaaactttcaacttttttcaggaactaaacacacccttaatagtgaaactggtgagaaaaacaatttaattaattaaagctatctgtcctagctagctagctaggcatgcaattgccaagaggatatatatttgcatgtagttgtcgacatgtccacgttagagacggttagaattaacgatagatgtttatctgacatggacaataatctctgaatttagccaggccaatcttgatcgtaattaactgtcctactgtagcatatctggatatgtacaatatattgtgctgtgatgtgtgttctcgtgttatgtaattaattatgtgatggccatggcaaagctatttatatgccaaactatcactactacacaaacgattttcctgtaaaaggagctatttagattacagacggacgcggaacataactggttacgtctgcaaaaatcatcctcctatttatatgtgcagacccttaagaggactacacgaaaaaaatcgatttttgcaggcgggcctattaagggtccgcacacaaaaataaggctagttttgtaggtgaacccctcttaaggggtcgcatacgaaaattgattttcacatgcgggtctcttaagacgtccacacgtgaaaatactctccctcctcagacatcttttccctctcaaccacttcaaaaatttcatcttatcctctctctccatctctcttacctcctcatgcttattctcatttctccctgtcactcactctctcgtctctcgtctttcactcacgggtggcggcagcgcggcctcgtgcttccccggcggcgggcggcggcagcccggcctcaccctccccggctgcggcgcccctcgctcacctggatctggaggtggcgcccctctcccgcctagatcctgctgtgggtggcggcaacacgactgggagcgatggcgggctcgggagccggccgcggcgaaggcaggctcaagagcggcggcagcgggagcggcgatgatgaccacgaggagcacggcataagcacccgcacgaaaaaatcggatttttacataccctacggtgcagacatatgagagatccgcaagcgaaaaccccttttcgaccgcacggaaaaatcattttctagtactgtatattaacattatagctttgttcaatgaacagaatataatcaatccaatttactttcacctttaaattttaatataaaccaggatatgtttgttttgtattaaaaaatcaagctattttacctataattttgtgataagatcacttttagtttactgaggttttatattaatgtttctatatgttacttattatgcggttgccagttagtaataaattttaaatcaattaatattgttatatgttgtttttcgccattgatgtgatgcaaatgatgaagcacatattaagacaattttttcttgtgtttttttttctggtagtagaattataatcttctttttttctcatatctagtggaccttgtcaatttgtattactacctcactcaactatagataatagaattaaggaggttaattgttcttactggtaggagaaatcataaactagtggcatagatcatatttattggcgataacactggtagtaaaatactactactccgtttcatattataagtcgcttttatttttttctaatcaaacttctttagttttaaccaaatttatagaaaaattagcaacatctaccaaaccaattaaattagtatgattaaatataacattaaatatatattgaaagtatatttattttgtgttgaaaatattactatatttttctgtaaaattggtcaaactaaaaaatattactatattttatactaatataaaatagatgcagtaacagtaacgggcgccataaaggacacgttaaaaattatctggagtacagcttttcactctatattgttcatttgttttgacaaaacttgaatttgttaagtggacctattgttatatatgctggaggtgtacgtacgtacgtaccaaattaaaactagccgcatgcatgtacaattattgtactagctagccatccaattatttcaagagacaggtgatactttctcttgtcaactttcgaagaaaaaaaagtaatcgagctgtccaattattgtgtataacgagccagtacaacgacatctaaaacacgcattagtagctgcaacaatataattaacagcagcaacgatgacgacggcatacaagaattcatgaaatcttataggtagataatatatagttgcctacttaacaaaagaacatatatggcttatactaaatctcacaatttaaattagacgcatgcatgatattaatatattacaatataattgacattttggatatcaaattaacagcaaatattgtacgttcttccttgagccatcctcgatctcccttgcgtgtaagcatggtggtgcatattgccacaaagccgtcgacatcggaattgcgaggaaaatttgtatcgactttatccatgtcaaagagaaagttggtcaaaaacatgtagatttggagtgttgcgccagtcttcaaactggatgatttgtatatatatggatggcctcatgttaaatctagaaaaggttaatcacggttagttaattaattgccttgattaatatttaaagtatatattgaacgattgatggattcctggattggtatgctacgactcctgacttgttttctttcataaagaaaaaataaaactagcttgctactcaacggaaaccgaatatgttgacctccaacaggcaaagattagctatacctatatatatatatatatatatatagtcaagtagtaagaatcaagcacgtcgaataataattgttgtgtataaaaatggttatttatttttaatagacggatctatcgaatattaattagttgctgctaatggagctatgatatatcatacaattaattcatgcatgagtttactttcagtccacaaatcaatcggtgatggtcgtttcccaatttatatatgcatatatatatacacgaatcaaggaatcaaagttcagaattcgtttaatgtcgtcgtaccagaacgacgactcatattaattccaactcaactatgggaatcgaagcgtgaatttcggtgcgacagcaacgagcttcatgttgcgatgatctcattatcactagtacgataacgatttttccgtgcagccgaaagcgattttcaggtgtggatcttccacccgtctgaaacaaagtgtctgagaaaatccaatttttttcgtgcagttgacacacccgcacacgaaaatcacgtgcacgagaaaataaaaaatcaaaaaaaagaaaatcaaaagacgccctggaaggctggaaccctaatccaactaccgccgccgttgccagccagcacgaggcccgccgccgtcatccccgcagtcgcccacgacggatccaaacgcccgaggctgggagaccactgctgccaccgccgtcgtcatcgccgccctgcctgaggcccgcgccatcgtccccacggtcgccagcgacagatctgcccttcccgcggcgcggtgaccggtgacggatccgcccttcccgtagtggcaggcgacggacctgccctccccgcggtggccggtgacagatccgccctccccacggtggcagacgacggatccgctccgccgccaccaccctagccgatgccgccaccatcaatgccgccaccgctctcaccgatgctgccgccaccgccgccctagccgaggctgccaccatcgccgggagtgggtagagggggagagggaggagggagagggctggagagtgagagggagatgggaggagtaggaggagagatgggaggatgagagggagagggagagggagtgggagtggccgagtgggaggatgggaggagatctagtggcatcaggagctaaaaaggtgggtgggctatttttgcatgctgatcacttaacaggtccgcacgcgaaaataggctctgttaagaggctcgtctgcgaaaattgatttttctgtgtggtcattttaaagagtcgcatgcgaaaatagagcacgatttttacagatgtgaccacttatagttcgtctgcaatctaatgtgggtcccgtacaggaaaatcattttttactagtgtgtgatctaaacaaattaaatatcatcatgatcaatctatccttaatttacttaatgtagtcactaatacttggctttgagtttttagattgaatacacaaaagttcgtccagttattattatattacaacggaataaaaacaaacctacatgtgcttagtctcttgagggctccaaattttgcacatggtactctgagaagaaaaagatcttcattttttttttactgtggttttggttaaagttgtaacggtatataatggctcgaaatatatattagagctgttacatttgtatgagaaatgttcttatttatatctatgtaaatcgaacatttcaagaaactcgagttattcagaaaaataaacagtgcatatgtttggccttccatccaaatggaccaaatcatgacggtttagactaaaagaagagttacacaatttataatatactaattgtttttttaaaaaaaaattgcagctgaattataagaaatcataagagtagctaggttgatgggtacagcttaatattttttactatttaatttcagaattattacaactttcatttattaatgttgaatttaaaaaatatccatacctctattaattgaaaaagaaataatagataattaacaaatacaacaatccatctaccgggactccatgcatgcccttttatcatgtacttcattggattattgtaaccgattattttcccctcatctataaaaatagtatgttttctcataaaatatttcgggtcccttgttctaaactatttgtttagtttatttattcatgtatttaatttattcttataatcgtgtagataatctattacaataatgtagttaataatctgttttaaagtgtcctgaattgtagtggtttataacatctagaagaagcatgcacgtcatctgttattctctgtagctcatatttataatatgcaaagctatagataactacacaaattaaggtcaattgagatgacttattggtgtgtcgtcccctacaaggatatgatcttcatctctagctaaaccttgcgtgtgaaaaagcttgactagccatcgagcttaatttcattaatcaactagctagggctgactaatgagatgattgattatccatccatcctaaaatataagtgattttagatgatgtaatgtaacacatcctagtagtactatgaatctgtacaggagtctgtccagattcattaagtactaagacgtgttcctgtctaaatttataggactagtacatgttacatccacctaaaatatgtctagtacatgttacatccacctaaaatatatcacctaaaatatatctattatattttggtacagagggagtatacacctggaaatgagcccgtcacttcattatctcactatcgtacggctgcaggattgagattagctactaattccaaaagaagtccacaagcttgctagcctagcttgattttctctttgggagtatactagtaattaactactacaaatttcaccatttcacactgctatccggttaatttgacgcacgtttcgcacgtgtcgtcaacggtctctcagctgactagcgtttcgtacgtacggtcgttaattaggtaaagcgggtagagattagtttaaggggttaattacgcatcgggaacagtgccaatgatacttttgtcaataatagagcaagtttaatagtatagcctactactagctttaattcatctatagtcaatctaaaagccaattcatataataattgcttactatactattagtatatggtcccacatatcatacacacattacgtcttagagtttgtggtacagctggctacagatctgttgcccgctactcatctctctcatcttttatctcattaaaatatgcttatagctgactaatatagtctgctactgtacctgctctaagcagggtaagtggcacatgtattgatagcttacttaatcattgttgggtcagtggtcacttaattacttactccatccaaaaagaaagttacaccttcgtcccaaaataaatttatttttcacacattctatacatgtcaatataaaataaaaggattagaataccctcactttatcaaatccaaatacaattattctctcctttatatactcttaatgtatttatctcctacttttactgtgaaatcattgtcatgattaatatttgtgatgaacaattggctatgcaaatgatttaatcaaagaattggtttgagagtttgtgtgaatgttggtgtgagtgcgtgtgactaatgtgggtcaggttgtgatatctgtgcccagaaacggttgttttgtctaattgtgtgcaggtgacttgaggtcagccttggtcaatggtgaagaccgggactatgctcagggaggagcagaggtctattgcggtctggataccatgtgagaaggtgagtagagtctggattcttggaggtcaagttcggtcaacggtggggatcgggactaaactcaggaaggagttgaggtccagacggtaaagtataccgggtgacgaagttggatacaagatggcatacggtggatggacatcgtgtgggagagatctttgcaacgggcttcacgaggtgtgcgtgcaagtgccagtgtttgcgaagggaattgtaaagttggagtagtatatggtgctacagtacacgaggtactgtagcgtgcaggtatgcatacatgtacgttgctgtacatgtatgtgtgatcgatacatgcatggtgaagcatgtatgtgtgcatgattggttggccgagcagcaggagagcgcctcggtgggcttcggtggctgttggcggcatgccaagtcggcccaggagaagcaagggcccagctggcagcgagtcggagacggtcacgcgtggacgtcagcttgggagcgaatccgttttggatttctggtgcggccggttgtttgctgcacgtttggaaattgtaaaacgtatggaaactgaaggatggagtcctattgtgtataagagttctacacctattttgagtaggggtttttgtggtataaatagagagggagcgtgaggcttcctgtatcgctttagagagcaatagagttgagttttggtttagggtttcgagtttagtcgaaatttttgtaaggagtgctgttgttgcactttgtaaacacagagagaagtaataaagtcgtcatccactttaagagttcttcgatttgtgtttcaccgggtttcggcggtctaaccggcaactcaccggtggtcagaccggcggcattgcggcggtcagaccggcgggagcgaggcggtcagaccggctgcagcggcaggtgcggcaggcgacttcggcaatcagaccggagattcaacaccggtcagaccggcggcatccactcggtcagaccggcagatcaatctcggtcagaccgacttccgtcgatttcgagggtaacttttatttccgctaaaagttttcggtttttgggtataggtttttgggtataccaaccattcacccccctctggttggcttagttcttgtaattcgatcctacatttaccaactacaatacaatgattactcaaaattgaacttgttttaggacgaataagagaagctaaaaatgaacttattccacattctgtagaagtatatattgtctagcaaatattaaggtttggaaaaaattaataataccctaactaaatttgaattactactaactataaggtagatagagataccttctttccttaaaaaaaactttaatcactttcgtcaaaaaaaaatcacctttctatgatacacttaattaatcacatgatcaatccatttagaaaaataaaactgatagctgctcaccagttaattagtgcttgctggtagccagtcgttattcttgttttaaggggaaactaaatgggatgcccaaacgatctcggacgtcgattctcccctaatctcaatcttggttgcgtccatttcaccatttcaaccaattagtcggtttccttacccgagagaaaacactaaattagattataattaattaagtattaaccttaataaacttaaaaataaacttatttaaacttttgaaggaacttttatatatatagctttttttcataaaaatcatcccgattagtggcttgggaaacgtccccgtggcgtcaattttgatgccttatataagatacttggttcaatcttttgagagatttatagaggtcactgagaatggaagctacgtacctttcttcttctctatctttttgttaggaacaagtaactgcgatttaattatgttcagaatattaattaaatttggtcctacgtcgttttgaggctaattctatcgagctgatcgttgcagtaactcattatttctttgcagctggagctgggtcggatcagtgagatgttgagctcttttgttttatatacatgtcttttaactcatctacttgctccttgttaattaactgatcaaatagaggattatgtcaatgtcattagtcatcacctgcctgattaggacattatacagtagttatatattgataacatacagatgttacaaagctagatatgcaccttttgatcgcctgcccattattctgtcaacttgttcatcatggtgtgttctatgtgtagtgacagtataactgccaaattacagtaatctaacgaatcaaacaaggtatccagtaggtagaaataaacacatcaaaggcacctgtgtgtcgccttcctagattttgctttcgtcaaacatgtatgttagttttgtcactgacaaaatatatcataatatgcttaataaaactacaaatccattttggcaccggttgcaactgtatgatatgaatttacaagctctgattaaaataaatcaatacaccaaacttctttttttataataaggctggggcattggagattgaactttggaagtagtacggaagtttcagagatattgcatcataggacgacaaagagaagtggaaccttttgctttgcagaagttatttcacatatataagtcataacgaactttggctaaaaaaggaggaagaaacatgacgagatgtcaaaggtgtgatcatgtagttgtcaaattaaatgtgtatgtcaacattttgtttctttttgaagtggaaatgtatggatccacttgatgagaccacgaataattcgtggaaaatatataaagatccaggacggcaaaatttccgtgctaaaattattttggaaatgtgggtatggaaatggatggttctaattgtattcattagttccaagaggaatttcattttcattagttccaagaggaatttcattttcatgtcggtagattggacggttcagatcagaaacctcactttctaaaatattattcccacctttgggccttttcatggtcaaattcgttagaaagagatatttctctgttcaatttttgtcaatttgactatgataaacgtcaggacacgccagtatttcttccggtgttatatatgtccacaaagttattcattttcagaaatgttgaaaccagcaaattttttttaattggagagtaacaaacaaattattcatttgagtgtcattctattccattatctaaaaaaatttgagtgtcggttcttcacaaaaagaaattcaatgaaaatgatacaaacagaagtctgcatcaaattagatatgaacaaaaatatcaaaatcatcggatacatcatagcctacttttgtttattacagaaaatcccgaaaattgttgtaaaaactgctgccatattaggtctatgccaagcagagctttttcatgcctgcccactaagccactatatgtttcaaaagtttgagacaagaagattaaagaggagaagcttgacaagtgctatgttgcatcattcataggacgacaaactgaagtaagtctcctttcctctctgatttcttaagtaaaatttggggtaaattaagcagatatgggcaaacagatataatgcttcagctccaaatagatgcccgcattttcggcacagccttttatctttttcctgacttcacactttagtggaatttacaaacttaaattagaaaatacttctgcatacccaatcatggacttctcaatttgagttgcgaaaaaaaaaataaattccgtgtctttactagccagattacaactgggatgtgtgttggtaattcttctaatattttgtaccactgtttttttccccttcttattccatgtaccacggcacgttaacaaattaacaaaaatgtgaagttagaagatatatatcgtctttaaaaaactcagtgaaaatgatatcaacagttgatggtctacgtcatgcaagagcttagtttaatagacaggttgcatatgaaacaaattaaaagctttggaacagcagtaatggcagataatgatccaaggaacaaattggacatttgatatatatattttttaatttcgcacacctgtattgttttccaaatacaactaggctcttgatcaggcttgccagaatatataaaggataatgacaaagatcaccaaccgtctctgtcctgcactgtactatcctacaccctatatctagctagccaaacagaaataagttcattgtgttagctgagaaacacaaaaactaggtttaaaactaacatgctatcttaagtttttcaaattaacctagttatttgaacactaaacaaccaaaagaacggggtgtattaccggcactagagaagtaccaaaagataatttgtggtatctgctgtgccatttttaaaggcataaaaaggctaaaattaatattctctcaatcccaaaataaatacatttatagtttttccctaattaaaaccatcctaaatttaactaaaaagagaagattattaatatttatagtgcctaataagtagactataaaaataatttcataacagatttaatgatgctcatctgatatcaattatttttatttttccattggattggtcaaacttaagatggttgacttagcatagaaccagaaataaacttatttcaggatggacaaagccaacaagtagttgatgaaaccataattttttgtgtaacatctgaaccgtagtctataaatcacctgcacccaaattccaaatccaaaccacaaactctcttttgttgtgaaatactccctccattccaaattgatctacatatttcataggtacaccaagacaaaaaaaaactaataactctctcatactatatttattatagcaacaaactcgatacatgcaccattcccactatttcttagccaatagcaaatcaagatattgcatatgggttataaatacttgtgtgcatgcatcaatgtccatttactccaatgcacaaataacgaatagacttaatgaataaacacaaatatgtagatcatttaagaataaaaaaaaatatgtagatcaatttgaaatgaagggagtagtttttatgtgtccattcttcaaaccccccccccccccgggtcattctgcttaggacatctcccacaaatacagtaacagcatgtgtttgagatttcagttcaaaatttccgaaattttggacccaccggcacgaaactattgttcccgaaaatttcatgcttttgtggaatttagaaaagaaattattaaattcagtcaaaatttattcaattttcaaataatttcgttccgggaattcggtcgcctgataccaaagttgtaaaccctggtaacaacatcacaaaaggtcgctgacgtaacgctcgagtcaagaacacaacagcaatcacttgtacaaaaaccgcaagaggcaattgaattcacacgaaagagataagcatgctgtcactgacgacgatgctaacgtactgtaatctactgctgattttgctcgacagtaaaacagcttgatcgatcacagtttcagagaatacccacttgtcgcaaaccatgggcgcatacgatcgatcgtttgacgcctgtcgccaacacggctgacgaagcaaatttgttgatgtcgctgtcggattcagaggtcatgttttcagttatgcatcatcttcagtttgttcttcagcttattcgatcgatatctcatatctgtaaagtgtggtcggtgacctttattttttttctccccatatccgttccttctgaaatcagaagctttctccgtctgaattgcaacattcttctggattaatttgtgctgtaagaacatgttttggtgtctgaactctgaactctgaaacctgaagctttcaaagaggattcggcttagccgtcatctagtcgtaaacgcgtcccagcatgcttgtgaaaagacttgctggttgaaatgttttgtcccttgttgacatgataaggaaagatcaaaggtttgtcctgtatgttctgttcaaagtgtgctcccaacatgtttccaaagaagccaagccaactctaacagattgtctacaggactgtttccaattctttttctgtttttttccaaaaagaaaattttgtttcaagataacaccataggaaatggaagaagtcctagtttcctgtcttgagaattttcaagatgtataattcatgcagcaggagtgttataactatttacagtgccatagctcattgtcgttgtggaggataaaaatataaattctgcataattagttcccaattattttaccattcactgattcacaggtcatcttgtttccacatgacaccaagaagagagagagagagagagagagagagagagagagaaaagttggaagaatgttaggtgaaaaaccaggcagtgttaaaagttgtccatatttgtgaagaagccttcaattcttgggtccaagtagctacatagaggcatgtggcactaccacccctgaaatggcagatctctgtccaaatctgaagagttttgactcaattttgatttggtttcatctttgcatgcatgcatacatccatcatccattccatgcagccatattggtggttggtgaggaaaaaggagagaaatttctcacaccctcctactgctttgattggattcctttcttgtaaactgcctgagtcattgagtcagtatcagatcaattgggtttcttcttttagtctgaatttggggcatgtcaatattaattataagatttcttgaccttaggatctgagctgctaggcctagtatgatagcaatgttgaccatcactctggtttccctctcaagataatgacttgtatattttgtttttgttctttttgacctatgatattcagggttaagtagggtgcagttagctggtagtaaaattttccaactaggggttatgtttggtatggagcatatactgaagagatagaatagtaggtgaatgattgatttgcaatgccccaatcaatttaccaaaccaattttgagttgatcaaactgatttggtagtagtacatgtgcacttatgcatggacaaatccacttcaaatttcaactggaggagagtttgaccaagaactgttgtttaacaagctagctactacaagtgtgatttctcaacaaagttctcaaggtacctaatacctgaaggtactaagttttatactaaaaaatatgatacctcctaataccttctcatgaatgttaaaattacctttttttccctagggttttgcttttgatagagatagtatataagaaaaagaaaagaaatgatgtttgaactcttgaaaagaatggtaattgaagttcagaaaatggaagaccaaatatgcagttggtccatgtgctattattgtaaccatccaaagtgcttctaaacgtataaaattaatgcaataatgaacactcgatgaaattgtttgtttgaattttgtaagttttcatcaatcacgtggtaaaattcaatcttggtaagatgcggcgatctgtacctaggcctaggagagcattagttattcacacacatgcctgacttgaacaatcttctaaaaacacacgcactatcactacgagtgttggttccagctggttcgtgacagcagcggagcagaagaagagagctttctccgtgttgcaggtcagaaattcagagatgttgcggctgtagaagggcaaagatttcaatcttggcagctttgattttctcctcttttcgctgcatatctttgcgtcctggcacaacgggttttcacctgtaagttctgacagctgatgcagagtttggtgaagttccactgatatttagtcttgtgacaagtggaaggcaaatcatgttcatgagatcacctgaaaatgccctgcagagctgcttctgctcaatttggaagttcttcagagaatgagaattcaaccaaatcttgcaactgaatgtttggtccaaaaagaaaagttttgcatgcataggataccagatgaagctactgatgaaatcatgaaacctgatctgaataatcatttccttgtattgttcaggtgaagtctcattgtcatagaaaccaaaaggcagatggctgtaagccctgcaagaatctttggttggctatcagatgcagcagcctaagtagttatcacacaaactaaacctaatataatcggatttatttcggttcttgtgaagaaaatgctcacgcatgcacctaccgaaaagggcgtgtgccacagtacttagacacaaaactaaactgaaagtctgaaaaccagtttagtttggtcatggccaacgacgactctgactctgacaaccgcttgcatacgcactctgaaaccgtgtgttttgtttatgcggcaaattgctgacctgaccaaatcctcttgtcgcatttgggagttctcactgatttggttatgcactagtggttaattagttcgctcaaatatgtatttccttttttttactgcttaaatgagtagcatgggatgttcagtgaagttaatttattagagaggttattcctgacaggttaattagattaaattgtgaaaattccatggaagacgttggccttgtggttgatgagaatcaaaatccaatctttgcccatctaacacctactacctgcttctttcattttctcgcctttgttaattagtgttcaccgaagataaacaactaggtatttggtgttgatagggcatatacacactactttttgcaagaatacattgtttaggagtttgaaaaacgtaaaaataaaaattcaaaatgaggaattagaaaagaacaaaaccttaataaaaaataaagaaatttgagttaggacacaactaaaacttgtaaactacttacaacaatgtggaacggagataatatattatgagtatggttacaattttacttatgacaaactcgatttgagaaaaagaactcggccattttacactctactagaagcaacgtcgtctacctaagaattgctcttgtgagttgggccattgtttggtaggtcaggcttaacactagctattctgtaacgggataacgagtataggcccagttgtttttgccagactatctaaccaggatttgggctttccagacatgcatgtacaacccaacttttgttagatggggcatgtacacacttaggccggcggaaggctaccgatcaaagtagccttccgccggggtaagtgtgcacgtgccacagctggtgtcgctgggccgggcgccgttccaccacggcgtcgaggcggtgggacacacgcacggggccgccgcgcgacgagttcgccccttccgtgacggatcagctcgccgaggcgcgggcgtccagttcgatcgacctcaccgcgacggccaggccagcctccaggccgaggcacgccggcgccgggaacgatcgaggtcgcggcgtccggttggcggccgacgtgggcctactctctcggcggcggatttaggaaagattgcttagttcgtgaccgacatagattcggtgtatgcgtgctccacgatttaaaagaaagaccaacacccggtgaaatcgcaccaacagaatccgagacacgaacacgatgaacgccaccgttgcatcaccgtcggagcccgccgccgccgtcaccgtcgcatcgctagacgagctccgcgaggtggccgaggatgatccccgcgcgtcggaggacggggggctgcgcgtggcggtcaccggcgtccccgtcagccaggcggaggagctgcacgcgctcgtccgcgaccacgtcgaggcgaagctctggagcgtcggcgtcggcgacgaggccgacgccgccatggcggcgctcaggtccgcggccgacggcgccgcccgcctcgtggggctgagccgcgcgctggacgccgtcgcggccggacacggaggacggagccccggcgccggccacggtgccccgcgtcacgctgctgagggagcaattgttgccattgacctcctcccatcggcgtcaatccactatcgcgcgaagccacgtcatcagcctccctcactcattctcctctatcgccaacgtgcacatgcagatctcaattgaacgtcttccttaccagcagccgtaattggaaaaaaaaatagaactgacacgtgggtcctacgtttataggtattttggtctatatgatgacgaaaaatataacgatgataatatgatttgtagatattcggatgacaagtgtacaaatagatgaattgtagtaacatttatctgaatcagcatatttgcaataacatggatccaattaaacaaaaattgggttacacattacgttacgatgaattggagtaatatctggcttcccaacttgagacctcgaggatgtggataacaatgggaggatcctcgaacgggatagtcatccccaacagggcagcgatccgtgccctcgtcttctccgccgtccgccggaagtaggccatcgagtactccagcgactccggcgacgtccatctgtcgccggagtaccgatagtagctcagcgcctccgcctgcctccctatgtccaccgcctcgacgacagcaacgacgtacttgcgcgggaggaacggcggcggccgttgggtggacacgtcgcgggccagctccgtcagcagcgtgatgcggggccccgtggccggcaccgggacgccgtcctccgtgtccctcacgacggcgtccagcgcgcggctcagctccacgaggcgggcggcgccgtcggcagcggacctgagcgccgccatggcgtcgacctcgccgacgacgctccagagcttcgcctcgacatggtcgcggacgagcgcgtgcagctcctccgcctggctgacggggacgccggtgaccgccacgcgcaggcccccgtcctcctccgacgcgcggggatcatgctcggccacctcgcggagctcgtccagcgatgcgacggtgacggtggcggctggctccgacggtgatgcaacggtggcgttcatcgtgttcgtgtctcggattctgttactgcgatttcacctggtgttggtctttcttttttaaatcgtggagcacactccgaatccgagtatatgtccctctttttcttttttttctttgacctaacaacaaaccgtctcggttcatccccgaaaaatcctgaaatatctcgccatcaaacgaaaccgtccgcgtcaagatggatctggaccaaccccagacgatgcccacctccgg

SEQ ID NO: 81916 - DNA, 1278 bp, Oryza sativa
taaatcgatatgagataactacccatctcgtgggcaaaacggaaggtttccaagacaaacctacaaagaggtgtcgcactctcgcagcagcggcggatggtttacggcgcaaaccgacaaagatggactaaactagggtaaaatagaaaacatagtaaaagaacgattcaaatagattatattcgggggttttacaatgaaccggccttgtcccttaaataggggttggtcttgccctctacaggcccttctccacgtccaactcgggatagaaattaaaggaaactcgaaacatgcctttccgagcaaggaaacccgagacccgacgaaaacatactcggactcggaccctgacggtctgaccgcccacatacctgcggtcagaccggccctactggccggtcagaccgcccacacacctgtggtctgatcggccctgtgaaggaaacccgtcactttctaaactttggcaattttcccctatttcgtccataggtgccaaatttgggtataaacaagttgcatgttgcaaacttgagacgataattatgcaactttttatcaattatggttggagattcacaaatagacttcaataatgtgttctccttattttagattcgttacttattttgttcattgggtgttttcaatgatttgttgaactacattcttgtttaggtgcttctctataataattggctgtaactctcttgagtaaagaccgagatgttatattccattatctaaaaaaaatacaacagccaatccgtctaggcatcgatcgatcgttgatgctgcgcaatgcaactgtaattaaagagcacaaggaaattaaattttccatttaatttggtctatttaggtggttgcaacttgcaacataatgtcatgtgttcatgtatacttgctgatcgatagttgatgcattgatctatgctagctcgatcgttttcccatgctttgctgggagggacgtcgacgggccacgggagcgcacgtacgtgctggttccagcactactaaagtactaactagcgtacgtgtacagcattattgcataatcaagggcatattcagactgtagccaaaataaacctggcaataccaaaattttggcaacatgtcaatattgccaaaattttaccaggatttattagtatggttgaaaatggtatcaaagtgaacatgccctaagatagtaagatgcatgttactccctccgtctctaatatagcaatcaagaatcggacgagatattttataggggctgcagga

SEQ ID NO: 81917 - DNA, 5077 bp, Oryza sativa
accgagaaattgcactataatcctgccctgtccatgggatgaacagggaatttgggtctcccagatgatacctagagattatttattcccacactgcatcataacagtactaggatctgcttgttttttatcgttagtccaatcagttgataagcactgatgtactgttagaggactgcctgaagcctctagctgagtggtagggcatatggttgcaaacatgtgatggttgtggatgtgtggttaactggttattctcaactcttttgagaaaaatatctcactaacaattggattgcaaaggtttttacataggaaaatacatccaggattggctagtgaggaactgagcctagctcagttggtcgatggtgtggatgtacgcctagaccacccaattccgattccttgttgaggcaaatttgggtgccaattttcttgttagtacaatgttccctagttcctgctaggttgatccctagttttgttaaagattagcaggtacggtcttggacacttgtcagttagacattatgttttttacttccagtatgcagaatctttgtagctttctagagcacaagatctttgtttaatcagataaatcgggactacaataagaacttggtacagccatttagaagttctgtgcactattttgacctaggtcatttgtgcatattgcttatggcctgtccccttgaacattcatatccttcagtatcagcgcctctcctgacttggcatgctagaaaactctcaatacttctgctaagttcttgtgcacaatctttgtattttgtagtgcttttgctcaccacgccctttgcaaatgtaattccttttttggtggttagtttgaatagatggcactcaaatttttaattcatgtgatagatgccgtcgcataactaaaatgtatatctgctaacagaccaaattaatagtgtaggtttgttgctccatgatactttgtccaatatatgaaaagagaattattgattgatcatagtcatagatatttgaatgaacacatttgatgtatctttatgttttccctgtttgtagtgataacttttgtcccatatctggaaagggattttttttcagatctttgaatcaatacgtttgttgcatcttcatatatttcccctgtttctagtggtaattttgttttttttttggcagactggtgcaaagaaggcttataagaaatttaaacatttcaagggcaccacagttgatcagagatgcggaccaattacatatagatgtggtctttgtggagcttcatcaaagtcgttcgagttgctgcctgttgaacctgagcaagagatgaaaaaacatgatgtgaaagattcagagttgagcttacctgataaggtcaaactggcaataaaattggttatttactgttctgaataaattagcctaaaacaataattttttttgggagatgaatgcaggattgtggtgctgcttttgtatttttcaaaactcggtatgcagccctggtcgtatcagaaattgttcagacatccaatcctatggaatgggttactagtcttgctccagatcgagatgacgtatattggtcaaatctttggttaccctacaagcagctttggattcgccgtatagttacactttcgggttctattgtttttatgttcctgtttctcatacctgtgacatttatacaaggtctaactcagtggagcagctgcagcaaaggctccctttcctaaatggcatattaaaaaagtaagtaatctaaacgctcaatgcctacctactgcttctttgctaggtgtcataaagaaaaaaaaaagattgattttcgcatcgagcatgtcagagattacttggatgtgtttatgtaccctaactattaccttatttgattggagagatatggctatgtgaaagtacatttttacatcatatatatgtgataattatgtcattttttacctttccatgtgaaatctggaagtccagggttgggaggtagacttgctgtcattaccgatttcttctccattagcagtttattatagtaacatatacatttttctagatctactatttggtgctcagggcgtcccctgtctgtttacagtcacaagtcacaggggacgcatttactactttgggggatgcttctactgtcgctgaatatttactactttgggggatggatttacattctcaggggtgggtcactgttagttcccttgatgctagttagcacttccatgtatctttgtttgtgttgccatgcaacattcaatctgttttttaggctttaaagttgaggtaacattataattattgcacgcacagtattatcttctggcatgttattttattcctttattcatttgtagaggaacataaaaatgtctatttctcttgcaggaagtacataacccagctagtgaccggataccttcccagtgtcatcttgcaaatatttttatacactgttcccccaaccatgatgtttttttctacattagaaggacccgtgtcccacagtgaaaggaagagaagtgcctgctgtaaagtattatacttcactatttggaatgtattctttgtgaatgtcctatcaggttctgcaattagccaagtgaatgcgttatcaagcccaaaggacattcctatggtgcttgctagagcggtacctgtacaggtgaattgcatgctcacttattttggctatcaggatgcagcaagtatttctgttacgcatatacaacttgttgatttgttaatagtgttgttcaattttactataattttttaatactgtttttatttgtctcaggctacattctttaccacctatgtactgacttctggttgggctagtttatcatcagaacttatgcaactctttggtctcacatggaactttataatgaagtatgttttgagaatgaaagaggatagctactttgtcccgtcatttccctatcatactgaagtgccaaaagttctgttgtttggactactgggattcacatgctctgtattagcacctctcatcttgccctttttactggtgtacttttttcttggttatgttgtgtaccgcaaccaggtgagaaactagagattaaattttgattccaaatcaataaattatctgtgattatgaattttgttgaaccttagttatagtgaagatgaccagactaactaattatgggaagttggtatgagtgcttatgcatttgtactttttaggtgaaaatgcaactgatgcattttacatatacatgcttctaattttgtgtaaattgttgtttcctggttcatgaatgtaaattctcagagtgcaaagttttgtgaaagattggtctgttgtgcttcttttccccgttcctgcaatctttttttgacgtaaccgttcctacaatctaatgggttaactttttttcatttgcagttcctcaatgtttattgcacgaaatacgacacaggtggtctgtattggccgattgctcactatacaacaatcttctctattgtgctcacccagatcatctgtcttggtgtctttgggcttaaagaatccccagtagctgcaggcttcactgtacctctcatcatcctcactcttttattcaaccagtattgcagcaatcgtcttcggccattattcaagactctccctgcacaggttagtatgaattcacctttatatattcttggagggatttacgctaaacttcttgccagtttacatttatgtgctctctactgagagtacatatcttgcacttctcttctgcaaatgccaaaaagtcctatgtcgaagcattatccctggctacctgaaatgaaatctcttacattagttctctctttctattacataggatttaattgacatggacagggaggacgagcaatcgggaagaatggatgacattcaccaccgtcttcattctgcttactgccagtttgctgacactgacgacatacctctgaaaggagttcacgttgacagagatgcagatgcaagcggaagttccggtgaatctagctgcaaagaagacaccaaccaacccacaaccagtgacatttctcaccctacactggaaggactccctgtaaaccggctacggcatgcagtgaggtcgctcagttccatcatcaggttacagaagagaggcctgtcaccacagcccgctggaccctccgccgatgtaaatccgcaaactgcataagttttgcagataggacatacatacagtgaccaaagaagcatacaaatgaatatacaaaaaaaaaaggcatagagatgcatataaaagaaaagaagcatagaaatgaaagagagcgccatctgtcctagttgctagggtaaaattttgtttgttttaagttttaactagtgcctgagcaacttgtgtcagatccttttggccatacaaaagttctgattcttcaattgattggtgatacttttggtcatatactactactgtcttccacaacctggtgatgcagttatctggtttcttttaaaatttattaaaccagtttcttgcgcttctgtttgctggggggcatatgatgtttcagagttcagacatacggggaagctttgaatacggtgtaaaccaactggaaaaaaggcacagaaattttcacatggttttgagtactcctgaaatccatttataacggaatagaatggagcatacaattcacagggactaatcacgcaagtggttaaacgaacaaaagatttttccattaattgaaacccgatactactacacaagcacaaatcgcagacgacgacgacggcgagcggatgtttattcggtggcggcgaaagtcacatgatggcgcagaggctggacgacggggcctcgccggcggcgtcggtggcggcggcggcggccttgtcggcgacgcccggccaggcgcggcaggcgcagtgctggccgtcggcgatctggctgtgcacggacgccacgtggcggccgcacccggcccacgtggacttgccgcacgtcccgcacttcacctggtagcacatgctcgctcgctcgcc

SEQ ID NO: 81918 - DNA, 1452 bp, Oryza sativa
tctgcttaatggcttccagcaaagtgggcaaacggacatacgcttcactccattcaccgtaaatgagcttcatagcctcctctcgtgccctccaaaccttgccatacttcaccctatactggaaaacttcaaatatatacaaagctaacgcagaagcagagagtgtaggttgtagttttatggcattgcataacctatttgctatgaactttgatgtcagctgccggtggctccctgaaccttcggcagtagcacaactatgttctttacctacccgtgatatcctccacgtgccactagacctcttagttgcatggaccttccatttgcaccgtgggttttcacatttaacagtgtacctcttatttgcggcagaattgacaacacggtatggacgatggtgcacgatggcgtactcctgaagccatagcttcaatgcgaccatggatgggaactctaaaccctttctgagaccatccacttggaatggttctggcaactgatctcggttgatgccgccatctagtagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtccacatcatctctattgacttctactgagacagaatcgtgaccaccactcaattcgacatcaaagtaatcatctggattcacatattggcctgctacttctgtcgggtattcagggttgactccgtacgacgaccaatgaacactcaccgacaaatgttcacttagatcaagcccctcttgtactaactcccttttcatctccctcgctgcatccacatcatcactaccgcaatgtctctttgatggtcctgcctcccataaatcatttccaagcaaaggtctcttcttctctccttccccctccaagtcttcccgtaccaactcagtcttacttgtaccccctccacgacgagaataatatgtcacaaaattcttctcaacgtaatgataagaaggagatttgtttagatccaaattttttacggtacgaactaactttgatgcaaacacctctagagatctaaactgagactcttttaccaaatcaaagtaaacttcccattccaactgactatcacatttaatatatacttatgcccttgaccaacattggatctccaataaaaacgaatctccacattatcttggtccatccaaagaattttttcactggtgaccttagttcatataagagtggggggggtagaaacaaacatgccgttcaatgacatatcctcaaactcaacatgtgcaccaacataaggttccaccactctaccaccgtagggctgcaggaa

SEQ ID NO: 81919 - DNA, 9120 bp, Oryza sativa
ttacggactgaagataaatacataagatgttgtatttaacatttgaactcttaaagttcgaacataatcatgtaagagaggctccatagctcaccatcttgatctctcttgcatatttccaattgtaaatgtctccaatgatgctgaaggaatccgtacatggagcatatcttgtccaaaataattcagtggaagaactccaagtacacaaaggaaagcggctaaggagaatatgcgtatgctattgaaaagaaaaacacataagcatatcttggatataaaaccaaaattgaagacttaagtaatatagtgagaatgcagtaggcaaatgaatacatataaagtaataactttatgtggcataccatgtgagaccccgatgaatgttggtatgcacattatcaactttggcataagattttttattatcattaacttttttgaagttatttgattcccatattattttgtgtttttttttacctatcctatttgacagaggaaatgactcatcataccagtcaacaattagagattaaaaaccactagtttaaataatcgtatttagcttgattttcattttcaaagcgccacggcgaaccttttaagtgaaagtataagttgattcctgatggtctaaactctcaaggcacacaaagaaacagcataaaaagaaacatctatataaacttcaaataagataaaaaatattaaagtggaacagagaatcaagtaattgtgtacatacctaaatacaagaatcctattgaagacaactgcatccaacccagcagtagctaagagttcatcctccgtgcatcgaagacttctcaaaatccagctagcggatggaacaaatctctccaaaataaaagcctccctgagcctactattctcctcagcaatccttcttccaaaatagaccttaacattttgcggttgcttcctcagaacggaatacagtgacaaaaaaagtatacagaggctaatgttgattccagctgaggtcaaaagagcgccgactttcatctctgtcttatgtcatctaaatgcaacaaacttcgtatctcctttaattctgcaggaaaagattggaagttcaggtttgacatacaagaaatcatgagaagagcatgcacgctaaaaaaacagcactgcaagccatcctttggatttcttcaaggttacaaaatgtatgatgcagaagcatatttgaggcagctaactaaagagtagcatgggctattttaaggagataaaaccctaataccttaataagacatggaatacacttaagcatgccatcaagagaaaaaacttcaaaaatcttggaacaggcatcacgcagggacagattttgatttgtaccagaacaataagccagactaaaatcaggacacccgtatactaatgtgaatagttcacaactcagacctggtccagactcaaataaaatacaaacaaatatatttcatatggttaaccgcttactctaccaggaaaaatgttctgtccttattcaaactggtttatctttgtccctaaaatggcagtataagaatgttaatgaagacggtgagtagaattttcatgcatggaagcagagcaaccacacctaaatgcagatcaagcgaattacgatattctgtcttctttagattagaataaaatatatccaggaatcaggagaagtgtgctgccaggttggttagggagaagaactttggtgtgaaattatgtttaaatgaggctcaatgtgatgaaatttgaattatgaactactgtctattcaataccaagttgttatctgattaatcattcataaacttttctatcaaggtaaagcaatgaagtagaacttgttcagttttttttcctggcagaaaaacagtggtatgaaggttctgaaaggctagtaagtgggtattcgtacgctacagatcacccactttctccttaataccattaacatggaagtccttcctttcatatccagctttttacaggtcagccacttcgtagcaattatacaagcctaaaagaccgcttatgaggcccaattagctactactccttgaatatgccctaattagcaattattggtaacaggttgggcaccctttccttgtatacagccttgtagaccttcctttagaaaaccaaatggacccactaaaaattgaaatgagggcctggaagcaaattagttcaagtagccctgcaggctgatctcctatgtctcagattgttgcattaatattgacgagctatgaaattcattgtcctttcgtttctattgtccttttttttccttccattattttaaagataacgcggaactcacctcacctttcaaatacaccaagtagatctaaaagaagctattgagccaaggcaaggaggatttgttctcagtatacagccagagcaaatgtaagtggctaataaacaaagcactcagatacgatttgcaaagaaagatggctggaaaggcatgagaaagtacaaaatggaatatctgacagatctcatgggaggcatgaagaatcttaaagagagagaaaagaattttgtcagtatggtacaaagacaagaactaatctcgattccactacccacaaaggacgttttacactttggaaggccggtaaccgtttcagaattcatattattctctcagcatcaaaaggctgcttttgtcctcctctttttaactaaagataaagaacaatccatcaactgtcagagtttaataataagccttctagttcactcaaagtaaaggcaacaatatcctgcaggcatttcatttatccgctgtcttaaacgctaggattagagcagccaatcttaagaactcatacatcccccaaatgcatcggaaattcaaaaactaaacacggttgtcgcaatctcccaccggcccctggtgaatctactgggcaatacaacaacactacgccgtcagattccagatagatgaacacaaagccgcctcctactcacaaaagagacagaaaacttgcccgtcgcgacgcgcgccgaaaaaatcccaccaatgccccccggccgcgcctcctcaaaacccctgcaccacttacaaacaccgaaaaaatagattcagatcacacgcgcacgcacacaaaaggagactagaacaaatccgcgaggcgatcggagggcaaaaaccacctccacttcgccagtcgaccaccgccgccgccgacgcgcgatcgggattcgccgggggggatcggagagatttcgagaaagcaatgtgtggtgggagatttgcgatttggtggggggtttgggttggaagtttcgatcacaaggaagaagaagaggaagaagaaggaaggcagagagacgaaaagggaaagcgacgagaagagtgggagaggagagggagagtagcagtgggagctagaggagttgtcaaatttgtcaaaagaaaaatattcccaaaaataaataattcgaagtgggaggaggccggtggggtgggcccactgcggattggggtgggtgccacgtggcggaacagcagtggtcgagttgagtcggggacccaccggatgcaggggcatatcctcgtgccacgctgtatgtgcgggagttaatttgacaagatttagtagttactccatcatcatggtccttgttaaaactccatcatcatctttgctttgctcctttgctcaactaggaaacggtgaatatccaaaaagtttatttacatatacacagcatattagcatgtacaaactcaaatatatggtactggtattcagtagggagggaataaatgttcttgtggaaattatatcatgccacattagtaggtggtgtttgaatctcctgaacataaataataatatgtgattaattgttttaattattacaaacctgaaaaatggattaatctgatattttagaacaactttcatataaaaagttttcgcacgaaacgcatcgtttagcagtttgaaaagcgtgccactttaattcaaaatttaatacactcttttaagtggattcgaacgcagccatagtttaggtgactctaaggaggtgaaaaatattgatagaacaagaaaaaattacatgatcacaatggagaatcactcactcggattaggtgtttggctaaaaacattagctctagatcctaatgagaggacttgaagataatattacccctttatgtactaagaagtcctgagattaatatagatatcttctaggttaatgtaatactaatatttaggctacaattagcagctgagaattgagagaagatttctctcgttcttcacgtgcacgcttcccaaactactaagcgctatatttttttgcaaaaattctatagaaatgttattttaaaaattatattaatcaatttttcaaatttaaatagttaatgctcagagcctcatcgattcccctaataagcctaggccaaagccaaaatttgacttttcaaaattaagttgatttaaaaatatttttaacgtatctttttcacccttggcttttaagtcgctaaaaacatgtatataaaagttttatttataaattaaatttttgttccctaataagtgttttggctatggtaaccgatgagggcctcaattaatcatgcgttaatggatcaccttgttttatgtattttctcaatcttctcttttcctcttctctcaaatgcggccttagtatacttacaaatgtgtgcaaatattccaatacaattactacacatgtcccatattaagtttatttttggtcctcatcatttttcttaaaataagtattttaataatcgttgcatcggagtttgtgaaagtagaaaataattacattgggagtagattgtaacatcctcaaattttaaactaaaatttgactgcatcatgctggctttcgattaaattagtgtgttttaaaaatctatttgattcttaattggttcaagtattacttccttggaaccctattaatttaccctaattatttcctttattccaaaccctagtgaatttgagcaaattctctcaaatttcaaactatagattatttccttagtttatcttaatattaatgaggatttgctatacttcaaaccctagtgaaacccttccaaattcatagaacaaattcaatcctttctaggaaaatattcaaaattcttgaatttcactgttcattgccttcaagatgttcagcagaatgcctagcccaactaactcagcccaatccctatccaatcttgcacaaagtctagaattgatcctaggggaccacaccccactcaaaaccgtggctttctttacttcttcctccccttcacacgcgccgctcggacatccgacttagccgcgcgccgtgccgccgcgcgtcggtctcgggatcgatcgcgcgtgcccgatcgccttggcgcgccgctagccgttcgacgccctcagaccatcgccgccgcaccaatcacggcgacaacaaaaccgggatgacaaccgccacaaggaatcgccgctcgacgtcgtgcgctcccgtccaagccgctgccgagtgcgatttcgcttctacccagagtgaatcgcgccaattcttgccgcacggttggatgaaagttagacggtggtttcccctctcccaattcaaaccattaacccccaagccggccgttttaaccctcgccgccgccgcgcgtcgcgcccggattggcgccaacacatcgccagccatttctacacacggtcaagccgatccttcgctggtaagtattcaaacatggcctcccgccactcaaattgatcttggccaccctctcacagcctctgccgccccaaccatatccaaagatcgagctcatccatggcgatgatggtgcccgagctcatccgctcctcctagccctataaataggaccccaatcccttccttgtccatcatcgatcatcaacaaccatagccccacaaccccgaagctctgcttcgccaacccattccatcaaccaccatcgcccgtcggtcgaacaccttgtgcgcgatcgactccacacccctccatccatcttccaccctaaataatccttagaacaccttatatcaaccatgttctagcataatagaccctaaccgaagccctgcgtcgagttttacctcgccgcaccaagccgagcaccgccgccccgcgctgctctgttcttcaccgctgagaagtttttccggccgcaatccttcgtttcaaccgatctcggtgagttcttccattttaaccatctacatactccctagattccattttagcaatcactttgcactatcatgtcgccctctgggttgccgacgtgagcacggccgccgcctatggaggcgctcgtcggcaactaccctccgagccttgccaaaggttggcaagctgccgaaatccatctaggtacctcgtagatgctctaggagccctcccctagccatgtctaactcgtaccatcccaatcgccttcacggcctaaccgtgctgccgccgccctagccgctaggccatccacatatcaaattaacccctccgtcgtcactcgccatcgccggagaaccctagctccctcccctcctcagccgcaaccactttccctctccatcgccacagcaatcgccaaccctagcatcgccggcccgatttggggatcggctggaggtagaagaagagaagagaaagagagactgacaggtggggcccgcacacagtaccatttcacatttatttgattttcaaactttagaagcccatatcttttaaaatataaacccaatttcagtgaaacttggaccaatattcttctaaaatcattctctatattttgagcccctttttgctatttttgcattttatttcattttctccatttttcttatttttttggattttatttgaatcccttttgaatttgaattttatatgtctaaccctaggtcttgaagattcttctgacacactagataatatcaatcaatctcaggacatcgagcaaggcaagttaccatataccttttgatcatttaaacctatattttacaaattagttatttataacctcctattcaatattctattttctatgcataaatcaattatagaaacccagataatttagtattgcttactttgcttacaatttggttaaaataccttatacttagattgggacagtacgtaagatttggatgatttccgggtggctagtactgtctcgatcgatataagttttaccaggtacttatgtcgaacaaacgagtacgaccacagtttctaaaatggggacagacttagttattatgttaattagcaatatggcacctctgtatagtggttcttatttttaagttaagtcctcgtgcaggaggcaactatagccgcgaagggcaactttaaccattaccatgtacaggtaaatgatttgtgatactcgagtataaactatatggtatatttctaaaccctgatcgagatgacgtggtgtcatacgatcagttcccccttaaatacctcgggaacgccagaactcatcttgctgctgttaacaatacgttcagagcatatgaggatataagttcatggaacaggtgccataattgttaatgacttaatactgggccatgactaaagccgatgattatcaacaagtcgtggactgcgggtaaagcgtacatctactgcagtagaatatctttgaaactattcgaatagccgtactcatggagttgagtactgggattcatatggtaccctggttagaaatctaaagtctatatgttttataaattcttgctataactcttccagattatttattactgctttttgcgaagaaccctactctatgctaatgcataacatatttccatgataacttgcttagtattatgaatactcatccttgctcttataacccctttttcagatctgggtcaagaggagcacccttatgactattactatgatgaccccgattacttagagaatccataaaggttatacctccctagtcagaatgtatagaaacttccgctgtgtattaattattaattaattagttaggtgagtacctattattgtaaaacccttagtattgtaaaactttaacgtatgcaatgaagaaccagttatattgtatgtatcaatatttactgatccaaggattgatacattatcttagtcgggtctaagttgttagttccgggctccgacatagataaagtgagtaatagtaacattgagattggataaagtagaggtattctagtcttctggtatttgtattggtatgtgtgcgatggatgaaaataaacttattttgagacagaggcgatacttgtgaaaaataagtgtggtaagctagttagctgctcccttcatcccaaaatataagtatttttagctatgaatctgaataactgttgttacattttaggatggaggtagtagtcaaggaatggccttgcatttatacctgagcacaaaaggtctgacgtatacatggagttgatatatggtttgtaataggcaaattggacgcctcattgaagagaatggtgcgttggaccatagaacaacgtatggggcggatccagcgttatatgagtggtttcagctgacaccagtaacatttgccgtaacccatgtaccccttttattctaacattgctgatcaatcagccatgtgttttaacaccaaccatcagctaaaatcagcgtttgcttttgcttagcccgtcaactttcttgctcagcccgtggcgaacgtggcatcggcagtttatcccttcccctaaccatggcaaattcactaattcctccatctaatttccgtagcaattttgttcttgtctacctgttttttgtttttttagataatgttcttgtctacctgttaaggtcacccaattaatttcatgagaaacacctagatgtcttcgcggatttaaaaaaaaataatagtgagagctgaataaactacatcagtataaatcgaacctacagtccccacatcttttgaatctatggaaaaaaaattagtgagagcttagggggtctccactgtcccaggggtggtagtgggg

SEQ ID NO: 81920 - DNA, 28834 bp, Oryza sativa
tcaaatattggttgaaaaatcaacggcgtcatacattcaaatacggagggagtagtagcgttattatattatttgaagacggagagagcatagcaaattaagaaaataccgtcgctagcttctcggcgtgaagtacggtgtctctgggtgacggggttttaattgctgcggcagcgaaggctcaaacaaagaacaaaaactacttgaagttgtagtggtagaacgaggctgaagttgccacgtaggagtacagaaagtcaggagtggggcccaccggaataatctgtctcgtcactagaatgttgtttggagaaaaataactgaggaagatagcactagtatttacttagcttatcttaaatatgttaaatgttacttccctaactctaattataagacctgtatttttttacacggtcttcaataacgaccactattttattttattctataatcctaacaaatatgaaattagcatcacatgaaaatactttaaaatataaatataatgatataacatgcataacacttagtatatatatatagttagtatgattattagtcaaaaaatatcgagtttgatttttcttaaaaatagggcgccctataatttaggacgtactaagtattaccagtagtattattacttctgtttgattatgtcgttgatctcttttcacatgtttgacaattcatcatatttaaaaacttttttataattataatttattttcttataagttattttataatttaaagtattttaagaataaaacaaattgtcaaacatgtgtttaaaagtcaacggcatcatctattaaaaacggatggttatatatatatgttaatgattggaggtcgtatttggtttggtatatgattccttagaataaatacacacggaagtcatggctacctaataatctggtacgagctgagtaatagtacaaagttatatatcatatggtagtttaggttatccggtagttatacaaactaacatgatactaaatttaatgaaattaagaatgtgttggtttccaattttttttagcgtgtgtaaggagcaggtgtatgtgtatggtattatatatatacagtggtgtatgtatgttttttttaatgaatcagcgagccgttaattttatttaatatagaaggagtaaactgtaaaaataaaaagctgtatatacacaggaccttaggtccagcctagctaaaaattaaaaattaagccaatcgctgagactcagtgtatgtatgtttaatgtacggctagtaagaaatagaaaagctggtacatatttatacatactatagtgtcagtatggaatgaaccatttgagatgtcaaatcgtctcatatggttatacggaattttagaaaaacaccgtttaacgcacaagcatccgtccagctcggtcctgttccggcggtccggcaggattcaaccgattcttttgccaaaagagagtatataatctgtaacttgtattgtatttggatcacaatctgcattcataatatcgttgtaattagtctctaatttgtgttgtgaacattttctcgattgttgctgggtgaacccattttttccgaaggaagatcgccggctgattttattaacgaaaaacaaatggatagcactccactgctccaattttaggtggagctaaaattgtttgactgggctcgagctgcaaccgtgcaaaacataccctacaacaactatagcaactactttctgtcttaaataagtttatttttttacctattccacacatattaataaaaaatagaaaaatagaatacatccactttatccaataccaatatagttattcctcagtttatatattgctaatacatttactcctattttcataaactcagatatataattattgaaaattgaatttaatttgagataaatgggaggaaaaaaatgaatttattttaaacggaaggagtaaaaatgaaaatatgggataccaaaaaagaaatacaaggagtaacttagtatttatgatagtataaataattttaaactaattaaagatgcacgaattatactcgtggatatcataatttgaaaactagtgatgaagccgtgtatctactgctccacaccgcacattgatggtgcttcctcgtaaacttcgacacgaatattagggaatgacgtaatatcaaataattagaaagagtgaggctttaaacccaggtcatctagtccaccacattgtgaagctagctggaaaatccctaggagtttctcagttcctcgtaaacttagtactgaataccgaagttaataagaaagaactgattatgtttctttctagaactagaatgttaaagctgaagcgaaatgagcgtagttcaactggttagattttatacggtggaacaaatccatctagatttaagttctagatttgatacgggtgttcacatttatagttaattattctttcagtgatatgcagtatacctatcgacagcgagatgtccgtgtgagcgtgtcaagggagcaacgcgaatcgagcaccatgatggttgttcttgccatctgtgtttatctttgttatgggttagcaattagaactactcacttcgttccaaaatataaaaacctaggaccgagtgtgacatttcctagtgctgtacagattcgtagtactaggaaatatcacatccggtcgtaggttcttatattttggaatggctgtccagattcatagaattaggaaatgtcacatccggtcctatgttcttatattttggaacaaagtgagtatttgtttgggatgcttagggtcatgatccatgagttggacaattagggcttgtttggcacagctccagatccacctcttctggaactggagctcagcctaacaattttagcttcacctaaaatgggagcagagctgggtagagctctctcacaaaatgaactagagaggtagagctgggtttaggcaactccacaactccattccagacccaactcctggagctaaatttaggagttgggactctaccaaacaggccctaaatatacccattcatcaatttaaccaatacaccagatatatttcatgtctggtgttttggttaaattgatcactttggctactcatcaatcgacaaccccttctccgatgaggtgcggaataaagtagagttaagagtgggagtacaagaaggaaaaggaaacttatcaagccaagccttggagggaggccttgaaagcagatccaatacgcttcatgtgcaacttctgacaaaaagagaaaacactctaatacaacaaatgcaataagatattgattataaaaataatcatcaaacttcaacaggagactacccttcaccttcttcctctactacattggctgaattcgccttcttcctatattccagttgccaaatatgggctccccataatataggctcacagcgagacagtgtgagagcccaaatttatagaaatcgagcttgcactagagagaaagggcctcacgatatcagctcatatggaggtggcacgtaatagatcaagttcttcatagtccgaggctccgatgtgtatggctataaccattgtggtccgctccatatcccttgttctccattgttcctcacaggatcaggggtggagagtgaagagagagcagaacgagtattatttctcgtcgcatcggatcacaatggttaatctaattcctgcaaaaagaaaaagatttactattttttatgctaaattcttctgaaattcatacctctgcattcaaaagagccttcaacggacgaacgtgagttccctcaatcagaatcagcggctgagatctctgccagccgtccactccatgttccaccacctccgccgccgcctcctctgcaccgcggcggcgccgccgatccgcgtggcgctgacggagtcctccggccgaggggtcttcgccacccgccccatctccgccggcgaggtcctccactccgcgcagcccctcgtctcccacccttcccctcccctcatccacgaggtgagttgctccgctttactcgcctctttgccgccggccaccgcggctggaaactctaccttctccttttacggacggagcgaaatggttcggattgggctcctcaggtgtgctacagctgcctcaggaggaagtccgggagcggcggcggctcgagcgggagctgctacttctgcagcgacgcgtgcagggagcacgccaaggtgaggccttaacaccattgatttatgtactagtagtataatgacttgtgatgctacaaaattttcaagattcagtggatgttagtgtactgttcttttgtcatttgctcatttccaagttattacgatgctgtatcaagatccagtaggtgttttgcaacaaaatgtgaatggtagccttccatggtcagagcacatgaatggccaaaggcttgcaatctttcacaataatgttccttgaggaaattacatgtttatttgtcctcccttcgacaagaagatatatctgcagagggcaaccgaggatggtgttgtctaacaaggtgtgtgattttttggccaatttagggattccatggcgttgaaaagaaagcggattggtctttgtttgatgaccactgcaggtatgtctctgtccccttgtgtagatgtgtgcatcctgacctccgcattgcatctatgctcatgctcttgggttttatttttacttgttaatgccatggcgatgctattttgttaagcacgcaattgtcttggtggcttttgacttgaatttatactttgcttttcttcctgaagttcacgcggtctaaagtacccgtacatggcaaagcgactagcttgcatggttatctcaggagctgttagtgcagactgtcttgacatactccagccagcccgtttgcaccaggggacacttacagaggtagctgctttatttcagaactattgttaatttcagaacataatcttttcaactaattcatgtcctgtaatgttatttgtctggtgcttacttgaacaatgtaataatatagatggaggaagagtttgcgttgttggattccacttttaggaaggcagggtttcaggaagaaatcacaacttgtatccttcatttttctcacttgtgttatttatggccaagcagtgttgaacactaatactgataaagatacgtaatagaatggatcgaatgcatatttcaatctcgcccaacttatcttttcttatctatttttctttgacaaattagttttgaccaaagagtggtacatcaatgtgctggcaaggatacgcataaatgcattccgcattgaactggttgcaagttcatatgagaaccttctatcctcagcagtagcctcagtatcttgtgatgcggcagttggcaatgctgtctatatgcttccctctttctataaccatgactgtggtatgtcttttgaccttgcgctgttgaactaaagcaatatttaacttccttttgcctacggaatatttaaacagtgtgtcttgccatgagatacaagaatttgttattgcctttttgttgtgatgcagtaaatggtgactgttatttctaaattcttcattagcatatgtttatatctagtattgactgattggtttaccgaaattattctcgtcgacttaatatcatcgagttttgtggaaccttttggttattaatcactttagataattagaaaacaaaagtcgtttcattccgagtaatttttttttacttggatcaatattatcgcgcttatttttctttgaaatttgagacccaatcactcaccatctcccattattaactttcagatccaaatactcacatagtttggttggccagcgcagacgcgagattaaaggccctccgcaacatcgaagaaggtacgtaaatctgcggtgcgctggcccagttattctatcaccagccattgagcgcagttgaacagaaagacaaacacaccgatggctgccaaaattgttgatactgtggatgttgcatctgctatatactacaggtgaagagctgcgcatctgctacattgacgcgagcatggacgtcgatgcccgtcagaggattctcgccgaaggatttggcttcgaatgccgctgccaacggtgcttgtctggagattaaaacaccatccctttttcgttgtattttccatccttttggcatgcacattgaagccaaccgaggttaattaccattgtaaacttttcaaagatcagttgaagccaggagtcaccaatgtaactgccaggtgctcctgtttggaagatttgtaacgtgttggtgtgtgtgtgtcgacaagagtacgaatactgaatgttgttgattattaccccgatgtttaagcattagacttttggacattattagacatttgtttgacatgttactgccatgccaataacattggtgtttacagaatgtcttgttgtatgctgcaactttaatttatggataagagggtatttgttctattttcttgatgcaatctccctagtgttgcagttcatctgtaccactgtacaacgcgtcatgcatagacatccagtcctatctataacattgaagattactgatgtgcaacatttcatgccaaaataaatagcagatctggcactctagcgcatccacaagaaagcatgatgttgtgtccatatgattgttcatgttattaccacttagcactatctgtcaaattagaacccaaaatactgcccacaatctgttttgtcaggttttgcataagcggaagaaatagcttatatcaaagacactctaaccttatagtatttgcaaccgagagatcagcttgtctgtcattaatgatagaaggtccaagcacatcagttacaaaaccagccaatacataactcaagcagcttataccaaaatggaattttgatatctgtcaacacaatgccacctaaacatggcttgggaagggtgggtaagagactgaatcgtatgcaatgcgttgcatcctggatgacagcaccattctcacaatgatcaatgaggggcataagtttcacattttttttgggcatcggcattctcatgctatcgctggccagtttagttaccaaagggatccaacaaaattttactgaccagcactcactattgcggtcttagagaaacaaaagaaacaaaacaatacaaattacaacagataatttaaaggaaataatcaggtgttctccgtgtcacatctggttcacctctcctaggagctggttcaaactgcaagaataatccaagttgaatcccagggaattatttttacaacttttacagttacagcacagcaaaagagaattgatccaacaacattactaatctgtttttaaatcagttggtatttacaatttaccatacctgtataatgtgtaagctacatgtagttggctaataatatcataagtaaaacaaaacttggcataataggaaaaggggatcagaaagaataaattggtatgcacctgaataaatgtgtgattcctgcagtcatcaacctccaggatggatgccatgttgccacagcgataacaataattaggtgcactgaatatggtcacgaccttttgttcctgtgcgtggtgaagaataaataagacaatgctagttcggtagcaaaatcaacaacaaaattaaatctagaaaaatgagaaaattccctatgtacccacgaaagttcacctaatcccttatatgcccctgaattttgctcattcccttatgtacccctgaattttagtttggatcccttctacgcccggtcaactagcggaaagggcatggaagagatcaaaactaaaattcatgggtatgcaagggaatgagcaaaattcaagggcgtagaagggattaggtgaaatttcaggggtacacaagaaattctctcttaaatctatgctaagcaacttacgtgcgcccagttatatccttccataactaattgatgagcccgggctacaagtttgagattattggtatggttaaactgctccgatatgtcctgaaaaattgaatgtgtacggttgagaacagaacagatagtctattaatagatgaaagaaaattaatggaaaatagagtatttagtacctggccaaaagtgtagccagcaccacgaggagatatgccccaaccgcatcgatcatccgggtcagaccatagaagatcacacattggtccctcatgagggacctcttgaacacgatctaagctgcgaacactatcaagattgtcgattgatggcgataaaccaccatggaggcagaaaatctctgattcaaccttcaaccaagacaataatttaacatcaataaaattttctgaacaaataaaaaatgatttctaaacttctgagcgagaacagaaacatcaactggttattaagaggaaacaccaagttaaaattctacaggccaatcaacaggtaaaaaatgatagatcaaataaagaatttcaactggtcttgcacatatattatcaactccaggaaacaaaaggaacaggaaagaaccaacaattatggctgcataaacacttggttgcctacagttgttacagcaattttggttttcaggaagaggaaaagcttaatcagtaattaaggcagtgacacaagggatgccagcattattgacccccttggagacaaaactcattcaagaaacaatccaaaaattatctacaagcaccagaaactaatcagtccaaagaggacacacgtttagactactgaggccagattttattttagagagtagtggttgccaaaagttgataaagtagcacatgcatagatgataataagtgggtttcatctgagactaacttaatctggtattggcttcagattttcgtatagaacattgagcaatgttcatacagaatgtcaattttaaaagaacaatagaaaaaaaaatcatagaaggaagaggactacaagttgagcacgcaccaatgctgtcaatggaaaatagtcaaaaagatcggtgaagatcttccagacatttgcacttccatacctaatcaaaaagcagaacaagatcaatcaataaaaaaaatcaagcttgtccactttgtattcacaagtcaatactacaaaaatcaacttagatagactagagttttccaaactattaactttggcatagatacagaataagtagactttcaagcacctaaactgactcactttcgtaggcattcgtcgtagaatccatacacctgtgtgatctgcaattattgaagatttcaagacagtttaaacaaagatggaatgaagagcaaacatcatctagatgagtccaaatgaagaaatggtttaagaagaaaggttgcattttagaatgagaaggtttctgttttaaatttatttgagggcgggaaaagaaaacaaacaatagaatcatctcatgggcatgatgaaatctacatacctgccgactctcatggtttccacgaaggattgtaatccgctgtgggtagcgcaccttcagtgcaaccaaaagctgggcaatggtaccacatcatgtcaacaagtaatacaaaagaaattaggcttcaataccattaacttaaacacaaatattgccgatacatctgctaggtttgaaacaaagagctgccaaaccatgatgcacatggtaaaacatggtagggccaaacgtcgtaaacaaacaaaccataagcatgacattgttgaacttcaattaaaatttcagcaaacaaaatcaaaactcaggagacttactgtaacagtctcaacagaatagtagccacgatctacataatctcccataaacaaataatttgtatctggacactggtaaacagtacaaaacaaatgtcagcttttaaagcatgaaacaaagaccaaagagagcagaaagaaacaaaactaatgccaatggattgagtaccttcccaccaatccgaaagagctctactagatcatggaattgcccatggatatcaccacaaattgtgactgggctcttaactggctgtatgtaaagtaaacaaatggttatagtcatatcttatattttcctagaccttataacataaaggcatacctaatatgttgacattgggtaaaatatttgtgccccctcaacatgcatagttacaagtacagaacatcaccatgcttgtcttagtcgcatatacataaaagattgttctttgtggtgcaatcaatgattaattagttgtgctgacaaaaaataaggaataccagacataagtcacccttttggttgtagctatacacatttaaattgctagagatgaaaacaaaatgtgagcggctatgctatgtccagactgaagctataaggttctctgtaattttaataagaaaattatcttattatgtaggtttccattgaagctcgaagaaataaaaaaggtgagcaagtacagaaggaaaacatcgcagttttgggtatatgagcgtgctggctggaggggtgaaacatatccttgttgtaaacaccctagagttgtgatgggcttgaaagtcactcaccctaatttcagatcttcccccacatttttcactagatatcttcccaatacccaccagcatacagaatgtgctgacggtaacaatataatccgcagatggaagataccttcataccaatcccactcagatacttcctccgtttcatattataagactttctagcattgcccacattcatatagatgttaataaatctaggcacacatatatatctagattcattaacatctatatgaatgtgggcaatgctagaaaatcttataacctgaaacggaggtagtaataaataaaaaaaatatcaacttcttgcatgggaaaagcatgataccgcaaaaaaccattatttttcatgtccatatcgagctagatcctctcacaataaaaactgaaatgagcatgccaactacaaacagcacagtcaccatatcgctggtgttactcgggctgattagagccacacacacagtcaccatttttatcagaagcaaccggcaatcaatactttcagcccagcacgcataccatcatcatactgcagggcatggcataatcgcaggagagctccaccgtacctgaacgttgctttcttccatcaatatctccttcgccttctcgcacaacgtcttgacctgaaagcgggccttggttagttagtaccagaggcaaaagactcacggattccagtacatttccattggtcaacccaaggcatgacgcatgtcaccgaatttttttttaaaaaagaaagaaaacagaagcatcgcatatatccaaaaacaaaggaaaaaagcaagcggatttaagcgacacaggcgcatatgtctcccgcccgagagagattcgattcggcatctgatgcaaaagctcacatcgacgtatcccaaatccccccgatccggccattactcctccatttattccttctcctcctccccccgcaataattcctagattccgcctgagatctaccgaacccgaaccgcaaaaccgagataaccctagcagccgcctccgcggagaagctgaaacccatagggcggatccggcaccagagaggaagccgtggcgtggcggcgctcacctcgggctcggagagcgggcggcactccatgagctgctcgatctgggcgtccaggccgccgccgccgccgccgcgcgagcccacggactcctccatccttcctcccacctcctacgccgcagacaagaggggcacctggtctaaccctagccgggggagagctcgtcgccggcgagggggaggcgagctggagagagagagagaggagagagattgagatgcggttggggggcgcgagggggagggagatggtgcaagggcagggcaggcagccaaatgcggggggaagcgatcgagccgggggggtcgggggtggggcccgcgtgtcagtgtcgcggggggggggcagaggaatgcggttggattggaactggagaagtggaagagagagcggaaaaatttttatgtggggcccacttgtcagtcagagggaggaacttttatgtgggacccacttgtcagtcggagggagggaattttgtgtgggccctacttttcagtcggggagagagaggaggagatgagggcgttcaggcgtgggcctggtgtgtgcccggcaatgaatactgcccccagtgcgcactccattttatattacaagttgtttggattttttcttaatcagtttattgagagatatactaataattgtaatataaaataaacatattattaaaatatattcaatgttaaatttaataaaactaaatgttatatatgttgctaatttttttatataaactttgttaaacctaaagaactttaactaagaaaaaaaatcaaacaatttataatatgaaacaaatttagtacttaaaaaaaatgaagattggtggtggtgattttaaccttgacagacaaacttaattctaccctatacgatcgcaagatccaacggccaaatcgttaccttcgcactacttttcataagctcattcagaatgcacctaggtgacatttagtctcatcgaggagatttcactccacgtaggcaactggcgtaagctcccaagaagaacctcatctccctacgagagagaggaagaaggagccagtgaaagtgccacggacaacgagattgtcgccactgagctccatatccatcgttgccgagctccaagtttgtcgccaccgagctccatgtctactaccgccaccttgatatgcacctgctccgaaagggtggctcaatctgccctatccaagcaacgaggagggggacgacggccgtactggagagtggggaggcttccttgcttcggagagcccgaagaggcaataggcggtggcagccggagttggaggcgagttgggggagggagaggcgttgacgagaggaaggaggggtgaggtggcgccggcgaaaggtggaagggagagacgatgctggcaccgccactggtgaggaggcgaggggagagggatcgggtgggaattggctgaggagcgaggagggcatgacgcatgagtggggatagggtgagattttatattatttctagattttagggtgtttagtgcaaaatgttggatcactacataaattaataatagaaggtgctgaaatgcaaaatatatgtggggtgctctaatggacactcggtcaacggggtcaaggcctcagtggatactcggtaattctatttagggcttgtttcgaattaacaaagggaataaacgagtaatttcaatttaggaaaaagtcctataagaccctttaagaataaaggattggatctgtaaaattgctatgaaattccgatggaatggcaatgttttatgcgaattttgtagaattcttagcataagcattgacctcttgaaattttccttttgtgtttatcactcttttccaaatcatatgggttgcatgtgctgcatctaaacagttccttatgtagtttttccagtgtttttcatttcttggattcaaggtgacatgacattttaatcatacatcttttctattcacatgttttaaaaattgtgagttccaaagtcctctaacttaatttctaaagaagtgaacccgcgaattattgaacacgcactacactataacatagatatagaagcactcggtctagcgggataaacaactattagtctgttgggaaagacctttaccgacactaattctgccacgagtgtctaccaggggtttagcagttgacaaaagtttttacatatatttttcaccggtagaagagtgccaacaattcttttgtttttgtgccgacagaccatgtattaatggcaaacaaactattcctagtagattgtctaccagcttagggcatcaacaatgttgttcaaaaccagtccatagtcaataaaataatctattcagctacctaaccacattgtggaagtagtcaataggagggaaatagcaaaagctgcccatagcactatggctaggcaagaagaccataaaaaaacatagttgtacagtggtactgttcataaaatattaaacaaaacaagttgtaaccgttggcttctggccgttggcttcctgaattgtgcctacaaaaactgaaacagcatacatacacccctgaacattgtgcctacaaaaactgaagcaacatacaccatctccattcatcaatttgctagaacacaactagttccaatggatccctcccatagaagcatctcaagtttcacaaatcaagactccccaagccaatactctgagagtagtgaccatatctcacctcctacaccccaatctcagtttctctttgcatcaccaaattatctgcaaaacttcaacccttttggtcctccaataaatcagccaccctttggtcactctcctccaagatttcaaggcgttcaacaccaagggagctggctgccacatactccatcaagctatcaatgatttcatttacaagagagttttggttccttaccaactatgcagtttggagctgcagccaacaggccaccatatgtgctgcaatttagctctgcagttggtgctgcagccaatacttcttcccatggatccgagtctagttctccatgccctgcaagacaaaaagagaaacaacatgtcacaattgaagagtcaagcagcagtagtgaagaagaaccaaagaggctgttggcgatatggcatgaggcccttcgaccaaaatctgccgaaagctatgcgaagagtggggattcaagcccgagacgtcaaagttagtcggggcgaagtccccctatggcgaagactacggaacaaggacggcgagaagcaagggatcacgcgggtactttgccaagccagaggcctcttgggcgaaggatgcagggcgaagagtatatgccgaagggggacggactttgccaaagcaagctcgcccccgcaagggccgaagaagcctttccggtccatcaagcctaggggctattgggccgacgatcgcccgacgacccatcaggggcccatgaacctcaattatactatgtacccatgtaaatgtccctttcataggggtaaccatgtaaattcccctgtataaccaaaaccctagtagtaagaacctgtaatacgggctataaatagtctcatagggccatgtaatagggggatcccaagaaaaattctcaaattaatacgctttacttcttttccaaccactgttgagtaaccacgactttcgacgtatgcggttgtcgtttcgacaacagctggcgccgaccgtggggacctccgagcgaaaccactgagggcgaatgccaccaaagaaggttgtgaaggagaaggttacaaggcgaaaggaaagcgacgccggggcggatatagccgccgaagagggagcagagccttcggcgtccattgccgaagatggaggagcgccatctggttctgcacctgcgccatctctaccgccttcggcccctgccacctctgtgcaggtgccgaacgcggctgacatggcgaaggcggcggcggcggcggcggcaagggcactccagaccagggcggagatcctttcgacaagccaactgctggtgccccaagccgctccgtcgcagccggcagcggccccaactgcgctcactcctgtgcaagcccaagtcaaccctaaccctgaaacacaaaccgaagccgacatggaagccatgcaacaaaacatgacgggactccaagacatgcttcgccaaatgtaagaacaacagtaagcatacgaggcggcaagacagtccaaggtcgcttcggctccaatcctccagtattcagcaggctatatcccacaagtctatccacaagtgccgacccagccccttccgcacaagtcgcgcaagcaccaatgtacttcgccgggcaaccatcgaccgcagcagcgcatccggcctctcacatgcaactgcaagctcaaccggtcgctgcccaagtacaccctcaaccgcctggccaagcaccacaaacaatggcagaaggggcttcggctctgtaggcgcagctccaggctttccttcagcagcttagccaaccccacaacatttcaggtacagccccttcggctcacctggaggggaatacaagtcaaggtgcgcctagttggttgccgtcgaatcggccaggtcaaggggcttcgccgtggagtcaaggaccgcagttcgacttcatcaatgctgctcaggcaccaaccattcggccgcaagcaccaatgtcaggcttcggagcaaaccaggcaccaaaccaggtcgccatgacatggtcacagccaactttcgacccctccatggtggctcagcaagcattaccaatcggagcggggcagccgaatgccatggcccaacctcacgcgcaagccgtgatttagccctttgccacgccgtactcgcagcaaggtgccgtgaacagggcggggggcgaaaaggggctaccgctgagtgggggaatcaagaaccgtccaatcccactccagttcaagttcccacccgtcccacgctactcaagcgaaactgacccaaaggaattcctctccatttatgagtctgcgatcgaagcggctcatggcgacgaaaataccaaggcaaaggtaatacatctcgctctagacggcatcgcccgttcttggtatttcaatctgccagccaatagcatttactcatgggagcaattgcgcgatgtctttgtccttaactttctaggtacctatgaggagccgaagacgcagcagcatctactcggcatttgccagaggccgggggagtcgataagggagtacatgcgtcgcttctcacaagcccagtgccaagttcaagacataaccgaggcgtctgtcataaacgccgcttcggctggtctactcgagggcgaactcacaagaaaaatcgccaacaaggagccacagacacttgagcacctacttcgcatcattgacgggttcgcaaggggcgaggaggattccaagcgatggcaagctatacaagctgagtatgataaggcttccgtcgccgctgctcaagcccaagcacaagttcaagttgccgaaccaccttctctcactgttcgccatccccagccagcgatccaaggacaaccgccaaagcaaggtcaagcccccatgacctggaggaagttcagaaccgactgtgcgggcaagactgtgatggctgtcgaagaagtgcaagccctccacaaggaattcgatgcccagcaagcaagcaaccatcagtagcctgtccgcaagaaggtccgaaaatacctctactgcgccttccacagacgctcttcgcacaccacggagcaatgccaaaacattcggcaacgtggcaacgcgcaagatccaaggccgcagcagggagcagcagtcgaagcacctcgcgaagtagctcaagaataggcaccccctgccgaacagcgccaagatgcacagcgcagagtaatccaagtgattacaagggctgacccgccaatccaactatcgaagtgacaaaagaagatgcagctacgaacgatccacaatatcacttcggcaggcgaaggggctccacagtatctgaaccagcaaatctcttttgggccagaagatgccgaaggagtaatgttcccgcatcaagatcctctggtgatctcagccgagatagctggtttcgaggtccggcgaatcctagtcgatggagggagttcggctgatgtcatttttgcagaagcatatgccaagatggggttgcccaccctagcccttaccccagcgccagcctcgctccgtggtttcggcggaaaagcagttcaagttcttggccaagcacagttgttggtagctttcggcacaggtgaaaacaggcgcgaagaacaagtattgttcgacgttgtcgacatcccttacaactacaacgccatcttcggccgtgcaaccttgaacaagttcgaagctatttcccaccacaattatctcaagctcaagatgcccagcccgacgggagtgatagtggtcaaggggcttcagccttcagccgcttctaaaggcgatcttgccataatcaacagaacagtacataatgttgaggctgaactgcatgaccgggtgaaacacgcgccaaagcctgcccctcacggcaagataatcaagatgcagattgatgacgccgaccccgcaaagctcgtatcgctggggggcgacatggacgaagaagtggcggcaagcatcctagaagtactcaagaaaaacagtgatatctttgcctggggccccgatcaggtgggaggtgtttcgacagatcccatcatgcatcacttggcagttaagccggatgccaagccaaggaaacagaagctgcacaagatgtctgctgatcgccaagaagcagcaaaagccaaagtccaaaaattgctcaaggctagggtcatccaagagatcgaccatcctgagtgactggcgaatccagtgctggtccggaagtcaaacggcaaatggcgcatatgtgttgatttcacagacctaaacaaagcatgtccgaaggacgatttccccttaccacggatcgaccatctcgtggattcaacagctggctgcgagctcatgagcttcctagatgcatattccggctatcaccagatccacatgaacccgaccgacatccccaagacagcctttatcacaccatttggcaccttttgccacctcaggatgcctttcggcctgaggaatgccggagcaaccttcgccaggctggtgtacaaggtcctgtacaagcagttggagcgaaacgtggaggcttatgtcgacgacatcgtcataaaaagccacaaggcttttgaccacgcgtccgacctgcaggagaccttcgacaacttgcgcgcagcgggtatgaaacttaatcctgagaagtgcgttttcggcgttcgcgcaggcaagttgttgggcttccttgtttctgaaagaggcatcgagttgaatccggagaaaatcgatgccattcagcaaatgaagccttcgtcgagcgtacgtgaagtacaaaagctcgcgggccgaattgcggcactcactcgattcctctcaaaggcagccgaaagaggtttgctcttcttcatgaccctccggggcgcgggaaaattcaactagacacccgaatgccaagcagcgttcaacgagctaaagcaatacctgcaaagcccgccagctttgatcagcccagcaccaggaagcgaactgctactatacctagcagcttcgctagtggcagtcagtgctgccctcgtccaagaaacagattcaggccagaagccggtctatttcgtctccgaagcattgcaaggagcgaagacaagatatattgaaatggaaaagctcgcttacgccctagtgatggcttcgcgcaagctcaagcattacttctaggcatacaaagtcatggtgccatcgaaatacccttttggcgaaatactccgaggcaaggaagttactggccagctcagcaagtgggcagcagagctatcccctttcgacttgcattttgtcgcccgcactactgtcaagtctcaagtgctagctgacttcgtagccgaatggacaccagcattcgcccttgagcccgagcctgtcgaacagccctgggtgatgtacgctgacggttcgtggtcgcacaggtgggcaggcattgcggcagtgctcacttcgccgaatggtgtgccgattcagtatgctgcaaggctgcagttcgacacaaccaataacgcagcagaatacgaagccattcttcttggcctaagaaaggcgaaagcattaggggttcggcgcttgctaatccgaaccgactccaagctagtggcagggcatgttgacaaatccttcgaggcaaaagaagaaggaatgaagtggtatttggaggccgttcggtccacggaaaagtgcttcaccggcataacggtcgaacatttacctagaggccagaacgaggaagcagacgccctagcgaaatctgctgcctgtggaggcccacattcgccaggcatcttttttgaaatcctatacgcaccaagtgtgcctgtggaaagcctggaggtcatgacaattgaccaggcgaaactgggcgaagatccatgtgactggcgaacatcgtttgtgaaataccttgaaactggctagcttccggaagatgaagcagaagcaaagcgcttgtaactcagagccacaaggtataagatggtctcaggtcagctatatcgctccggggtacttcaacccttgctccgatgcatctcttccgccgaaggcaaggaaatggcgaaggagttacaccaggggctttgtggtgtgcaccaagccgcaataacagttgcctccaaagtgtttagacaaggagtttattggcccactgtgttgaaaatctgtgttgaacaaatcaagaagtgcgaaagttgccagcgtcatggccgaagccaagccgcgccccagtatgagttgcagcccatcgcaccaatctggcccttcgccagatggggactggacatcattgggccgttcccggtggcgtgaaacgggtacaagttcgcaattgtggccgttgaatacttctctcgatggattgaggccgaacccctcggagcgatcacttcggcagcagtacagaagtttgtatggaaaaacattgtttgccgtttcggagtaccaaaagagtttatcactgacaatggcaagcagttcgactctaacaagttcagagaaatgtgcgaagggcttaacctggaaatcaggttcgcgtcggtcgcgcacccacagtcaaatggggcggccaaacgtacaaatggtaagatcctaaaagcactaaagaaaaggcttgagggggcagcgaagggcaaatggccagaggaaatgttatctgttctttgggcccttcggatgacccccacaagaccaaccaagttcagcccgttcatgcttctttatggcgatgaggcaatgaccccaacagagctaggggctaactcaccaagggtgacgttctctaggggcgaagaggggcgcgaggtgtcgctcgaactcttggagggggtaagagtcgaagcactcgagcacatgcgcaagtatgccacaggcacttcggcaacttacaacaaaaaagttcgaccgacggagctgttgcctggtcatcctgtcttaaggaaaaaggcgaacccgatagccgttggcaagcttgaatcgaagtgggaaggaccatacctcatcaagcacaagtccaggacggggtcctttcgactggcgacacttaaaggcgaagagttcgaccattcatggaacgctgcctctctcaaacgtttttatgtctagaacgggtggcacccaaatcgccaacttgtaaaaatgtatatatcgttatgtaagcccttcggcactatgtaagcttttcggaaagaaaaaaaaagaggaaaatgaaaaaagacaaaaaactggatgtagggctattatccaccacggaggctcgaaccagtataaaatctctgtcctctgccctctttttatttgtttgtgcgattgataatttgcggaaaaaccccaaggcaaacgcctgatcagcgaaaaaggccaggggggcgaaacgaatcggccgaagcatcgctcgccgaacgattgaaaccgcaacagcttgtttcggagaactagtcgaacactgttacactcgatcaaaaggaaagtacgagtgcttcctacaacgtagaacaaagcggatcgaaaatgaaagccgaatgctgaaaactcaaaacctatttcgctaatatatgcaaaggggccgacacgttccgacccaacgaaaagcacgcgaagtgacaatgcaaagatagcgaaaaggaaataaaacgcacctttattgattttaaataaaaatgtatcgaagaatacaaacccatcacaatgatacaagtgaaaggaaaagagcaatggcgttacaacccagcttgcagataaattacatcttcgcccccgcgatcactctctctctctgtaaggaataatcaggcgaactaggttcgtcattactactaatatcatacacaaccctaagaggagaagggggcgaaacacagactagactgtaacgacgctgggagatcgcctcctgccgatcagtcttctgatggtttcgccaaaagcgagccatatcctccaaacgtcttgaatggacaagatcgtagtcttctaaggttcgcctggggtgcgcccgaagccacccgacaaccttaaaaaccttatagctacggccgtttatcaccatttcatgataaacaggccgaaataggcatcgcaccttcggcaaatccttaaatgccacaaatttctcgttttgatttcgccaactctcagaaggaggccggatgcacaactttcgacgaacacactggtagacagtgcaaaaagggcaaaagacgaattgcatagtgagaataggccaaaaaagagaaaatattgcataatgcgaaatgggtataatcataaatacgccaaagacttcgaccacaaaaaaagtggctaagagaatcatatattcaaaatatccaaggggccatttttcggctacaataaggagggttagcggcatcctgccgaatatacatcgttcgccattcccgacaaacacaaaaagaagaagggaaactacaaaaatctaaggaaggggcggagggcctcacacctctgggtgatcctgggcatcgcctccacccccttcggctgtcgcatcctcttcttcgcaccggtttgccgcctttgccttcgcgagttgctccaaaaggcgcgtcttggcggtggaccggccgtctttctgccagaactgttttcgccatgcacgaagcgcgggcgaaatgttctgcgcactgatctcccagtcccccttcgcatagttagggaactcggcgacgtgctcgcagccgaactgttgcagaaggcccatagtaaaggccaccgatacgcgcgcacagcaatcgccgtacgcagtggtgaagtccgaaaccgaaccaccggcctgctgagtccactcggagaagtcgaaggccgaggcatcttcggcagggacccctcgcacctttgcacccatgtcagtaagggcgaggcgaagcgtttggcacgtcgttctcgcggattcggtagttttcgccatctcccgcgaaaactgctgtgactccgccgcagcgttcgcgtcggccttgctgacctccaggcgaagagcctccatctttggctcagtaagattataataatccgtcagcacggcggaatgggctttttctttcttcaatttggcctggaggcgatcaacctcagctatggcctctcttcctttctccagttcggccttgaggcgatcgacctcggccctagcttcctttcctttctctaactcggattggagccgcttgttttcggctttcgcctctttcagggtgttggcgagggcctccacctgcaagttcttgcggcctatttcgtcatccttggcccgaagacggttcttgaatccgtcaagacgggcccgcacggttcactctgtcgaatagtgagctacaagaatctggatgcaaggtaggaatgggcaaagagaacaaatgttaattatgtgacatgtaaaaaagaagaggaaaatcaggaagagagaaaaaacatacccgaactgccaagcttttaatagcagaacacccctcatcgaactcattcaattcggtgaataagctcagggtgctggcaggtaagacaagattgcttactccctccacaaagggaataaggtctgcccgggtctcgaaatcgccaggggcgaaatggggcgccgcaagggaatactccgaggcagatgtttcgacggccgaacccttccccttcgctttgactagtggtgaaacaaccggttgacgcagagggctaccgaagatcctcgccgcagctgccacgattcgttccgcggaggctgaagccccggcggcggcgctaccgcctgccccaccagcgccgatggaaagaatgggggcggtcgaaaggtccaggctgcggccagtgggcgaagtcggagtctcttcaaaagactcgtcgtcgctgaagacgcgagcgacatcgacgagtcctttctttttggagatctttttgaccggacctcccttcgccgcccggcctgccgaaaacgcaattagcgccttcgccccatccaaatcctttcggcgaaggggggagctgttcgactccaccccggtctcgttgtgacctggacttggagtaggagtgtagccaggggtgtcgacgcggttttcgactgccccgtccgcggccttttcggccacgacctccgcctcctcatcttcctctccttcctcctcgtcgtcacgctcttcgacgtcctcctcatcatcggcgtcggaatcggacgaagcaggaacccttcgcttcctaggggcaagcttcacttgcccacgcgttcgctttcgcgaaggtcctacatcgtcgtccgccttgtgggggttcacccgtggaggcaattcgccgttgtaaacccggttcgcctggccagctgcttgtcgcgtcagcagctggctatactcgacgactgacacgtcgccgatcatcctacgggcttcggcgtcagcctggtcgagggtcaacactacaaaaataataggtgtagccacatcaagcgtcgaacaaagcaaaataacaaaagcaggagtgcgtagcgaaagagcactcttaccgttcgttccctcggggagaaccaacttcggcaaaccatcaacctcttcgccttgatctactgcgacttgccatgattgagagaggggaaagatgcgaagcatgcagaattcctccaccaagtcgcggcaactaaggcggaagcaaaccttacgcagcagagcgaatcacgcctccatagcgccgtccacagcgatcttgggttttcggttcggcgcaatcgccctacgccggcaccggagggccttcgctgagtcagaaccagcctcgaaggggatggtgtggtaaaaccacctcgccatccaatggcggtcccacttcgacatggcggcattcactggccagagatcggaccgctcggggcgaacattaaagtttacgctcccgaacactgatttcttcgtcccagccggggtaatcaccgtcttcgaattcacggtggcgaaaaatatggcgccaaaaagttcggcgctaggctcaaaactggaagtccggcacgcccagtcgaagatagcgatccggaccagcgtcgatgggcttaactgtgggagctctacctggaaaaggcgaagaatctccggcaacaacgtgttgcacggaaaccggagccccgcctcgaaaaacacggcgaacaccaccgtccagttgtcgacgggcttcggtacaacggctttccccggggcgaaagcctgtccctcgactaacgccccagagctgaccaacttcgccagctcactgtcatctatgagagaaatccctaagtaggcggtggtgtcgtcgtcaatccggccggggtcaagccctttcgccgaagaggggttaggcttgcggggagccatgacgaaggatgtatgcagtgacgaagggtgtgtgcagtggtgaacaaaggaaacgaacgaaaggtctaaagggccaaagggtgccgtgagagcaagaacggaggaagagagcgcgagcggtgaaagtgacaagtctggtggtgaaaagaggacgggggagaatatatagcccacccaagcaacggttcacctacccaccagtaataaagcaccacgtgtcgcgagggtaggcgaaacggtaaattcctatcgaccgagctacatagtaaaaagcccacaaagagaaggcccattactgttcctttcggcccgggaaagataaaaataatatacaaccgcctgcaggaggcgaagagcggcaaaacaataccagccgcaaagacaataaactttatttgtaggaacaatgaaggttttggaaggagcatcggtcgaaagggggcgccacataccataccacatggtttgcacggtctcggccgaagctccaatctcacccttgcccgtgaggggcttgttggcggtatggcatgaggccgttcgaccaaaatctgccgaaagctatgcgaagagtggggattcaagcccgagacgtcaaagttagtcggggcgaagtccccacatggtgaagactacggaacaaggacgacgagaggcaagggatcacgcgggtactctgccaagctagaggcctcttgggcgaaggatgcagggcgaagagtatatgctgaagggggacgacttcgccaaagcaaagctcgggccgaagaagcctttccggcccatcaagcctaggggctgttgggccgacgatcgcctgacgacccatcaagggcccttgaacctcattacactatgtactcatgtaaatgtccctttcataggggtaaccatgtaaatttccctgtataaccaaaaccctagtagtaagaacctgtaataggggctataaatagtctcatagggccatgtaataaggggatcccaagaaaaattctctaattaatacactttacttcttttccaaccattgttgagtaaccacgtctttcgacgtatgcggttgtcgtttcgacaacagaggcgtacacgcataaattggactgaagaagagaatctacaccttcttagctattggatacattactcaactgatcctgtaaaaggcatcgacaggaaatcagaattttactggaaagctgtagctgatgtgttcaacaccagcgcgccaacaaatggacacaagaggtcagtcaagcaactgaagacacattggggtgatgtgaagagagatataacaaagttctgtggagtatatggtagacttaaagctacctggaagagtgggcaatctgatgacatggtcatgaactcagcccatgcgatattcgaaaaagaaaacaaggacaaacctttcaccttggagtacatgtggagagaggtcaaggatttgcctaaatggtgtagaatagtccaagaggatagtggaaataagaggaccaaggtttcatcatcagaagcatacacttcttcatctaaccaagacacaggaggaaaccattagcaaagagaagcgccctgatggacagaagaaagcaaaggccgggctaaaaggaaaaggaaaagatgctgcaccatctcctttgggcaaccaaccaagtcagaatatgattctatatcatgaagctatgtcacttaaagcaacagcaatgataaaatcagcaaaagagaagaagtaccagacttacttaaaactgttggagaaagatacttcaaacttcagtgaagcacaccacaagaggcatgaaggagtcctggaccaattagcaaaagaacttgctggggagtaaataatcagcaagtgatgcttgtactaccattacctattgtgcttgtcatatttagaggtgttgaaagtgtaattttcatatttagaagtgttgtaagtctatttgtaacccttaagttagctattgtaacaggtcgatgctctatattgtatggccatgttgttagtgtatgtgtaagccaaattaatcatattgaacagtagagaaatcacctttgtttatccttagttttgatccatgtcaaggtccatgacagttgtggaacagggcataaagcaaaataatatcagttgtaaaataatatcagtacattataactgttgtggaacagggcataaagcaaaatatagctgttgagaaaaagacaaacaaagtacagttgttgagaaaaagacaaacaaaatatagctgttgagaaaggtggcaaacaaaatatagctgttgagataaagcaatagatagctattggtatttagcagctataaatatgagatgcagtctaggacaccactccctcattcatacaacacacactccctcattccaaaaaagaagatgtccagtgactctcaagatcaatctagtcattcagatgagtctacagaggctcagcttgaagctgagcttgaggtagagcttgaagctgagctgggggctgaattggaagcagaatcagctggtacctctattcggcgtgggggctacacacggaggtacatcaatagagatcatcaagatgatcacaacagattgtttgctaaatactattctgccaatcccttgtacaccgataatcaattccgtaggagatttcgcatgagaaagcatctatttttgcacatagttgaagctctaggtgtctggtctccatatttttgtctacggcgagatgcatttggaaaggtgggtctatcaccactgcaaaaatgtacagctgccatcagaatgttagcatatggttcaccagctgatcttatggatgaaacatttggggtcgctgaaagcacaacactagagtgtttgatttattttgctaagggtgtaagagttatatttggctaacaatatctacgaaagcctactaatgaagatattcaacgtttacttcaagtagcacatgggcatggattccctgggatgttgggttgtcttgactgcatgcattgggagtggtagaattgctcagtagcatggaagaggcaatttacacgtggtgattataaggtacatactataatgctagaagcggtagcatcttatgacatatgg

SEQ ID NO: 81921 - DNA, 3800 bp, Oryza sativa
ccccccccccccggcccccattgtgaatccgctccgggtcttctggctagctagcttcacaaggtggtgggctagacgaactgggttcgaagcctcaccccttctaactatttgatattatgtcctttcctaatatttatgttttttttcacccaattaatttccttaatctctcatgatcacttaagtttagggcttttgaaatctagaggttttcactttgcatggctggtcttctttggttatgaaacggttggtcactggcgtcacatatttataacatagggggctttgtttgttccacgatgatatttactcatgctgatcttactctagtgttttgcaatttaattttaacaattagacaattaggataaatatatatgatcaaacgatcctgaaaagagaattgttagaaaattacctacatgtgcattaaactctagcgcctacggatattgtgcacgtacgtggatttttatttcccacgggatttcagtgagatcgggatatatcgttggttttcgtctctttgagtgtgtatgtcacggatgtattattcgtgggtgtgggagtgtggtgttatgtgaatagtgatgcatgtccatttacagtataataaacaaaattaatacatattattaatctgctagaaactatgtacgttgtgaccatcaacccctgtcattatcgatctgcaacaaattgccagtacaattgacctatttcttgtgctatcattttcatatagctttcaagagaggaaaaatgaagacagtatacggttcaatgtcaaaatcgtggtagtttatgatgatctattttttcaatgcctccatcgcctctttctcgcgagcaattgtttaactaaccatttataaaaatacggcctagaaaaggttgaaaagtcagaatatgtctcctttcttgtcattcatataggtcattcctctgaaaatcatccacattttttccatggcatacttaattgtgcagagcactaacttaattgggcttaaaagcattgcgtatattctatttacgaaccttttgctacttgacatttataaatttataaatttatgcaccagatgtcaaaagcaatcttttaacaaaagctgcttccaatactatttcaaatcatattaaattgctagtcttctaaagaagtacataccagaacattgcaattcattaattatatctataacgtcggtggatacgtaattatttattccttctatataagttgaaattcattcagcctcatcttttcgcttatgcttatacttatcagctaaaatttaaattttcaaccttaaatttagagttgattttgatatttttcatcggagtttatttttcagcctttgcttttagatcgttaagaacacacatatataaaagttttattcacaaattatttttcatttgcaaatataccgtttcgcttattccactgataagcaaaacgatgagaaccaaaggcttataaagcagaacacacaaatatcaccactcactattaattacttctattattataaaacatattaaaacttttttaaacctaaggcggaactttgttccacttttatatttagaagaagagaattgacccagtttataaggaaaaccagaaccgaaaaccaacaactgcacggttaattacaggaaaaccggctgaaacccactgctacataactaacaatagcggcggagcccaatcgcaggacgtcgccgccaagctaaacacaaaagcaacacaattgctcccacatcgcagaagaggtgttatcattgccgagctagccgcctaagcgacccagcagcgccaacttcacaaccgaagcgacactgaagacgaaagtcgccaaagcgaaaagcggatctgacatccaacaatggacatcagccaagccaccgaggagccacttccttcacacggccaacaccagaactccatggaagagactgcaacatgtcatcgttcccaagcgtcgccgcacccccatcagcgagaagcttcgactcatcagcagaaacaaccgaagagcgtgtcgcccaccacaagaatgaagcggaccccaagaaggtgcagcctctccgaacacaaggtatgaaagattttgaaccgaaaaggaccatcaacagtcatcgatgcgttggaacttctccgaagcgacacccccaaggaggacacgacgcgtaacgccgccgccgcttgtccgtaaatcgtaacgaggttttcacctggagatttgtggggatatgaaagaacgccatgacaacgcctccaaggagggaaacgacgcccacgggcgctgtcgttgtcgaaccggccaaaagcacggcaaggctttcgttagcatcttcacatcacccacataagcaccctcacatcgatggccacagaatagtccataacgtctcacaagcagtcataccttgatcgtaaccaaaggcaaagatgggcccttggccaccctcatgccatccatccgccgcaaacttctatagcaagctagagcctccgccctcccccctagcattccccatgaccagaaaggggtccagccaaagaaggggggaaactgaaaggatggagaacactcggccgacaacgaggaagtcatcgtcgtggacgtcaagccccattcctgcttcacgccagcacaagccgtcatcccgccaactccacgtccgcacatcgccgcccatgagtcacgagacccaccacgggcagaagatgccccctgccgaacaggaggctggccaccagtgagccaccgccacgctcgccggagcccaccgagccgtgcaacgcccacacatagctgccccgccgaccggctgccatctggcatggaggcaacggatccggctgcagacggccagatccagccaggctcgggggcgacgaccagctagggcgcgccgccgcaacatccatcgtccaccatcaccaaagccgaagccgacaccgacgccggcgccgtgaccacggcgcgagcgagccgccgctgccgtcgcccgcccaccgtgacactgcccctgcctgccgccggtcttcgcgctgccccggcgccgacctctcccccgccgccagccgccacctcttccccgtcgcctgccatctcccttccccgcctccttgggtgtcgccgtcgtcctgggagggggacggactgtcacaccatgaagttcttttcccaagcctaaattgaatttataaatcacctcgagaaaataccggtgaaaaagcaagagagaaaccctaaaggaatcaatgcaaataataatcggaattggcatgtggaatttttcttgagttctatatgtcgaaatatgctaacaagatttttagtggaattttcagagctctagaaataattttaaccaattaaaaatgagctcaagcattatttaatccttggaaattcttttcctttttttctttttccttttcctccctttttcccaaatgggctgtcggcccatttcctccccctcccgcgcccttgctgggccagccgaaggccacggcccaaccgctcgcccgagccccccctctctctccctcaggcgctgacaggtagggcccacctgtcagtcctttccccaacctccagccggtggccccgggccggcaaccgccgccgcgcgcacgccgcctgcacccgccttccccgcaccacgtcggccacgcccgcgcgtgcgtccgcccctcccgcacccctcaaccccctctcccgctcgcccgcgctcccgaggtggccgggattcgattttcgaatccc

SEQ ID NO: 81922 - DNA, 24028 bp, Oryza sativa
tttttgttcgcatatattttctgaaggaaaaagtctagttctgttcgctcgactcctcacgtggtttgatttttgtccgtcaacttcaatcccatgccataactatcatagctacctaaataatgaccctaggccagttttgcaatcagtatttagtgaggtggactgccatatcatccttcttttgccatgcctaccacatcatctccctaaccctaatttcctaaaaatgattagaaaaaaaaggtgaaaatgatatttataaatggataatctagtgggtcccactattttttttaattcttttgttcacttattcgccatgtaggctgtctaataggatgctacttacctctacttaagtcttatactagtcactgcaaaactttaaatatattcgttgttagtagtcgaaatacaatattcgtagttattagtagttgaaaacttgaaatagaatacttaattcttatactactcaccgcaaaactttaaatatattcattgttagtagtcgaaatggaatattcgttgttagtagttgaaatagaatatttaattcttatactactcaccgcaaaactttaaatatattgattttcctataaaaaatggtttcttgcatcccctatacaacaaagaataacagatgcacggttgatatacctacaattgctttcagtgaattaatttaaatatctagttatctgtacaaacttaccgtctgtttttttttgtcaacagtggtgtgtttattaatgagaaatatttctatcttggcttgcgtggaaaagtggaggaccagtttaatcctaagaacaaatttgtggtacatactatttctgatatatatactatagcttgtttgctgcatgtggccttatatcctatttctgttgcaggtcaccattttaaccatgtttactctaataactctatattcaacaatcatccctatttctctttacgtgtccattgaggtattttgtccaacttctcatttaatgcaacctacatttggacttttggagctcatgctagctttggatgcagatgatcaaattcattcagtgcacacagttcattaacaatgatctgcatatgtaccatgctgagagcaacaccccagctttggcccgaacttctaatctgaacgaggaacttgggcaggtaacttgtaacattattatctgttggtttgaagagaacccaggtttttggtcactggaatgctactgtcttatactacacaaattgatctggctaatggaatggcacaacctcattgtagtaaatcactccgaaaattgggattgcttggggaatgtggttatttgacaatattgagtgagctgatcccacttaataaacatgtagaattgcttcatctattcaacatagatgcatccagtctagcatggttatgggagaccacttgaataaaactgctcataaatgcatatagtactggactaattctcatgggggcattctgatatatttcaacaattaaagataaatcaaacatttctgagttctgaaatatttcctcttaccctgaatttctgtcattaacacaatggctcaggttgaatatatattttctgacaaaactggaacacttacaagaaacttgatggaattctttaaatgttcgattgctggagagatatatggaactggcatcacagagatcgaaaaaggtggagctgagcgagctggaatcaagattgacggtgatgaggtattcaacatttttcttgtcctttaatagattatttgtgttactattcttattttcgctttattcacctcatcagggtaaaagatcaggtgctgcagtacacgagaaaggattcaactttgatgatgccagaatcatgtgtggtgcatggagaaatgaacctaatcctgaagcttgtaaggtagttattatagactagttcagctcttgccttgctccagtgtcattaccccccacccacccctcagttatctttgttacccttttcacagttttgtaatgtgctagacagccaatatctgtatgctcctgtttatctctaggaattcttcagatgccttgcactctgccatacggttcttcctgagggtgaggagacaccagaaaagatcagttatcaagctgcttctcctgatgaggctgcacttgtggctgcttcaaagaactttggcttcttcttttataggtatttccgaactttaacttattttcagtaactcttgcacagttttattcttttatgtatttatccaatcagaatgtctcgaatacattagttatggtgacatttttgtgcttcttttatagacgtacaccaactacagtcattgttcgtgaatcacatgttgagaggatggggagcatacaagacgttgcatatgaaattctgaatgttctagaattcaacaggtgtggtttgtttgtttccattttaaattctgtgagatgaaattatagttctgtccttgacactactcaactaacagtacaagaaagcgtcaatcagtggtctgccgtttcccaaatggaaggcttgttctctattgcaaggtaatacgcggagaggggttggttcaacttcattctgtacatggttaacttgtttcactaacctgcatttttttttctaatagggcgctgacaatgtcgtttatgaaagattagctgatggcaataatgacattaaaaagatcagcagagaacatctagaacaatttggctctgctggcttgcgcacactttgcctcgcttatcgagatctcagcagggagcaatatgaaagctggaatgagaagtttattcaagctaaatcttctttacgtgatcgtgataagaagcttgatgaggcatgcatcttttggttattttatttgtatactgtggaaatgcccttttttattttctgagctcgtataatttgccacaatctggcctgttatcgttgcagtatgttttttcttatcaacactgtagaattactaataaactattgaggcctatccttttccttttaaattgcaaagtagcatgagccacaacctataatgtcaagtgtccgtctgcaatttagcaagttcttttcccttctttaatctaatttgttaacacttgctgctttgaacaagataatactactacttccaatatcttagctttgtttctttttatctaagagaactagaattttgaagttgtttattcttctattcctgggcaatattgtgatgcacttttttttttcatccctgtaggtggctgagttgattgaaaaagaccttgtattggtagggtgtactgctattgaggacaaactgcaagaaggggttcctgcctgcattcaaactctttctgcagctggcataaaaatttgggttttaacaggagataagatggaaacagcaattaatatagcatatggtgatatttttattcttaattatattgctcatgtcgtttcttcgattttttttcttgagattcttttcatattttcctgtctcatcttatatctaaatatatagaggatttgagttgattctctgctctgcagcctgcagcctggtgaacaatgatatgaaacaattcatcatcagctcggagacagatgtaattagagaggctgaagacagggtaagatgaacatatatcattgcactgtgaaattgcaagggcatgaaacattgtttttgagttggtttattttatctttattatgcttaagcgaccataagtggagactttaatggttgggtccagcctgaataactacatgatttttgatatgtcactggttatgagattgatatgtggtctcatgggtctaggacccacacgtgtgaggcatcagtttcatagaacatccaaagttatctatcggtacttaaggctttgtcttccaaagtacttaagaagtaggttatacaagttcacttgatgcctgggtttggtatatacgacattaggactttctttgggggagatatagcattgacccccttcctatatttcagaataaagagaatgatgtgatattctttaatagagttctgtggatcgcgttgctttagtgctttaatgtctccattgtattaacgtatgtcttgtgtacatctgtttttttttataattttgtttttacttggataaaaaaataattagctacattgcagcatctgattttgtattctaacttttgattctttttgctgaacctaactgtgccatttataataccggtcattttcagggagacccagtggaaattgcacgtgttataaaagaatcagtaaaacagagccttaaaagttaccatgaggaagcccgcggttctctaattagcacaccgggacaaaaattggcgctcattattgatgggagatgcttgatgtatgctctagacccaactctgcgtgtagatcttcttggtttgagtttaatttgccactcagttgtatgttgccgggtttctccattgcagaaagcacaggtaaatatcgtttcttgctgttattgttgttaattatgaatgccttccttcttcccagggaacagaacatgtcattttttatgttccgggttatctgtagttcttacctagatgctttccagagtgcttaagcaataaactgaagatatcggtataaggaaataatcattttttttctgacaaagtgtacttgaaaagatttgttatgttgttaatcatagtgcataagatgcttttattagtgccaactcaaatctcattcttatgtcctatttttagttgcacacattttatttcgttattaaccatcagcagtcttatctggtttgttatatttatttcttgcataacttatttggttagtacaatgctgaactgtaaacagctgacacttgctcatgttgtgtaggttgctagcttagttaagaaaggtgcccataagataactctcagtattggtgatggtgctaatgatgtgagtatgattcaagctgctcatgtggggattggcatcagtggacaagaaggaatgcaagctgttatggctagcgattttgccattgctcagtttcgatatcttaccgacttgctccttgtacatggaagatggtcatatttgagattgtgcaaggtatagtttagttctttgcagtgtagatttgtgtatagttcaagaaactgatgactgatgctttctgttgcaggttatcacatattttttctacaagaatctgacatttacgctaactcagttctggttcactttccaaactggtttttccggtcagcgattttatgatgactggttccagtccctttataatgtcattttcacggccctacctgtaattatggttggattgtttgataaggtatgtaacttgtattcatttctacttatggagtatactattctctgtgcattacacttaactgatccctttcaggatgtgagtgcgtctctgtcaaaaaaatatccgaagctttaccaggaaggaatcaggaatacattcttcaagtggagggtgatagcagtgtgggctttctttgccttctatcagtcgatagtgttctattacttcactgcagctgcaagtcggtatggtcatggttcatccggcaagattcttggtctttgggatgttagtacaatggctttcacctgtgttgtggtgactgtgaatctccgacttctaatgtcatgcaactctataacaagatggcactatatcagtgtagctggcagtataacagcctggtttatgttcatcttcatctactctgcaataatgacatcattcgacagacaggtgggatagttcatagattactgaaaaatccagtgctctggtatgactattttattcctataactgcattaacttcgtgctgttttctttctgcaggaaaatgtatattttgtgatttatgttttgatgagcacgtttttcttctacctcacactattgcttgttccaatcatcgctctctttggcgacttcttatatttatcgtaagataccctatctttgttatcacgttgccccttttgtttctcaatacttttctagctgtgagcctgtgactgacttattactagctcttccttgattcctccaattaaattgtgttggtttgagccttttgattttaaagcattccatggtataaacaaaacaactgaatataaaccatcctgatgtgcattatttgtctcagaattcaaaggtggttcttcccctatgactaccaagtaatccaggagatgcacagggatgaaccccacgagtacagcaggatacaacttccagagacaagccatctaagcccagaagaagcaaggagctatgcgatctccatgcttccccgagagagctcgaagcacaccgggttcgccttcgactccccgggatacgagtcgttctttgcatcgcagcaaggtgtcggtgtgccgcacaagccgtgggacgtagcgcggagagctagcatgaagcagcggcagaaaacgggaggatcataaccctagtagcgcccctaccttcctggccccccccattttgtgtaaagtttttgtacatcacatgcttttgctggcagaccacaggagagtgtgtataagcttgtagctttgtagccatttttcgtgttttgtcaccgatatgttgtgttggcgatgttagcagaggccattgatccagttggctgcagaattacttaggacacgccctttagttaaaaacaaagttggaaactgggaatgcagttagtagtgaaattctttctgacgctattgcaatgtttagtccttttctgcttacctctattgtggtatttctactatatttgataattggtgccgatgccattttgctacttctatgatttttgataattggcgttgtcgttgcgataaatcataaggctcattcggtttatatataggattttcaaaggattactttaggaattaaataaaacattgatttttttaaacccaaattccttagaattgtactcttgcaatcttatgccataggattaggattcttagcatgaggtaagagctcttggaaaaacttcttaggattagagtgtatgtgacatcctaatcctatatttttctattcccatgatttgaaaatccttttcaccgaataagccctaaataatttatactccctttgttcccttttactaataattaatattgttggctaatgtgattttagattttatcattgatgagcaaatcttttaaattaggggaaattttacaaaattacatgtacttggcgagccataggatttgttaagaactgtaacacaaaactacagagttaacatcgtattttgcacaagactacatattgaagtgtcgtatcagaaaaactacagatttaacattagttttatcataaaaatacaacttttgtaacctcaatattctatggatataaactttaaagtttgtagttatgtgataacttcatcactaaatatatagttttgtgatacgatgctttaaatctatagttctgtaaaaaatttaatgctaaatctatagttttataatacatgcctttaaatacgtagttttgtgataacttgatcggaagtatatgtagttttgtgaaatttactttttaaatcacaatgttttgatgaatacatgtactagtacagttatatttggcgtggtcgtagaagcttttgcttggagcaatagaaatagaatgaaatatatcaatggaatgagtacggttctctcttactccgtttatttcatgtacatttaactctatgagcaaacacacgtattacacctctatgagcatccaccaaaaatacacatgcacaccttacacccctgtgagtttctatattatataccggcatatctgttacacggttcctttttctctttccgttatctgaatgaagagagagagagagagactatttttttcttacaaaaactacctattcgatctattcgatcctatgcttcacttttctgcaggtgggagaaaaaaatcaaaccaatcgttgatcaaaatttagggtttaaaacttacaccatccgttcaatagaaaactcaatcctaaatttagggtttaaaacttacaccatccgttcaatagaaaactcaatcctaactacgaatctggacatatacgtatagaggttagtagttaggattagactttttataagatatagtaattaggattagactttttataggatccaatactagcgacggatttggacacattcatattaagatttatggttaggattgaagggagtagacattcataatccaagaaattggtttgatttttaatctattgatcaaaatttagggtttgaaacttacctcctctgtcccaataaaaaaaagtcaacaatgcttgttcaggttcgtagctagtatttacttcttctacatgacccaatcaactttttcataactcaagaagtaattgtaccaatttttgagaaatccaattcagttaagacaagagaaattaaagagggcaacttttcagccttatgagttgccattctacaggtgattcggatattgcataagctaggtttgattccgacccgggagattcggcaaatgtaggagcctggtttgccttcatcaatcctgaatattgacaatattctacaacgcaatgtatcgaattatcctagcctggcaaactcaattatcacaagttctaacactagcacttgaacataagttgtacaaaacactcgcactgaatagtggaggaagaattacgagtacttcataagatcgtcctgtgtctatcaaatgtagaatagttataaagatcaaacacgcccagatcaaagaattaaactcataaacgtacaaatacaatgtgaagcaacattaccgaagcacaacgattcccactacaaatagaagatcaaggaaattgttaactacctatgataattctaaaacaaattgtgaactacgggtgcgtttggatccaaggctagcaggggcctagcctggcctggcaaggacagtcgtttggaatcagaaaaaaatcctagcccatgggggcgagctagcccataagagtgagaaaatgatagctccaactcctgtttagggcctgtttgggtagagccccaactcctaaatttagctccaggagttgggtctggaatggagttgtggagttgcctaaacccagctctacctctctagttcattttgtgagagagctctacccagctctgctcccattttaggtgaagctaaaactgttaggctgagctccagttccagaagaggtggatctggagctgtgccaaacaagccctaattgtccaactcatggatcatgaccctaagcatcccaaacaaatactcactctgttccaaaatataagaacataggaccggatgtgacatttcctaattctatgaatctggacagccattccaaaatataagaacctacgaccggatgtgatatttcctagtactacgaatctgtacagcactaggaaatgtcacactcggtcctagggttttatattttgggacgaagtgagtagttctaattgctaacccataacaaagataaacacagatggcaagaacaaccatcatggtgctcgattcgcgttgctcccttgacacgctcacacggacatctcgctgtcgataggtatactgcatatcactgaaagaataattaactataaatgtgaacacccgtatcaaatctagaacttaaacctagatgaatttgttccaccatataaaatctaaccagttgaactacgctcatttcgcttcagctttaacattctagttctagaaagaaacataatcagttctttcttattaacttcggtattcagtactaagtttacgaggaaccgagaaactcctagggattttccagctagcttcacaatgtggtggactagatgacctgggtttaaagccccactctttctaattatttgatattacgtcattccctaatattcgtgtcgaagtttacgaggaagcaccatcaatgtgcggtgtggagcagtagatacacggcttcatcactagttttcaaattatgatatccacgagtataattcgtgcatctttaattagtttaaaattatttatactatcataaatactaagttactccttgtatttcttttttggtatcccatattttcatttttactccttccgtttaaaataaattcatttttttcctcccatttatctcaaattaaattcaattttcaataattatatatctgagtttatgaaaataggagtaaatgtattagcaatatataaactgaggaataactatattggtattggataaagtggatgtattctatttttctattttttattaatatgtgtggaataggtaaaaaaataaacttatttaagacagaaagtagttgctatagttgttgtagggtatgttttgcatggttgcagctcgagcccagtcaaacaattttagctccacctaaaattgaagcagtggagtgctatccatttgtttttcgttaataaaatcagccggcgatcttccttcggaaaaaatgggttcacccagcaacaatcgagaaaatgttcacaacacaaattagagactaattacaacgatattatgaatgcagattgtgatccaaatacaatacaagttacagattatatactctcttttggcaaaagaatcggttgaatcctgccggaccgccggaacaggaccgagctggacggatgcttgtgcgttaaacggtgtttttctaaaattccgtataaccatatgagacgatttgacatctcaaatggttcattccatactgacactatagtatgtataaatatgtaccagcttttctatttcttactagccgtacattaaacatacatacactgagtctcagcgattggcttaatttttaatttttagctaggctggacctaaggtcctgtgtatatacagctttttatttttacagtttactccttctatattaaataaaattaacggctcgctgattcattaaaaaaaacatacatacaccactgtatatatataataccatacacatacacctgctccttacacacgctaaaaaaaattggaaaccaacacattcttaatttcattaaatttagtatcatgttagtttgtataactaccggataacctaaactaccatatgatatataactttgtactattactcagctcgtaccagattattaggtagccatgacttccgtgtgtatttattctaaggaatcatataccaaaccaaatacgacctccaatcattaacatatatatataaccatccgtttttaatagatgatgccgttgacttttaaacacatgtttgacaatttgttttattcttaaaatactttaaattataaaataacttataagaaaataaattataattataaaaaagtttttaaatatgatgaattgtcaaacatgtgaaaagagatcaacgacataatcaaacagaagtaataatactactggtaatacttagtacgtcctaaattatagggcgccctatttttaagaaaaatcaaactcgatattttttgactaataatcatactaactatatatatatactaagtgttatgcatgttatatcattatatttatattttaaagtattttcatgtgatgctaatttcatatttgttaggattatagaataaaataaaatagtggtcgttattgaagaccgtgtaaaaaaatacaggtcttataattagagttagggaagtaacatttaacatatttaagataagctaagtaaatactagtgctatcttcctcagttatttttctccaaacaacattctagtgacgagacagattattccggtgggccccactcctgactttctgtactcctacgtggcaacttcagcctcgttctaccactacaacttcaagtagtttttgttctttgtttgagccttcgctgccgcagcaattaaaaccccgtcacccagagacaccgtacttcacgccgagaagctagcgacggtattttcttaatttgctatgctctctccgtcttcaaataatataataacgctactactccctccgtatttgaatgtatgacgccgttgatttttcaaccaatatttgaccattcgttttattcaaaatttttgtgcaaatataaaaatatttatgtcatgcttaaagaacatttgataacgaatcaagtcataataaaataaataataattacataactttttaaataagacgaatggtcaaatgttagacaaaaagttaatggcgtcatacattgaaatatggaggtagtagtttttaaacatatctattgcatttttataattatcttgtttcaaaatttgacgtaaatattatttacttttgtcacgacttgattgttttatcacttgaaaaatgacttattatctacactaaatttttaataggacacaagttatcaaacatatatgcataaatataatgtctgtaataagttaagtaaatcgcgctaggctatgtatgttttgctcaatgtatcctaaaactactaattttcgatatatttacatcttttatcaaaaactacagctttctaacattgaaaaaaatatgattcactgtctccctttcattaaaatgggatgaatattttcttgaagcttttaatgtagttgtttgataaccgcatgactaattttgtggtatatacttttatgataaatttgatattaattgtgtagtttcatgacacaatcttaaattcgtagctagattagtgtatgggtacttttgtcacaatatactctaaggcatgatcctagagtatgattaattaagctttagctaaaataaacttaaaaaatagattaatatgatatttataaacaactttcttttttttttgaaaaaacacatcatttagcattttggaaagtgtaccatgaaaaatagagagtagaagttgggaagaggtgacaaagaacacaccctaataagtttatagaaaatgtaaaatcaaataagtgcattttaaaatataccgagtattctatgataaatttaataaaattaatttcatgctatagatgctgttatgtctttatataaattaattatggacaggcttctgttcggcatgagtggacaattatggaccgagtattctaaaataatttcatgctatagatgcttgttctccgctcatatgtacgttttttgaagtgctaaacaataaaaaaaaactctaaaagaaagttgcttaaaaattcatattaatctattttctaaaatttaaaaaaatagtacttaattaatcatgttgtaatgactcaccttattttagtatcttttcatatcttttaagatctttttattttccccttctctcaaacataccataatattatacgattccccatggcgcccctggcttatcaaataaatcatggatttcgtctaaggaaaaaaaatgcagaagatcaagaaaaatagagaacaaaagtgttatatgataattctagaagcatgtagtaccttaacagttttttaaataaaaagtagtaacttaacgatacaacatctagaacagttcgattagatgtgatcaaaaggatgtactcccacatatgctgatccacttaaaatttgcatatagaggtatttacttatagaccctaagctgtttttatttggaagagtgatccaactgtagaaaccacttaggatttgttgccactttataacatatatattgttgagaattatacatttccatattattttttcaaataggaatatcacaaatattccatttcatatatcttttagaattaatcaataaaaataaaactattttttagataaccccgtacatttgatctccctagctcttaagtatatgaatttcacgtacattggtctatccatgtgaccaattgacttatcttacactactccctctaacttgactttctaacttgactttgtggaatatgtctaactatccatgtgggtactatcaatatgtgttctcgaggtgaatttttttcattctaatattttcttttttattggtctctttgcttccgtttgtacagagtcttcgaatctccaaaaataaaaaataaaaatgatcatatgtatctcgactaggaccaacaataccaccacaggctttattaatcggcgtgtcaactggcacgcctattttctagttgaacttattatcggatggagcaaatttcatagtattacgaatctagctatgccgatcatatgttcttataatttaggacaggtagtatatcatatagcgtgtgagtaattgtgtgttggggcacagcacctaaattatgagaacgtagtcctggataggacatatcctaatacttcaaatatctccgtccaaattaacagtactacatcacacataacataggttcttatattttgatacgcgagagagtagataattgacagtaggttcctgagctagccgatcgatggctttatatataccaagcgccggccgtcagcgaactcgcgccggttagttcgtcgatgtttctttctgcgtgcgagctaccatctgactacctcctcctgcagctctcttgcctttcttttttcattttcttttttgttgttcatcggatcatcctgtgagtcctctctctctctctttctttgcatgcacgattagttcttaggagcagggaacacattgctacctccggtctaaatgacgttttagacaatggatgaatcaattccttgggattacgacggtatcaaatgtgcatcgtgcatgcaaggtgtttgtggaaaagccgacttgatctgcttctcttgcagggctcactgtcagttccccgtttgcattgtgaaagcagttctttattattattattattattttccgaagcaaacctccgaaagggtagtggtagtgagttcttgtttttcattgagaagagagaaaccgagcataaataccttacagttacacggctaattgaaggaaaaccggccgaacccacacaggatacccaagcaacttgtgtttaatttggtgtatggggttttgaggatttttcttgttatctctaagggttccttttatgtaatcaggaatggaaggatcaactagtaaacatgattccctggtgcaaaaacatgtggattttggtatactggagaacaacatacaagatccaactgcgacgccaatgtatctgccaatggaattcttgaaaaccattacatgtgacttctcaaaggaacaagagcttggcaggggtgggtatggagtggtttacaaggtatgctccccttttttcccctctggttatcaagggtgcgtttggatccaaggctagcaggggcctagcctggcctggcaaggacagtcgtttggaatcagaaaaaaatcctagcccatgggggcgagctagcccataggagcgagaaaaggatagctcacaagggagagccgaatcggctcgcctccgacggcaagctcctcgcgtgaaaaaagttgttgataaggatgaagcgatttttctcaaaagttgttaccttcttcaacaaccagccccccaatttcgtcctactcctccactcttcgccaaagaatcgggcttgcagatctcgtcgctctcttcccccactcttggctgaactatagggctcacagatccggtcaatttgcaatcaccctcctccccttgccgaactttcaagcatcctcgattcatctgcagtaatcccgtgcccatatataaatgcagtagagcctccggcctccacgcagtaaatcggagagcaaggccaactcgatttgaggagagcatgttcttgcagaagattgctactggacacaagattgctcgtggtgagaactgagaagctcccagatttgatttcttccgccgatggcgcctcgtctatctagatttgcaggtacgaggactttttttctttatattaaagctctccatcttcctgccatggatggatgtatacgagctgtctatgttgcttcatgtactatttccacatccagtaatcttgctttgggcctttggtgctggattctgattttgcattaatggggattgtcgatggtatgggcagtagtagctaggaactttctggccgtcggcaccaagcatgatggaagacaacttgtatttaaagaagtccatcatgaggaatgtgcaaagcaaattaatggcaagtatcacacaaacttcacaagtcgacaagtttatcacaagttgaaggctcagtggaaggtgattatggaggcaaagaatttgagcggggccaactttgatgatgttgagaaaaaaaatcctatatgatgagattgaagttgttcgaatgactaatgtgagtgttctaactattctttccttgcaaataactatcgtgtttacatataatatggatgtctatttttctgacatttttcttgtcatgtgtaggccaaagataaaagggctaaattcattaacgtccccatacgttggtatgatgaaatggagtttatttttcaagacaagcatgcaacaggggaatttaatgttctgcaaacaccatatgaccatccaatgactgaagatgatgattttattggtgataaaaatggcagtcctggtgatgttgacccttcatcaaattatgactcagattgtcttccagatcaagagaacaatactggaagtagctcatcttctaggcgtgcaaaaggtagaaaatctgataaaggtaaaagagttagaactgatgataatgtggtttatgagataacaggggctacagataatatgtctgaaaccatgtgtttcacacatataacacatccaaatgaatccctattcaagataattgatgagatgacggaataccctgtcatggttcgacttgagctgcagacttatctcgcgacccatgagaatatagctgccatgttgaagggtaagccactggattctattaaggaatatgtgacccaatggataatacaaaactatccagctgctatgtaatttctttgctgagatgtttgaataattactatgcattcaagctaaatagtttaagaatgaaacatgcactttagatattatttaaataattgatatgctttagttcgaacttgtaataaagtagttcaaaaagatgtttgattgtttcaaggaattcttttagcatatagctttgccctttttactacttctatccgtattattcttgtggccaagttaactgtggaagaatctatagtgttcttgtgacaaagccataagttaaaaaaatttgatctgtgtgcaatattattttgctcaatatgaaaagaagcggcacaaaatactctaaagagaaagatgattcgttgaagcaaccaaacggctagccactaattcttgccatagaaagcacaccaaccaaacaaagggtatatggcaagcctggcaagctggcaacgagttggcttgcccttacccagctaggctagctgggcaatggaaccaaacagaccctaccataccaaagaccagcaattcagaacaaaaatgctcttagaattctacagattttggcacgagaattcaacagatatgacagtttagttcctccaaagaaggaaaatataagtatgataggtgcaaactaaggagacctagctactccaaatccaaaagcattttagatcaggaaaatcaagaacatcagagtatagaatttcgcaaggcaattgcagtcatagatggatagcactgtaccaactcaaatgatcaaagaatcacaacctgcataattgttcaccaatttctaccctattctagagacaacaatgaaaccaattctcctatattaaggttcattgagttaatagaattctaccctattccacagacaataaaaccaactctaagctctcccatatgttacactcaatgaaacgaaatcctatgttaaggttcattgggttatatagtctatagtaacactaattatcaacaactttaacaaaccaatcaaacattttctacgcgatatacagagcaaggtatataactcataccaagacatcaatttgaagaacacatgaacaagcaattacaacacaaggagcatatgggaatttcatggtaatatatcgaatcactcaagatttcaccagtgcgatagaaaaagataatcatgtccaccaaaacacatggtaacttaaagcatcatcatcacggctaagttcaaaatcttgaaagcaaccatagatctaaagacaaaacatagaactcagtagtacgcagagctaggcgagccatggcgacgacggcggcgaagaggcgacgacgatctagacgcggtcgcggcgggggccaccgtacggcgggcgggagtaggtcggcgcggagacctcttgctggcgctcgacgccggggaggtcggccatgccgagcgcggcgagcatctccatggtctccttgtcgacgcggatctcctccacctcgagcgccgacttctccgggacgaagtccatgcggcgctcgcgctcctcctcctgcagcttcagcgagatgccccgcacgggcccgcgctggatgcggcgcatcaggtgggtggtgaacccggccaccttgttgcgcagccgcttcgacggcaggatggacacctcctcgagcaccttcttgttggtgtggaagtcgagcgtcatccgcgagtagtacttctcgatcacctgcctcgaggtcttcttcaccgtcttggtccgcacgcgacccatggctgctcctctccttctccggcgacggcggcggcggcggcgcgggtggctacttgcggcggcggcggcggcgagggtggattagggcagaggttttgggggaggagggagagaggagctatttataagggaggcggcggagtgggggctagggtttgggtgggatctcagccgtcggatctgaatcgacggtcgagttcgttcgatggagattcggcttccgcggatgggccttttgggccggaagggtttgggctggcaaggcccagtatatggccccgtgggagttttttttttttttggctcgtcgagtggagaggaagaggaagcgggagctcaccggcgcggcggcgatggcggcggaggcggaggcggcggcgctgccgcagctgcagctgcagcttctctcgctcgtctccgagcaccggctcctccgcgtgagctttgcttgccgatcatccaatgccttgtcggatcttcctcttcctctcgtagtgctgattcctcttccattttacggtttcgcaggagcgggagcgtgcggcgcgcgaggagctccacgccgccagccaagtctctctctctcttactctacggactgtgattggattctctgtttgctggggattagggttttgggtcgaatttgctgatgcgtggtgggggttttggtgtggaatttgagcagagatggaaggaggcggaggaggggcaccgtcgggagacgcgggagctgcgtgcggaggtggcggcgagggacgacgcgctccgtcggctcgagtccagggttcgttctgcttagccccttcacaactctcaatttcgccaagtagcttgtgttctcgtctcatggatttgggtagagctcatgtgttggattatgttacagtttaatgcctaactaaattacagtccctaacttaaacacattgtgatcatgctggtgtttgccatgttgtgtttcgtggcgattataccaacatttggggctgtttgggccagttgtctatcatagtgtagatttgtacttttactaccgaatcgtaacaatgactagtcctggtgcttggttgattaggtagaagcagcacttgatttttgatatgcatgttatgtcacatcacaccgtggatgcttcattcttcccctagtgcttggtttgtacctattcaacagaggttcattgcaatacctttttttacagataaaatgccttgaaaatgaaaatgagcagctggagaaaaacgaaaaggagttaaaagataacatggagggactgcttcaatcaaaggaggctttcataaaacattacgaggcaggtgtttacctttattttcccccttccttctgtagtagtttatatggagctgaactcattttttatgttttctctccatgctaaacttttggtctttgtaataattgcatatttatgtgaggctacttgccattaatatcatagtttttccttaacaattgctatgcatttgtaagactagagtgtatctggagtctgctttattgtacattgtctaatctgtcatataattctgccctgttcttgcttctgacatttgcattaattatgaattacctgtatgtggaatcaaactgattatcggctcatgataccatgtttgataggcaggactctgcttgttctctgcaatggactatccagatgaaggataaacagattgctgtgatttcagaaaagctgaatgctcatctggctttatttagttcagtaggaaaggaagtcgctgcggtgaaacaagtactcggtaatgtgaaatgtctagttggcgacaaggaaaatgtaggtatgcaaatggctgaaacatcttattctactattgttttaccaaatgattgtctttttattttttattgcactaatgtgcattctttagatacttatctgtgttatgttgcaatttcagtttctgacttgaagggtaaagtagagaagatttctgtgcttgagaaagattttgttggtatgttgcttcttgtagtcagattgcaatttccatatgttgataatgatgaccatatataagttgatatcctttttaagatctgctgttctaaatgtgatttttcattaaaatctgctgttctaaatgtgatttttcattaaaatctgctgttctaaatgtgatttttcacttatgcagaaaaacttaggtttttcgaagaaaaaattaatgattaccagcttgaactccggaatagggcgaggttgatatatgaattgagggaacgccttgaggctgagaaactcaacaccaaatttcagcccaaactagaagaaatatccatttctactgagttaaaagtcattgcagtcaatcttagtttctattgatctcatttggttggttgcgtctccttaacgatgttaccttaggaaatctttattggtgaaggatgagattattgagagactgacttcagagaagcaggttattcagttatagcataacgcctttccaatttctctgaaactccaaaaatctaagttgatatttactgtttttctttatttaggcaatgcttatggagcttcacaacatggagattgctttacataaatttcaagacatatttgacagtattgggcatgaggtgagaccatatgagatgcaaatattgaaagcttcaattgcatatttgcattatctcctgtgtgcatttcttggtacaagtcctgcttgcaggattgttcttcctaatatataatttgtttggcttcttttatttaaaaccaagtatctctctaaactatctgtataccaggtaataaaaagaagctcacctgtttctaatagtcaggatgtaacagaagatgtgaatagagaaaaactagaaaggtgatgctccattcaatactttcaattctcatcaagaaagttatatgaattacagtcttaatgctattaatttatcatgtgcaaacagcattccaggtagtcagtgtgaaccagctaatgagcataccgtgatacctgtttttgatgaagcaggtactatcatttcttagagagctttttaatatttcttacaagttccttggtggctccattgtcgtaagaatataagatattaataacctgttctggcatgtctgttaattttatatttccttccagaatttctgaactctgttccttcaatgtttactattttttttttcaattacatagttagttactcgattactttgtgcattatccttggagataacaataacatggttatttctttagtcaaatatataccactgtaccattgtcacatcttccattaacctctcatttttgaggtttctgtttgtgaacataaatcttctcgatcactgagtttgtatatcatcaacagcaactactccgaacatagaaggtcagtcggaaattgacccaggcagaaaacaagtacaaagccagtcatcccttatggcaagtatacatatgattatatcgattttctggcaatgctactattctcccattttcatagtcttaagtgatttctccacatgaatgcagcattctgctttgccgtctccagagccagcaaatgcaaatgccgaaacagctgactgcctacatggatccgaagatattgacatggtaaaaacacaaaacacactccttcgttgtctactgctatgccctgaagttggtccttatgtgtgttcacttcacttgttatttacaggataattcatctccaggacggtgaattgattatgtgaatccgaaccttgagtcacaaaaacagccctgaattacaactgggcttccctctggtggcatggcgctgagtctgcaaatctccaatgcccagcatcgcagctcatgacctcctctgctcacagccgattgatttcttgtctgtatagcatgttaagtccagttagcccctaaaggtcagaaggaagattgggtgctgcattttggtttttgttttttcaacttcaaatttgtgatatctagctagtgatgggtagttgggacatgcaagaactcactgcgctgtgtattccattgtgtcagatctcttcaacaatatgacactaatgatgaatactacggatgatttcagactagcagacttgtatattgtgtgacatgctcgcttcaaggaagctaagagttggggtttagaatttaaatctgcaacaccaatatattaataattagcgtgggttaacatggttgaagcctctttagcatcgacgattttactatcaaatccaatagaatttttttttaagaaaaatgaaatgtttaccgttgatttagaccatcaaaagcttggagttgaaactgagtcggaatcaggacagaggattaaccctaaaacattttcgactgcaaacccaaactaacctatctaaacccatccaaacagtgatcatgctaaatcgagaagttatcaaatagaaatgtggtgttcatccaatgctaaccagaattcagacatttagactgcaggttttccatcacttaatgattttttcaaacggttttgctatttcacttgtgatagatttttggttcccgtctttcgatttttcgtcagtaagatcttgcatccagattcatgctcatgtatatccaatttatagttaccctcgattacagagcacttatacttggctatagagaatttgtacttagttacaatttactaaaattagattttacaagtgtttttttttatctctagatatacggtttttttttacatttttgtcatttttcattcaaaatgggttatatccattgattaaaagttctgtaagatttgaagctccaatttatccaaagatcaataggtactcccctttttcaaaggttttgctattttacttgtgacagattttatttttactttgtaggatcttgcatcaagattcatgttgctgtatatccaacttacactttcgctacttcttgttgggatcaaatccctcttgcacggaaaatggagcgatccattagagcatgattaattaaagagtaaattgcattgctggtacacaaacttgttagaatggtacaatttagtatataaacttgtaaaatgcccgttttagtatacgaacttgcctagttcgtgcgaacgaggaccaaaatatcat

SEQ ID NO: 81923 - DNA, 4354 bp, Oryza sativa
aatattagttttgaagatcatttcaagtttgaccatatcttatattatgtttcaattttaatttttaaaatatttatcattattattttattatattgggattagatgttacgtgactgaatcttatcttatatagtgaaagcagcaagccttcttatacgaggatgtgctatatcatcaaaaatatgttagccgtctgataaagagcttggataaataatggtctttggatcgaagagagcatgtattaaaaaaaatcataaatgggctaaatatatggaattttttttggaggtttctggcatctcctactaaacatatgatacatacaaaaagaaaggaaataaagagaagaaagatgatgcttctagtgattcctcttataaacatatactccatcagttttacaatgtaagactttctagcattgctcacatttatttagatgttaatgaatctaaacatatatatgtgcctagattcattaacctctatatgaatgtgggcaatgctagaaagtcttataacctgaaacggaggtattagtagctatatttatagttggctagaacaatagatacttcataaacaaattaactttttatcaaaaccttattaagagctaaggtaaactaatagaccatatacaataaacaggatcaaaagtcgcgcaaaacgcgattatgtggttagtttttagtgaattttgtcaccccttgagtgggaattcaatggttctctttactccttcctattgattattaataaaagagtaaattttagataaccccaaatatacaaaactaatgggttttggcacgtgatacataacccctagctattataactataaagtttcacaaaccacattattaattattttatctaatttataagttatttattcatcatataaatattatatctaatcgtgtatataaagctttttaaaatttcaaaacaagagtatatcaatttagttaacggtgtgaattagtaaaacttcaaccacaatggttgtgattatgtttctcgtgccaaatctgttcgctcatatcataatagatatgaaatttactcattttattataaggttttcgtggttttgaactcctgatgtactaatgggttccaccgtatataagatccaatggcgttgatattcgtgatcaagatctgacggtgatggatgcattgtaagtttgtaactacacaaaatttatttccaggtggcgtctcctcattggccagcttatggcgcgcaacggggaagaaaccgacttcctttcccgcgcttttagccgttgccccccaatcccaccgctactttaacggagggggaattaatcaatagcgctcaaatttacatctcaccccctaaaaaaacatataataacaccgaaagcatcaaacgatctgcacagcgcaacggacaacggcagttttccctaaaaccccctccagacaaataaattcgcactcctgcccttcttccttctctctcttcctccacctcctcctcgatccccaaatcccccaaaccctagctcgccggagcagtggagggcctcgccgccgtgctgcctcttggcccctccgtgtgatgccactgagtgcgcgtgggtgggtgtgcgtgttgtagctctttcatggcgtcgcagcctcccgccgccgtggaggctcgtctcgcggatctctgcaaggtgaggtggtggttagatctttggttggccgctggtgggaatcgtcgagcgtttgaggtctcatggttcgatgggttttggtgcaggagctgggagtggacgagggcgtcgccggcgaggccgcggcggtgctggaggaggggaagggcgcgctcctcgcgtcgccgtcgttcgggagcaaatcggtgagggctgctctgtcttttgcggcgaatttgaggctatcttttgtcccccccccctaaagtttggattcttgcagcccgaggatgctgagaagctgtgcttcgcgttcgtgctgtactgcgtctccaagctgaaggagaccaaggcgggttcctccggcgttaggctctgggagatcttgaagggttgcaagctcaagtgggtcatgctatgttataatggtttttgaactgtagtctagcaagttttagggccttgttgacactggattgttttttttttttttttacctttgtttggtgtgcaggtatgatgatttcttcaaggaatcacagcggcttgcttcaaggatcgaccaggttttgggaagccgttatgggtcagattgggaagctcggctagaggtgggttcacgccaagcccccgcattgaacagattcacatttttctttttcagatgtgcataacctgtttgttttcttcattgttgtttcaattgtgattccagctgaagcaattggagaatttagtaaatctattggcagatgcaagccggtaagcaacatatgtgccttgtacctgattgcagttttataacagaaccgttcttttgcatggggatttgaagctcacgagtttattagaattttgccacaaattacaactgatacataggttcatattgttgagatttgtttgtttgctttatatggtagtgcaaaatttacccacaatttcacaatatcctaggttctattgcaaagcatttaatgagctattcttgagcccaagtactgatcaggagcctggatcaactacaaatattcctgattatatccgttttgggtggctgctcttcttaattcttcgctcaaaatcacccgaactgtttaaggacctggtatcctgcatccatggactagttgccatattggtgagtttgcttttctctttattccgtttcattatttttatcctttagctatgcaatcttgtacttgtggttaactggctacttcaaccaccactagcccttgtgctttctggagctaacttgtcaaaaaaatgattcattacaggccatacttttaattcacgtacctgctaaatttaggagcttcacaattgaaggttcttctcacttaagtaatatttctcaactttattccaaattatttctttaactgtcttactttatttggcatctgcacagattataattacagtccttttgtttaatttcagtcaaacaaactgagaaaggcgtggatcttcttccatcgttatgtcacaactatcatacctctgaagaccgcttgaaagaaatgatgggaaaatcttacaaagtgatagaggtcttttttagcaggaaagcaataaatgcttcagagttcaaaacagtgaatttggataaaatagatacaggcatgacctcaaacacccgtgttctctctcatgtgttcctgcatgcatgctctgtcttacattcaattatctaagtcttgtttcattgttatggtggtagatggcctgatgtatttcaaagatcttgtcgatgatgagatttttcagtcaaatttggaaaaactggagaagctaagtagtaccaccggctgccaaggggagcttgatttggaaatgtttttgaccagcaatgactatgtactcaatgctgaaaactcttctggtagttccgctaattttggctgctcaaaggtatctgtgatgattcataatctttttagttaactacacattgttttctttttttacattacagattcccttttctctttttgcagcgtgtgtttgaaacactagcctctcctacaaagacaataaagaatatgttggctgcccctagttccccttcatcacctgccaatgggggctcaatcaagattgtgcagatgacaccagttacttctgccatgacaactgctaagtggctacgtgatgtgatatcttcattgcccgataaaccttcctctaagcttgaagagttcctttcgtcctgcgatacggatttgacaagtgatgtagtaaaaagggtcagcataattttggaagctatttttccaaccaagtctatagatcggggtacttccataggcctcaattgtgcaaacgcatttgatattccatgggcagaagcaagaaaaatggaggcttccaagttgtattatagggtgctggaggcaatctgcagagcagagtcacagaacaataatgtaaataatttaaccccattgttgtcaaatgaacgttttcatcgatgcttgattgcatgttcagctgagctagtattggcaacacataagacagtcatcatgatgtttcctgctgtcctggagagtactggtttaactgcatttgatttgagcaaaataattgagaactttgtgagacatgaagaaacccttccaagagaattgaaaaggcatttaaattcattagaagaacag

SEQ ID NO: 81924 - DNA, 1309 bp, Oryza sativa
  unsure (1)..(1309): unsure at all n locations
tgtttaatctagggtgaacaaggtaataataacaataacaataataataaggtcataacaaaggtagataggcatggctagataaaacagtgataacgcgggaatttaaataaagcgataatgcaataatttaaagcaacataattttataaactgggattcaatatgttcaaagatgatgtgacttgccttgctcgctttcccaaaacgccggcttcaacttccacgaaaagcggatcctccgaagctgcagcgtctacacgaccaacggaaaagaaaaggcttttactctaataaactccatataacaagcagaaacaaagcacaaaaatgggttcttgacttcttagggaaaaattagagacttgaacggtccaattccgagttcaaatggccaagttatggccatttgaagtttatatgctctttaaatgaatatttgcgaatttcttcatttaaattttaatttaaaatggattttttgcgtcagccgaggggaggggcgcgcggaccgggtccacgggcgtgggacccacggcgccggccggtgtgagcccgggtgcgcccggtccaccgtggaccgtggggctgccgccggtccaccgtggacggtgccgtgccgcggcggcgtcgtggcgtctcgtcgtgtcgtgccgctgcggcatcgtggcgtggcgtcgtgtcgtgacgacatcggcgtcgtcgtcggcaacgaggcggccggcggcaaccgagagggaaagagagaggttgagatcggagagagatagctgatgagagggaggcggcggcggaggaggcggcgacgacgacgagcgcgagacgacggcgagatacggcggcggcgtcggcgcagggatgccctacgcagttgtggcgaaggagaagtcgagagagatcgatcgggcaaaaacttctaagtgttggtggagaagacgagggcgagcatcgggaatatatatacccctagatctttactcccggttctttactcccggttgttctcatcaaccgggagtaaagatattttcccgctatttccaaattctttttaaacccggttagggttaagaaccgggactactgataagcgtactgaatattattttccattacatatgtgcttctaaaatagaaaataatgcattaaaattatttaaagtacaaagattaatgacaattacttcgaaaaattattgttgttctngtaataaattaagtggataaaacgtaataagcaaatatatgatttaaaattaataaaaattctaataatcatatatacttagcatatgaatgatattaaatt

SEQ ID NO: 81925 - DNA, 9685 bp, Oryza sativa
ccaggtactatcgctatctacaattgcacatacgtgtattatccggattttttttcttctccaaaaccaacacaatgcccttagatattagttctccagatccaacaaatttgtgctgctcttgtatagctggatttgggacttcatttgatttggggttgatatgcggttatgttttttaaatttgagtgggaatttttgttttggtttaatcagaggatggaggataatatgatgtacccaatcaaggaccaagaaaccatgctgtgagttggccaatctctgttctcctgcaattacattttcctttttgcagtagatcttgcttccaattgattttgcagggcagtaccaatggacatgaacaggcagcagcaggatacagtttgctccaaggaaattttgcagcaccaaatcagtattatactggctagcatctcttgtttatttgcattctgatgtttttttttatcctgtgggacagattgatctgggctacgatcgaatgccacaatatatgtcaggcatgtaacacaggggagtgcagaaatcctgttattttcactcaatctggtaatctgctctaattcttttgctattctttgccttggccatgtactggattgaaattgaagatatttatttgagcatatatattatttttgttcagggttacaggattgaaattcaagtatacaagattgcatataactgaaggattggagtggtcaatgtctagcattcaagcgtgcaagacctactgagctgtgtcaccattgcattgcatctgatctaagttggcgctcttggtttaaattgttgagtggtgtcaatgctaaacttttatgccgaataagagttaagaatcttttaccaactttttacgctggggcacttcttggatgccctaatcttatattcgtttagtgccttgaatgaaaactagagcaatgctaggcttagtttgttgcgtgatgtagtagatggagatgtgtttatagcacggaaataataaaatcattttccatatgttctctattaaggaaatattaattctactatttatatattttgcctatatttatattcctgaatatataatttataatttaagggcaatggtaagttatatatgatatatgtatctctataccacccatcagtcatcatgtatacttagatacacatatttgatccgcattactaaccattaccgtagcgttagcacgggcaaattacttgttaaataagacaagtctatgttgatccaactagtggaaatcaaacatgcaaacctttgcactcctctcatcctggaacactaaccgtacttattttcctgatgcaactaattgcaattataagttatatataacccacgaattacattgctaccggcacgatggctgaatattgttgcaagtttgcaaccacagagcaaagatccccaagcaaacaaatccaaatccgacgaactactcgagcacgatatgaaagccttttggctgtccaagcggggttacggaggacggcgagcggcgctgggcggaggaaaagggagagagatagttgcagtggcgtcgccggcggtgggtcgggaggaagagaaaggcgaggccggtgttgggggggcgggggggggtgacgaaacgggtttggcaccggcactgtgcgggttgattttgttttgaatattaatgactttaggatccatacttattataaattatctagttctaaaataaatgtttgaaattcatttttaatagttaatttatagttaattcattcgtttgcatcttcgaatagttttttcgcgaacgcatcttccaatagttattacaaattcacttagcaaataaataaataaataaataaacagactacacagatgaataatataagtagttagcagacgatatatgcccttccctctacttctctcttccacattgaatcttacatggtgttcacaagaggtcagtacagttcgcaattttaccatgcaaatttgtacagtttaacaaaaacaagacttcatcttcattcttataaatgcatatccagtttatctgcattatggtacaggaatcccactttgttgcactaaactaaactatcatcatcatctggttggacaaaaaaacatgtcgaacaaaatatgtcaattcactggctaacactttctttatcaaacaccatgatttatggtaattaaatgggtcagtgcatgacatcacatatatacatgcagtcgaaaaaaatatatggagactttgggggttctgttaaaaatcctgtaagatatttgaaggcaacttattatgtcaggaagaattttaaccgagtttttcaaggcttccagtttgtttgaactgtcatgctgagtccaagttgatggatttactatcaatcagccattgctatctaacataattttcactagctcttcattccaccaactatcttcctgcaaaagccgggatgagatttcagatatgaaaagagtcattaaaaaggtaaaaacaagattatcatgaagtactgaagtactcaaatgttaccagttcgtgtataggttagtccatcaatgccaacaccttgctgttcgtataacaagaacagccataacaatcaagaactatccgttgctgactatcaagatagccgagactgccttctcacaaattgtatcatgttctcacgtataagctgcgggcaaaaccttcatttttcacaaacaagttctagtacttcacaagtgctggtattacagcatagcagtctgctaagcaatgaaaaagccaattcaggagtagagtgtccggcagattgacaagtagttcaccctacaaaaatgtaaatttttgaaaataaaattaatattcacagtatgtccgaagttgaacttttaatgacagaaagctgaaaccccaattcgctttccaatattcatgcttgtatatcctaaaaataacatgtccaatgtgatctttgtgatgcatttcaacaatgaaaaacagtactacatgtagtaataaggatgttagttattatcggtggataaaaaaggacgtgatggtagacaaatctatagttagcttcaagatcactaattaagcagcaaattgctttgccatctaatcaggcttttggaaaatatttgcaaaatatcttttaacaattttgttttcaccaggaaactatggggatactctgatatttaccttaatttcctttccagtgaatgataaggaatttcgatgagtctccaaagacattgcttctctcatgagccgaaataccttcttgttcatgtttgttttcatgatgatcattttgccagatgaatatatcctactgataccaagatctgctgccatccgtcttacatagagctttttcaatagcaactgcaaggaggagaaaggaagacataacgaagtaatcaaacttcaccatcaccaactatggtcacattggcatgatgaaaatctcagaaacagcaaacctccatatcacgaggctcctttccatattgtcgacgaagatcttctgtgaattgtattaaggtccataggtctttctctgcagcttttgcagcttcgttaagcaattccaccggattttcaaggtaacttatgtattcagaggagagacgtgaagaaatgtttatatccagctgtccaaagacacaaagtttgtgaatgaaatcaaaagggcaggttacccagatgaaattattcgtcattgcatgaaaaagctacagcagcaaagacaataaattttgtgcccacctgaacatctttgtaagggacgggaataagacaaaactgatcaacctaaaaagatagaaaatagtcttgtcagaatgatcacagtaaataattaataacgccatgcaacaattcagaaggttatttggctcattaaaggatgtacaaaattaaaaacagaagaactgtatgattgtaccaaatagttggaatattgaaatagtagtatgtggaccaaatgggtaaggactacctgaaattgcctataaaatatcttcgcatgaaacaaagatgataacaatatgcatgccatgaatgagaagcattctcaaataaaacaaatgaggcagtaaaaaaactgggtctagaaggggattacataacaataatcactacttcaagtggcaaacaagaaaaaattgttcaaaacagagttcttttctttaccaagaactagccatcttaaaggcagcaacaaagtagtgaatagatgaatactccctccgtcccataatatagcaacctaggaccggatgtgacacttcatagtacaacgaatttagacaggaagcatgtccggattcgttgtactatgaagtgtcttgtccggtactaggttgctatattataggatggagggagtaaaagatatgtatgatacaaaataaaggatataagaataacaggtgcagaaccaaaaaaaggaagtgaatagttgaataaaagaaaaataatatcatgagcagatatgcgtgattgatgtgtatacctttgacaagctatcaaaaagcatatcaaagaatagatcaatgccaacatttgcaacatctccagattgttgctcaccaaacaagcttccgaaccccctgatacccatatccttctctgcaacatggaaaccttgaccaagatctgaatgctcctcaatagctccaagtctatcctgcagatggagatattgaactacagatgaagaatgacacaacacaatacagattctgaactcatttaacaaaagatatttcaagggataattgccttattgtcatacaaaagaccccttattttttctgtaagatgccctatagaaatgtatcagaaaatcaaacatcaggtgctgtggaagtagtaaaagctacaatttagttcacttcattttgccatggcataaggctagtcatacaagtggtggtcaggactgagggctcaggaagcatcaatacactgaaacctagtaagcataacatacattccaaagtgccaataatagaaatactgcttattaggtgccaccaagactggttaactgatcttatgtacaacaaactatcattaaaggaaatttaggttatatttctgactgggcttccatatttagtattattgcaaatatgctttcagtaacagtcatcagatgatttggatgctgtgacaagaaaatgaatataaataataaaattaggggcactatggtagagctaaccgttgcaatctttgagagcaaagacttatcagtgtagaagaggtatgcgaaaccttctgtgccggatcttcctactctacctcgcaactgtgaaggaaaaacaaaggggtgaacttgtaaaattaggaagatgcattagaaacaacacggataactagggcacatattacttttaagtacgataacagtctcacagaaggctaaacagaggcacaggacagctcatactttttcagttcttcgtagcttattttgtatttataaatgagaaaactccagtaagatgctcaaaaactatttgccaatgggcatagttcaacaatcaatcaaatttatgtgctcacatattatcaaatataaatgctaaataactatgccataatgaggtgcttctagtttgtttgctggacaggtgttttgctgtaccccttcttggattgttgttgttgttttatcactctcttatcaatgaaataagagccttttgcctttgtttaaaacaaaatgccataaaggaaaaggaaagcatatcagaaaaacaaagccacctgatatagctgtgcaagcccaaatagttcagcatactgaactaccatcgtgttggcatttggaatatctattccactttcaatgatgtgtgtgcagaccagaattttgacttctccacaagcaaatttttccatagcaagttgtatgttctttgaaactttctgcgggaaaaagaattggcaagaaatttgattatgacaaaagcaccattcgactatgcaaatagaacataaatcttgattgttaacctaacattattccatatataataactagcaacttaagatatagacttgactgaaattgaaggttgtaagctttacagaaaataaatagtcattgacaatcaaaatcaaaacgaactatcgaagaacaaggtcatcgacaaggcccatatagagtttcctgttaaattagtttgaacactaatcagccatgcaaggaaatcctaacaatgataagagagtttcattggtagaaatccacatgttggactttggctttaacacaatcaagggtatacaaataaaaatagcctacaataaataatagtgaaatagcatactaaacacatctgaaagtttagtcaataaacctttccatgagcaacagccattggaacatctggaagagaatccttgagaaattgcagcacatcatctattgctgtcgcatgatgaaataaattattaaacataaatgcagatttgcaatctaaattattgaatgactttgcatgatattgcagcttctatatggacagtatagattgttagtgaacgcatccagcaataggctaattgttagaacaatctgcaatcgcaagtccaacttgctgagtactaaactgagattgggaatattgagaaaaaaattgttttcaggttcatgcatcacaagtatatgctgtgaacaataagtcatctgaagataacaaagtttccaccttttattcgaggaacaacatagaaaacttgaccaccacgtgccaactcaaacttaatagctgatagagccctttctttgctaaatcctgacacgtaggtccttacagcaactctttctggaggcggcgtagacattaaactgaaatcataatacatatgcttgtgtcatggaaaaaaatgaaaacaattccgagattaaatgcatccaaggtattggagttatgaagaatgaattaaatatagagtcagcagaatagcgctatgatcacattaaatgcacgaattatctcaagaaaacagtagtaactattgcaaatgtaataaaatggctcaagtgaatcccctaaaaaaactctagtgattactcgtaaccattgtccacaaattatctcaagaaaacagtggtaataaattagcaatatctcgtaataaattgtggacaatggttacgagtaataaattagcaatatctcgtccaatatctcgtccaacagaaaacagaagaaaaaaatagtattgttgccatcttacctggcatcacggaaacctgtcaacgcgagatacaaagtacgtggaatgggtgttgcagacagtgtgagaacatcaatagaagccttgtatgatgcaatcttctccttttgttggacaccaaacttctgttgaaacatagagtttgtgaatatatataaaataaaataaaatgcatggctgattttggttgcgagatatttagtcaaaatttatggaacactagagttaagttttcagataaccattcctgacctttagaaaaataacaaaaagtaaacataaaacaatctagtattttttttgtcgaatataatctacaacaaaaaggctttcccttgctatatatatttcttgtagaaaaccttaatatgattaacttgttcttttcatttctggaaaatactacccatattaccatcattgatgttatcaataacagaaaactatacccaaaaaaatcaaacagagtaaacatttatatttacaaattacaaagagaacctgttcttcatccaccactaggagaccaagattgttatatgccatacgttctgtaagaacagcatgagttccaacaataatatgcaaatcaccattccttatctttgttattagctcatctttttcttctttggtctgtaaagcagaaatgtaccccaagtcatgcagaagataagagacgcaaattccatcactttaacagacaaaatttaaagaaatactaatgccttcctatctgagaacctacatgcccacatatgagcactatcactacaaaaattgctgaccagtaagtacaagaatcccttattgaatgtcagaagaaaaggttcgggaaagacaaaagggacttccttaaaaatatatatttgaacagtacttaataacattcagtgaaacatcaaaaggtagaaaacagggtattattaccgattgttgtacaatcggtaatatatataccttttttttctaacaacaacaaaaggcacatcaactttttttcctaatatgggataagatcataagagcagcacactttctagggtcaggactaatacagtaataccttgtagttaagcaattaatgaatataaaatgatttcacagtaacacaaaaatattactactaacacaataatgcttggttgttaatcaattgaggcatacaaaaaatattgcttggaaatgaaaaacacaatgaattgcctggtggggtaactttgagttgtgccatgctatacctgagcaccactaaacatggcaaccttaatatcaggataattggagaaacgctcagacattacatcataatgttgcttggctagtattacagttggagcaagaaccatagcttgaaatccagcagatataacaatgaatatagcacgcattgcaacttcagttttaccaaacccaacatctccacaaatcaatctgtccattggggtttccctttcagtcagatctttgtcaacatctataaaagcctgtcattaacacgaactgcattaaatccattgatgttgattcaatcctatgtattagtaaagtagtgcatggattacttaatcaactagactcatcagtttgccaataagtcttgcacaaggaaagaatagcagcagcttctctttctaaaaaacgacatcagaatttccaggtgaacaaaagaaagaacaacagtatttgattaagagccgacctggttttggtctggagtgggctcatagggaaattcagcagtaaactgatccattcccacaggcttcgggtaaggaggccttttctgcctcatcctttgtaaatacaactccatcaaattgactaccattttctgaacagcaagcttccctttcagtcttctcttctcccacgtggaaggatcgttcagtttgctcaaattccgtggtctctgcttctcgtgaggtctgcaggaaacatcaatctggataaatggtcaacgtgaatttttactttccaccagaattgaagggacaggcccacaataaaacatttataccaaacatcaagtccggaaatagcaatttttacaatgtttatataagtagtaatgaatttttcttgttccttaaatggaggctggaacgtgcagaaaacatgaaagttcttgcagccattcagagcaggaatcaattttggcaaaatgcaattattatgtcaaaattcgcatagctagctactcaggcatacaggttgtatctgtagagcatgcgggcggcctggtcgacggcgagcttggccatggcgtcggcgtactgtatgaagacgtagtcgagaccgccctcggcgctgatgcagacgaacttgccgacgccgacctttttgtgcacgacgtactccccggccttcagcttccgcgggtacacccggtgacccaa

SEQ ID NO: 81926 - DNA, 20748 bp, Oryza sativa
gccagtgtaacggggctggaggacggcagcgggccggtgtagacggcgggggcaaagcggaaagagtggtagttgaaggcggccggtggtggcgccctgccgccggcgacagggaagacgacggacagcttgccgccgtcggcttgaggcaaaggagaggagggggaggggggcctcatcggcgccgttgacacctttcggccagccggcgaggccgggcggcggcgcgctggggcagcggtggcggcggaggcgggggaagcgctaaggagcggcggcgtgaggaatcgggagaggagagaggatttttagggtttggttgtctacacgaatcttaaagcaatcgaatggtctaaaatttctaagatctgtgagggggttttctgtcaaatgatctatagacaggccctataaagtttggtctcaatactggatttgttttatgaggcttagagatgcaaatcactatttctttgattatggatttgacttattataaccttttgattctgtacgttaataaatttcccgaaaattaatatgccgtacagccatagtggtctcctctactgtttttgggtcaaacaagtgttatatgataaacttcttcatttgatttgctgcgggcaacacgtccataatgctataataataataatacaatatgttaacgccgattatgaagtctaattactgcaaaaggtaaaaagtatcgaatagaaaaaaggggcaagtaatgttaaatggtgtgaccttttctgattttatctagaaaaaatgtccgtgctttaagatgaaattttaaacggggcaagtaatgttaaacaggtgaaaactattttaatcttattattattatgtcgagttaagatgaaattcactgtgttaaattcgcttggatatatattttgttagaaaatcgtaagctgcaattaggtgtccgatcgtctcaagttagtatgtgagtttttaaagagatttcttatacaatttcttctgtatttctaaaagcgaacgaacttagaaactggctcaaatacagatttgtattttcaaaagcgaatggacttaaaaccgactcatacgcagatgccgtactaaaataccagcaaaaacatctttattttttataatagtagagaaagagatagagatagagagatatgtgtgcagtagcttgattgaatatttctctgattaggtttttgtatttctcttggcaaccgtgatcgatcggctactgttgctgatcgtcttgttgcacgtgtggattttcgatatgtgggtagtaatagatctcggctttgatatcctgatcttttttttaatctttctggaacacgtatacccggcagaccgtattggattgagtttctgatgaacacggtaggaattcttctcgatacagtgtatgcgtgtagagaaaaatcgacaatggtatgtcgtgctgctggccggcctcggcacacggcaacacaactgactgctgctggttggtgttgatataggtgcgtgacaacaggtcccaaaccgtgttgctgaacagatcgtatcggcaagatgacaacttcgcggtggcagttggttcgtgacaatgcacagcacgaaatacaatcggctgaagtcactgatccgaacaagcaaattttcttagggaaaatccaacgtttaaagctcatacatgtgggacacataaatagttaaattgacagtgataatgtgcgagacggatttggacacgacgacttaccaagccaccggcaaaaacatcttcaatttttataatagtagagatagagatagagatttgtattgctttgtaaacttcagcatacccttctctttctcctccgaaaccacgtcaccacctactttatctttctcctctgaaaccacctctagactctagatgtcactatctccttacacacaacacaacattaacacatcgacaaatggatttaatagacaagatttcaatgtggtaacactttgagtgggttgaagcacctaatggatttaagcggtttggatatagatggagaaagatttggtttggtttggttttggctgcaaaatttcactctcaaattggattccgctcatggatggtttggatatatatggaaaaaggtttgctttgtgtttaggtcttgttacaaaattttagctactgagttgtccccaaacacttcatcttacttgttgaggaatcgtctgatgaggaatcatcgccagtaactttccattttcccctcgtgggggttgccaactgtcttggatttacattgccgatgtcctcaacttcctccaccgtctccttagccacctagacattgattctgcaattcttgcaggtatctaccttgtcggtcatcgcatccctttccactccttcccgactcctccaagtagacgtcactaggaccctccctaccctgagcatctacgtacgttgtgtcaattctgcctcctctacctaggccactaccaaagggacacatcggcctgacttctcctcttggatctatgttatacttccaccaccaccactctcaacaataaatagtatccttttgatgtagcccaacaatagtatccttttatgtagcatgagtgtctatcaagggctagataataataaatgattgcctttgaattgtatttcctgtagcatgggtgtctatctagtccaataaatgattgcctttgaattacatttcctcttacaactctcgtacggtgacttggaaaaaaactgcaaattaatgtacttttcttttacgaccaaattaaagaacttgaactagctacgtcgtcttaaaacccctggaaatcaaatttgtttggaataaggtcacctgacgtccctcaactttacgtcgagtttgtctgaggtccttaatccacaataccgaaaatctctacccctcaactatcataaaccgtgcacaaaaggtcccgaggcagtattgacctaatttttcccggtttcgctgatgtggcatacagtaggccctacatgtcattgtcctcccttctcttctcttctctctcttttcttcttctctttcctttcgtctccctgatctcttctctacttcagcgagactgcaggcgggcggggcggcgggcgaagcaggcaaggggcagcgcgcgcggagcagcggcggcggcgggcaagcacgcagtggataagtagagtagaatagtagaagatgaatgcatgccagctccctcacgctaattaagccaatcccaatcctaatcctaattcctacgtgccctgcactatttgtccataccttcatcattttgcttactaattggcccaaccaaatctttgctttgtttcccctacctaagctaataataatctagctaacgctccctcactctcaaagttagcctcatcaattagcagcgtgaggaggatacagatcaatacatggcggcgggagcagccgtgcacgtcgtcaggcggccgccgctacagatcagccggtggtgtacacggtgtggaagaggtccagcataggcttccagggcaccgatggcttctccgtctacgactccgccggcaagctcgcgttccgtgtcgacaaaactactaccaccgccgcaaagctttcgccggcgacctactgcttaaggatggccacggcccacggcacgcctcttctctccctcaagccacaggtcaatcatctttccattcacttcattaattcttttctagctactcgtatatcgctttagcagcagcctgtttactgatcgatcagatcatgagtttagtttactagtttggaatcatgtatcttaagatcagctcagcgtggaggagttcatcgcgcggtacatccagctagctgcacgcgccacacgtcagggacgccgtcgctgcactcgtgctcgacatgttcaccgcgcccatagtcgacgtggcgtgcgacctcggcgtgctgtcctacgtgttcatgtcgtccaccagcggccagcaccatgctcgcgctcatgctgcacctccccgtgctccacgagcgcgtcaccgtggagttcgacgaggtggacggggatgtggacgtgcctggcctgccgcgcctctgccgccagcgtccatgccgtgccgtgcccgatggtggacaagaagagccccaactacacgtggttcgtgcgcctcggcgaccgcttcatggacgccacgggcatcatcgcgaacaccgccgaggcgccgacgagctcgaaccggccgggtcccctcgccaccatcgcggacagtcggtgcgtgcaggggcgaaccgcatctccgatctccccgacgacctcatccagcgcatcctccacttcgcgccggcgagggaggccgcgtccaccggcctcctctcctcccgctggcgctcgctctggcgctccaccggcgccgtcaacctcgccgtcctcgtccgccgccgcgacgacttcttctccctccgcgacgcgttcgtccgctccgcccacgccgcgctcgccgccgccgccggcggccacgtcaggaggctcaccatgcacgtggagacggagcgcctccccgtgcagctgacggccgacgcgttcctgcaccgcgacgcggaggactgggggaggaggcacgacgtggtcgccggcgtcgtgtcccacccggcggcgcgccgcgtcgaggagctccgcgtcgccgccgtcaggtccgccgacgggccgtcgtccgacagggaggtcacggagatggaagaaggggagttccacctctccctcggcggcagcggcggcacccagccgtcgacggagacgctccgcgtgctcgacctcaccgggtgcggcggcgtctccctccccgccggcgcggcgctcccgcggctgacgacgctgcggctgcggctgtgcgtcgtgcaggtcgaggacctgcagggcgtcgtcgactccgcgccggcgctcgccaccgtgcacctcgagtccgtcttcctcgccgggacgaaagaagacggctgctgcgcccgcctccgcttccccgcggccaccgcgctcgtgctggccaagtgcaggggccacgggagccaccacaacggcgacgacgacgccagcgactgcgagggcgccatggagatcgacgcgccgaggctccgatcgttcaagtacacggggctgccccggcggttctcgctcatctcgccggcggcggacatggaacgcgcggacctgcacttcctccacgacgacgggcctcaccactaccgcgacaccaccgccgtgctccgcgcgcgcttctggcgcttcctccacaacttccgcggcgtcaagtccctcaagctgaaggtgacctacctcaaggcgatcgccgtcaccggcaacggcaaaggcatcctcctcccgccgctccatggcgtcgagcgcctcgacgtcgccgcgctgcacgacccggcgagcgagacgtccacggtggccatcgccaacctgctccgctgctgccccaacctccgcgacctcgtgctccgcctcagcacggtgccgccggattccaccaagaacggcggctactgccgcgacgtcctgcggaggcgctggcaggcggacctcgacgagtcggtccaccgcctcgcccgccggcgaggctggccgaagccgccgccgccgccgccgccgacaaagatctcctgcatgaaccaaagcctggacgatgccggcggtgacatccatggattgagcggccgatccttcgcctgcttgcgaagctcgttgacaagggttgggatccagttccggaacgacgagcgcagctggcttggcgtctcgctgatcaagttcttcgcggagaacgccatttgcctcgaggagatgcgcgtcgatggagggaacgagaggatgcgcgatcacatcaatcgtagggttgagagatggatcgttgagagtggcatgcgatgctttagagtgttaccgcttgagcggcgatgaaattaggagagatggattattgcaaacttgcaagtgactgaaattaatcaaggtcttgataagttgtgtgttgcaaataaaatgcgggttttttttttctagcttgttatcttcagtgataaaagaatgtcgttttaaattggtgtagtacaaaatatagattttggatataccaaataatcaaaatgacatatatagccaaatttgttatgaagagagctttcataacattacgcttgtgtgtaattaactacattttagttcatgttaaagaattggtgagcattgttatttactgcctctatctcaaaatatagctactaaagtgtgttttgaaactaatgattagccgcacgtaaaactagaaacatgattaacatatgattattgagtactaattactaaaagctagcaaaataaatttatttgattttttaaaacaacttatgcatctacttactcatcccaacgagtcacaaacatcactcgattaatttgtttagatagtttctcatctcaaccaatcatacttatttctcacctcaaccttatttttttttaaaaaaaggtatatatatagggaccacatatacatttatagtataacttctacgtaactttgaaaaatccctctataacatagtagtttccgtgaaatggaggttgtgggaacaaatcctctcacatgtgtgtatgccttgactttttttccttctttacacgaatcttaaaacaaatctaaaggttcaaagttatatgaaagttacatagtacaagttacaatgtaattaaattacgattgcattataattacatatgttcaaattttgggagaaaaataatcgaaaaatatagaaaaaatgtaaatatatatttatattttatgatgaatgtattattgagtttgaagcacatggcacgtcctttcaaagtaactcagagacatatgcacgattcaaaacctagtgccatggtaactccttccgttaccttggtaatttctatattttaatttgtttagaatgtgatttgttaggttctaggggaacctaaaactacatattgctaagcctgaaactgcagtgctatgcaatttgcaattcagttcattgttgttactgcaattttgttgttatatatatatctgattttattgtctttttatataagtttgaatatttttctagagatttttatatatttttatgactcaaaagtctatttcatgtaattttgttggtttttgtaagtgagaatagtttattgtgcaatcattcaagagtgataagtaatatagtatgaattatctagtgatgagaaccgtatcagaaaaactactcaacatcagtattccgtagacacgggataagtactaccagtaaatatctctcactccccacactttctattcaaccttatcctctcatctcttccccttccctcctctctctctctctctctctctctctaccaccctcatggagcacggaggcgacgaggtcttgtgggatggcgcatcgggcgtggaggaagctgacatcaccgccaccgccattgctgctggtggaggtgtgggcggagtagaggaggagatcgtgaagctgttagtgaggtaggtgcccaattagcacatgatggaggcggagctgcccatcacatttcaggaggtggccattgtcgacgaggtcactgtcatcaaggacaagagacctcttgtggtgtggatccgtacacccagatctaggctcgcgacctccaagctcctacgttatctagttctacatttgattttgggttctgcatgttctataggtgtttctacagctatgttggcttttttcctggaatatatttcctttattagtttttattcaactctctcttgataaacacatgatttttagttctttattacggtgacattttagtggtatcatcatactttggtacttgtaggtatcatggctgatacccaggtatcagacatggtaccagtaggtaccatgcttagtacctgtggtatcatggctggtacccataagtatcagacctggtaccgggcacctgtaaggtatcaggtagcatggctggctgcaaggtatcaagtatcaagcaccacacgtcttctctcctcttctcccttccctagccttgatccttgtctcctattgctatcacaaccaaagtcctctcctgctctggatgggggaagtcctgctcggagtagttgcaggcgtcgccggcgaggtatcgcgtgcggagtaaggttctggccagccggaggaaggagcactcctgctcgaagtagttgcggcggcgcggcgccgctggcgaagcgcaataccaagccgggttctgcttggggtggaatcgcgtggacagcgtgggcctcagtcagaaaaagatacatattaaatctgtcgggggatttagttatcccgtgactaccactttgcaatgaaatcctatacagtagctgccctcgaaccatatacattggattgtcatcggagggttgaaaaaacttactaaattttttgaaactttaggcgcctaaaatctacacactcactagaaatatacatgtttgtccatatgaaaattataccattagggttttatgtgaaaaaaccttttgtatttgaatatcaagatactcgtagaggccgtaacaattaaggaaatatataaggatacagaaggtagatgttaaatttgtaccctaagctagagaccgtgagaaataaacataattttcgtaggttgtccaatttgttttagaaattcgagtacaaactacaaagaggtgtacttcaattttcgtaaaacaagggcactcgtatattggtgagaaaggtcaccgtaaatcctagaagttcccaactcgtatcgagaaattaattaaggtaacgaagatctcgcgaccaaccccagatggccatcacctccgccgccggctgcggctgcggctgcggcggcgacggcgaccggctaagctcgctgagcgacggcgtgatcggccacatcctgtcgttcctcccggcgaaggaggcggcgcgcgcggcggtgctctcgtcgcggtggcgccacacgttcgccgccgtccacaccgtctccctcgtggagcccgacgcccccgtcgtcgaccacgacgagttcgccgggtacagccccgggtggggcccgccgccgaaccccaacccgccgccgccgccgttcgccagcgccgtcagcgccgccctcctcgcccgccaccgccgcgccgccgccgtccccctccgcgcgctccgcgtctccatggccggctacgcccacagggtctcccccgcggtggaccagtggatcgcctacgccgtcaaccagcccgcccccgacggcgtcgagctcgacctccgcctcggccgcccctcgctctgccaccgcgactactccctccgccgccgctccgccgccgcgatcgacgaagatgcgaggccgagacggtggaggacgatgccgcccgaggacattctcttcgagagccctagcagcggagaggaggatcacgccgacgacgaggacgacgacgacgtcctctccgacgacggcaagaaggatcccatggccgtgtacaggcggcggttcgagccgcaggagtacagcgtgccgagggggctcttcgcctgcgcggcgctgcgttcgctgtcgctcggctccgtccggctcgctctgccggcggcggccatcgcgctgccgtccctcgagacgctgctcctggccgacgtcaccgagtccgaccacgagaggagcatgcagcgcctcatctccggctgcccgcgcctcgccgacctgacgctcgaggcctgctacgcaaaggcccacgcgctctccgtggcggggctccggcgcctacgcaggctggctctccggtgctgccacggcctggacaccgtcgtcctcggcgacgacgacgcgtcgccaccgtcggagctccaggccttcgagtaccgtggcgaagtgccggacgacttcttcctcgtcaccaccacgaagcacgggcacggcgtctctctggagacggtcacggtcgcctactgcaagatcgacatctgcggcgacgaggtgacgtcgaggtcggagctcgccatgctcggcgcgttcctccgccgcttcgccggcgtcgagcacctccacctcgcgtccgctcgcctcggctccggcctccacgacgccgccgcgttcgcgactctcccggacctgtcgaccctccgccgcctcgagttaggaggatgcctccccgacgacgacgacgacgacggcaccatcttcgccgcactgatcaggctcctcgacctcgcgccaaacctggaggcgttgtcgctcgtcttccacccagagcctctcgacgacggcgacgacgacgacggctaccgcgcatactgttaccacaaggaggaggagctccatgacaagcacctcctcagatacaaccggcacagcgtcctcgccgcgccgacgagcggcgccgccatggtggcgccggcctgcctgaggaggcgggtgagggagatcaacctggtgcactaccagggcggcacggtgcagagggcgctggccatgtacctgctccggagcgcggcggtgatccgtgagctgaggtgcgagctcgccatggggcccttgtggatccaggacgagctggtgcgagagatcaagggctgggtgatgaacaaggcggcagttatcaacttcggatgatatgcttgcatgcgcaatcgtgcatgaaaataatcttaagtaatcatttttttagtggagtaccagtaccagtattagattgtgcgaaaaattagagcaagaataatattgagctctaagaaggctgaatactgaggtggatgagagagaagaggagagagatgagaagcaagccgtaagtttacagccggcttaggcacaatcaccaagaaaatttacgagatagataggtggaccatatgtttatagtgaagagctaactagtatataagtgagctgagagataggtataaagatctatacaaccagcagctggctatattattacccttgctcttatcaaacatatctagattgtattttgactgatctaaatggctgagttcttttttgaagtttccaactcaacctctctttttccgtgtactgctttccaaactaccctccatctcataatataagggattttgagtttttgtttgcactgtttgactactcgtcttattcaaaaaattttggaattattatttatttttttgacttactttattatccaaagtattttaagcacaacttttcttttttttatatttgcacaaattttttcaataagacgagaggtcaaacaatataagcaaaaaactcgaaatcccttatattataggacggagggagtactaaacattcatttttaaataaatatatatatatatatgagagttattttaaagaatcatattaatctattttctttgaaaaataactattacttgattaatcatgcgctaacaagtcgttcttttgcgcgatggagtagttcccaacacctaaaattcattaataggctgtgttctttttagatgttggaaacacttcccctttacacgtaaaacagagtgctggattaacgtatgattagttaagtattagctataaaaaccttaaaaactaggttaatatattttttaaaagcaacattccgatagaaacttttttttttcaaaagacgcactatttagtagtttaaaaaacatacacgcgaaaaacgatggatatgagttgtgaagttagtctaaagaacacattctactaatgaatctgaagtaataattactgttattgctcttatgaatcaaacaatttgatgtaatcatgacaccttaaaaaaacaatttgaagtaaccatgacatctaaaattgaaaattaaatggaagtggatttttatcacttgaaggaacgtcctctcattttgtacgcggcatttaaaagtcatcaaaaattttaaagaaaatgtcaagatagaccaatatgtgatatgtcttttcataattacataattcaaaacgaaaataataaatttaaccacgaattacgtgttctatttaaagttaaatttgatcattataagttaaaattgactatgcatatagtagatctattttttaaaaagattttgttgataatttttatgcgacacttaaaaatgagagatatattttttaaagatcccaaatcaaatcatgcaccacgagcatttgattatgaagagtctgtttggcacagctccatctcagctaaacagtttcagctccaccaaactaggagtgcagttggatggagctctctcacaaaatgtactactccaaactcaactcctggagttatatttaggagttaaagctgtaccaaacaggcccgaagtttgaggcccagctaacccggcccgtagggcttcagcactcggtccagcccgttcgctccgtctcgccgcatcctatccgtactaagtcgcatcacaacatctgaaatatcgatcgccttcttggttcttgctgataggatcggtcgatgccatcgccgccgccgacgccgacgatggccgccggcgccgccgtcgaccgtatctccgacctccccgacgaccttctccagcgcgtcctgcacttcgtcccggcgaaggaggccgcgtccaccagcctcctctcgtcgcggtggcgctccaccggcgccgtcaacctcgccgtccacgttcgccgcgaccaggagcgggaattcttctccgcccgcgacgcgttcgtccgctccgcccacgccgcgctcgccgccgccgccggccacgtcaggcggctcaccatgcacgtggagacggagcgcatgcgcatctgcatgcagctgacggccgacgcgttcctgcaccgcgacccggaggactgggagaggaagcacgacgtggtcgccggcgtggtgtcccacccggcggcgcgccgcgtcgaggagctccgcgtcgccgccgccgtcgtcgaagcgtactggccgtcgttcgacggggaggtcacgagcagcagcgaaggggagtccgcttgtgcctcgacgcgcagccgtcggagacgctccgcgtgcttgatctcgccgggtgcggcggcctctccgccgccgccgccgccgccggcgtcctggcgctcccgcggctcacgacgctgcggctgcggctatgcaatttgcagatcagtgacctacaggggatcatcgacgccgcgccggagctcgccaccgtgcacctcgagtcggtcttcctcgcggggacggcagaagaaggctgcgtccgcctccgcttccgcggccaccaccgcgctcgcgatgatcaactgcggcgcggactgctacgcgtgcggcggctgctacggcgccaccgagatcgacgcgccgaggcttcgatcgttcaagtacacgggcttcgcgcggcggttctccctcgtctcgccggcggcggcgccgccgccggatgacacggtggtggcgcgcgcggagctccacttcctcgaccacttccaccacaaggacgccgacgccgccgacacggtccgcgccaacttctggcttttcctccacaacttccgcggcgccaagtccctgaagctgaaggtgagccacctcaagcacatcgccgtcgcggggcgcgcggcggcgcgccgcgcgctcctcctcccgctccacggcgtcgagcgcctcgacctgaccgcgcgccacgccgacgcggcggcgagcggcggccggacgacgacgacgtccaccacggtggccatcgccaacctgctccgctgctgccccaacctccgcgacctcgcgatccgcctcacccgcatggtgccgcacggctccaccaagaacggcgtctacgcccacgacctcctgcgggagcggcggcgggcggacctcgacgagtccgcgcgccgcttcgctcgccgccgccggcgaggcagctcgacgaagaaggacttggacgatgtcagtggtgacatccatggattgagcggccgaatcttccattgcttgcggagctcgctgagaagagttggaatccagtttcatctggacgaacacaacgactgcatcggagtccggctgatcaagttcttcgcggagaacgccatttgcctcgaggagatgtgcatcgacggtggaaatcagaggatgcacgatcacatcaaccacatggttcagagatggatcgctggtcgtcgctgttcatcagcaaagagcgagaatggcacgggaagttcttcacaacctgatgttttggaaagcagcatgccgcgttttagagtgtcaccgcttcagaggcgatgaaattaaaggagatggtttacggttttggttgaaacttaattaaggtgttgagaagattagtaagatgtgaatttatttttagcttagactcgactatagttggccataaggcccgaggcccgaaggcccggcccacggcacgcctttttggcccggcccaagcacggcacggcccgacttgggtcgggcccatgccggcccggcccgaccgtcgggccgtgcctgggcctccccaccagcacgctgggctggcccggcacggtcgggccggcccggcacgatgggctggcaggccagacccggtacacaaagtatagggactaaaaatagacatataaatgtcaatgtctaaagaatagggaccttaaatagacttattttagctattaatataccacagcacaaagaagagggaggtaaaatagactttttttagctatacaatgtcacagcccaataggagggagaaaatttagacttattctgaggaaaagcacgatggcccatcgtgccttcgggccggcccggcacggcccgaggcgtgttgggccgtgcctgggctatgagtgcggcacgtgggctggcacggcacggcccggtgcgtcggtcgggccgtgccggcccgacaagcctcggcccaggcacggccgggcctgggccgtgccgtgccgggcggcccacatggccatctatagacttgacggattaaaaggacgaaaaataatataaaaagatatggataacgtagggaaccagattctccttttccaatccattgtaaaaatagggcacacttaggtcatgtttgcttcttaacctcactctgttgtttatcacgcggacgcttcccaaactactaaacggtatatttttataaaaaaaattctataaaaaagttgctgtaaaaatcatattaatcttattaagttttttaaactaatacttaattaaccatacgttaatctattgtcccattttgtatgcgaaggggaggggctttccaacccctccaaaaaaaaatacagccttacacctgttacagtggccaaagagttactgctacacaatgataggaccgacactactactaataaggccatccacaatgggtgccgtcgactcgtgccctcgcaaacggccgtttccctcccgtccccttttcagcgtgagtcgtctccccagctaggaacgcggcgccaagcagggggacacggctctttgcaaggagcaactgcttttcgcagagacacgaccctcgcccctgggaggagacccactgcaggctcccgtctcctcgccgctccccccaaatccccctcctaccctcgcctctctcccacagcgccgcctgctcgtcgatccgctccaccagacgccatcgcgacggcgaggagaagctcggcagccttgaagaggagggcgagccagttgtcggcgaggcgacccgtgaggcggcgctgggcgggggtgccgggggtgtcggagttgagggtggagttgtcagcgaggcgacccgtgaggcagcacggggtggcggagtccggggtcggcgacggcgacggcgacggctggagggagagaggggagcgggaggagggcgaccgggcgctgacctcgccggcaagccgccgccgtcgctgctcgaggccagatccggcaagccccactccgccgccactccgacggcgacgaccctcgacggcgacggcgacgaccccgcggcggagggaaggggatctggcaattgatgtcatcggccagcccgcgcgctcgtcgtcgtcggccaccgcgcacgtcgtcgccgtcggccacgccgcgcgcccgtcgccatcgtccacctcacgcggcgcttgccgttcgccaccgcgcctcattcgactgagagagagggggagagatcggaagagaaggagacagtgggcggaggagaagagaaaatgcgagaaagagaaaaggaagaggttgctgggctagtggtctgatgaggggtatgggtggaatttttgtactgggctaccttgagccaggacacccattgtgagatgtagtacccttatcgggttgtttcagattttgagaagcccatccagggataccctccattgcgagacaagttccccctacgagtgtcctcagttagtgaggacactctaggagtggctcacattgtggatgccctaagctgagcaatatgcattatgatcgccacttactaccatttgccgactaggcgactacactctctgtttctcttctcaatttccttctcttttcttccccatataacgcatgcaagtatttttttctgaaagaaaaaaaaatcaatctttctttttaaacttcgcgggcggtagaacgtccaccgatccacgacgccctgcaaagcgtgtgctccgctgcctcgtgatacggatagcccatgctactaaacaacattcgtcctctccttaagagtgttgcaatacatacgacttacacgactagagatatgcaaccatagattaaaaaaaaacatgttaatatgcaaaatactccctccgtttcataaaaaacgaatctaataccggatgtgacatattatggtactacgaatatgtccagattcatagtattatgatgtgtcacatccggtaggttggttttttatgggacggagggagtagccatttacaaccgttattcagaccctgtttagatgggactaaaacttttaagtccctatcacatcggatgtttggaaattaattataaatattaaacgtagactattaataaaacccatccataatcttggactaattcgcgagacgaatctattgagcctaattaatccatgattagcctgtgtgatgttacagtaaacattctctaattatggattaattaggcttaaaaaaattgtctcgcgaattaactttcatttatgtaattagttttgtaagtagttatatttaatactctaaattagtatctaaatacagggactaaagttaagtccctggatccaaacaccacgtgagtcgacagttgggtcgtatgtatagccatttcctctccttaatgggctgggcttcctgcttaatgggccggccttgttagtcgatgggtcttctccctcccccgtgactcgacgacggcgaagggaaacccaaccccatccatccctctccttgccgccgccgtcgacccgatctccatcgctggcgacggcgagcatcgcatcgcatcgcatcgcggcggtgcccaagcgaggcaatctccccgtccgtcttccctcccggcctcggatcccggaggaggtctctcctcctcgctaggagcggcggcgggtgccgtcgtcctgctgcttcccttccgcctccggtgagcgcgccctcgaactcgccttaaccttgtcttatcctccactcgatctggaatggaagctaggttcaatctggggagtataatatctgggggttggttcaattcaactgttaggtccacccctgcaggcggcgatggcgttcttccggggcctgaccgcggtttcgaggattcgatcccgcatggtgagtagtggtgatccatcatcgatcgtccatgtcaatttttttgtgcatttgtggtgtggcgctgaaattccgtttgctcgtgttgctgccaggcacaggaggccaccacgcttggtggtgtgagatggctgcagatgcagagtccatctgatcttgtaagacaataatagtttgtttgtttctttgtttgtttgttcgtgctataaatatttgcatggttgaaattgatagttaccctctctaccttctgtggctggctacgattgaaattaagttggaaatgtgctctgaaaaagatgtttgatttgtgttcctaaatattatgctttcaggatcttaagtcccagctgcaggaattgattcccgagcaacaggtatgttttgttactcgctagcacatctaataattcgacaaagttgaaatgtttctggcatccaattccttatctttactttttttgctttagcctataatgttgccatcttcttgcttcatgcaagttgctgttactgtgtgagggcatgcttacatccaacatccaaatgttgcggattacctctcttcttcttcttcttcttctctctctctctctctctctctctcttgtgtaaaagctgtgctggggcatagaagcaaatgttagatgaacactgtattgaacgcattgtttcagcaccttaagaaatcccccatcactagcttggttctctgggctattgaaaatgcactacaagattgacctatcaggttattgttttcttcacaagtttagttttgcatcaagcactaataacaacattcagaatctgtatcagagaaggacctacttgcagctagctcaccagttcacttttacctaaactctatatatgagctgatttcctgtcaaagatcaggatagaaaagcacaactcactttaccattctggtacaggatcgcttaaagaaacttaaatcagaacatgggaaggtccagcttggaaacataactgttgatatggtatgattctgctatcgattatttatggataaatctattgctattgctttttaagggtgtccttaattgattgggctaaagtcttgaattgtgtttctccaggtccttggcgggatgagaggaatgattggaatgctttgggaaacatcattgcttgacccggaggaggtatacttgtaactatgtatggttctatgataccataatataaaagcagaagtgcttattttgtctatatatatcttgtaatgtgcaatagatgaaaaattaaacaaatgaatcaccatattttcatgatctccaaacaagtttctgtactaacagttgagcatgatctgttcaattcacagtaacaacgatgtaattattattcatatttgtcaatgtgaatcaagttccacaatcaactttagcacattgatttaaaggaggtacacggacaaaatagtctagatttctcatttctgaagtcactatatagtaatgtgcttcattgaaagagtgtgatgcttttatgatttatcgtttagaggtggcggttttgcttcatattttgagttagagttgtaacttagttggaatttgtgaaatttaaacgtgtatcactccatgttttgctgttggatgtaaatctctctcttttctatccagggtattcgtttcaggggtctctcgattccagagtgccagaaagtgctgccaacagcaattaaaggtggagaacctttgccggagggtctcctttggcttcttttgactggaaaggtttggcttttgcctttcttatagaatccttgttgaaatagtttgatgatctgccaataaagttccttccagaaacagggcttgttgattcagtaggagcttctttgtttacctgttatacttgtaatctcgattttcctattcttatttttgtcagcatttagctattagtgtggactgatgcgtatttgtttgtttcaggtgccaaccaaagagcaagtcgatgctctatcaaaggaattggttacccgttcgagtgttccaggtctgctattgtctctgttggtttattacattattgcttagatgagtttcacatcattatcatattttctgtttcttaaaagttcaaatatagacagataaatacagagattatggaggttttgttcctatgaagttttattctgaaagtacacataaacacaccaagtttcttataaattagtttgaaaacaattgaagctacttcattctgaatttcttatagtaatctgttagctttaaggttaaccttttcaatttccttaagattattgttgttaacttaagaacttcttacgtgtagttaaaattttaaaggcaactgtagaaagtatttttgggccagttccatttattttctctattttgactcttcatgccctctgctgatagatagagtaacttgaatttttttaacctttcctttgatattgtcataatgatatagcttatttatgtattcatctttgataagttgatttgagttcattgtgcattcaatccttagtggtagggagtactgcatataaatttggacatctataaacaccattcctttgatattgtcataatgatatagcttatttatgtattcatttttcataagttgattttgagtttattgtgcatttaatctttagtggtagggagtactgcatataaatttggacttctataaactgatagtatgttcaccacttggctactgggctcccatttgattgacatatgatatggatgcaggccatgtgtataaggcaattgatgctctccctgtaactgctcatccaatgacacagtttaccacaggggtgatggcacttcaagtaaa

SEQ ID NO: 81927 - DNA, 744 bp, Oryza sativa
gctaaatgaggctggctcggtcggatgtgctactataataatgataaattaattagaataataatgttcatagattgcacatataaatggtataataatttgggcatgcagattttccctgaaaggatttgtctgaaacacaaacaatctataccaacaaatcggttttgatcaatttgaagtactaactccagccgttcactaaaattgttcatctatctaccattaccagctggatcttacatccttcatacttcattcatcaaatccaacagacgaaaatcatctgacgcttcagatccaacgaaccatctccctcagcttccaccgcgcaccgctccatcccacggaatcgccgcacgcgcaccactcccatcccacggaaaccgcatccgccatcatcgccgcacctcgctctcccccaaccccaaatcccgcatcaatcgccaatcgccaatccacatcgccaatcgcaaggacgtggtaacaacaggtcgcaacaaacccccgctctaccgccgtcgccgaagcctccacgcgaggacctgcgcttctgctggccgaaccattcccccaactcgcacgctatccagacgacggcgctgtcatggcccagcctcacaaattccgcgtcagtggcgccgccacatcccaaggttcgtccctttcttccgttacattactctgttttgcttcctgccgagatgaaatgctgcataaacaatctcccactgggctgcagga

SEQ ID NO: 81928 - DNA, 2740 bp, Oryza sativa
tcctgcaccccaaactttttttctcataccttaattttttttgttattatatttttcttctgtttcattatgtttttgcaagtaatttttttactcatgcatgtctatttatattaggtgtcgatactactgtacgcctgtacccaccattctcattctttaatttctcatacgatcctgatttttcggatcgacgatgagacatatgagaggagatcctaatatccctcaactatcgaggcggatcatgggggattgacgccctgttcttcctagccagtggaggagcgttggcggcgacgtctctgacggcatggactcgtcagtgcggtggtgccgatggtcttctccctcgggagtgagattttgtttttctgtttcttttttattttctttttgtattttttacagtaccaaggaggctaccacgatttacgctgatctggcgacagtgcggcggtggcagccatgcgggcgaggccatcccaagcggtggccggtgactgcgcgacctggtggggtggagcagtggtggcgtggtggtcgttggcagggacgccatcggatctgtggccaccgatggctgtcacgaccaggagcagccgcagcatcatcctttctcccatcgtcttccattgcagtggcaggccaggcctgatggcgtcgcatccatggccgcttcctcaccaccgccatcactatggaagatgacgacgggagggacagcagcaacaagaggaggcggtggcactgccgacacaagcaagtgtcatcgacgggctacgacggcaaaaaacatccaccatgcgccgctgccgcccgctgggccttctaccctccttccaagcaactcccttggtggtcgcagcgccactgggatgacctccgatccgttggtggaggctgcatacaagatgacggcgcttggatctacagctgcatgtgttcatcgtcggctgtcgagctccagccaggcctcttcctgtcagtgctgcctagacgctctgtgtggtgggggtttttctctgaggcgtcgatgcctcgttcatcttcaccggcggaaggagcagaaaggaggacgacgattaaacagtcgacgcccgctatttccgttttttctatctagacatcatcgagagcaacccatgtttatttcctcaccccgtgtccatgttcttcttttttttgttctttttttcccaccgtgtgtataagtgtatcaagatcatcactacatgcacgcgattcatcccggtggagttaaaaaattactaggccatgtctttttttatgtcaacaaaaaatcttactctgcccactggaaatgataaagtgaaaaatgcgtagtaatttttttatttgataagtttaggagagactccaacaagggaaaatatatggtgaaaacaacatatacagtgaaaacctgaaaactacctttgggtcgaaaaatagatgttcgtcaacatcatcacgagtaaaagttttactcgcatattcactcatgagtaaaaattttactgggagtaaaatctactcgcatattcactgatgagtaaaaattttactagaagtaaaattttttacttacgttgacatgtacacatctcggacgtccatttttagatccaacggtagtttacaagtttttactatgtatgtagtttgcactaaataattttccctaaccatgtcgaaataaccggtacaataattttttactcgacaaatctgttggatggaactctgataaagtggacagagaacatggagtaattttttcacttaacaaatctacgggagaacccaataaagtggaaagtacaggaaacgagagagatggatgcattcggaagcatgaaagcaattttttttactggccgatcaatgcatattgaacaggagctagtaactttttaactactcaatatgatatcgtgtggacgctgttcaaaaagttaaaaagttaaatctttttaacgggacctaatctaatcgggcagtgatttttttactcgtgaccggatacatgtggcatgagaagcaaagtgatttttttactcgctcttagtgggaaccagcaggtgtatcgaacgaaaaaaaatctgagattgaaaacaactgtgcgtatctaacagaaatttcggagagaaaaatcgataaatctgggtgagcaatttttttaccgacgttggaacgtgggggtgggagcggggacgccagggaggagcgatggaacagaaaaaccgggagtgggggaagtcgtgacttgcgctatgaagtttcgtagcgcacggtgtttatgtgtggcgctacgcagcgccaccgtgtgattggtgctacatggagtatgggctccatgattcaaattgagtatatacccaatttgaatgagtatgaaatttttttaaatgtttagatatgaacattaacttctttactaacaagtttgaacttatttttttttgttagattttggttctagatatataacatccaaacatataattagttaggtatgtaataatgaattgtgaaataaagttgagtttgagtgttttgttgttaggtatttggatgaatcaaattcatattcctaggtatatactcacaatttaaacatttttaaaaatttgagagaatttgtgtgttttatactttggagcccggacaccatggagtcccatatggaattatatatatgtatatatatataaatatatatatagggctgcaggaa

SEQ ID NO: 81929 - DNA, 3891 bp, Oryza sativa
cccaaggaaacaaaaacatttcccctcaattaattccgaggagccattccgattcacttagttctttcctaaagaagctagcaatctataatcattgaacacctgtggtgttccaatagtaaatggctagtgtgtgaagagtcaacatcaaatcttcaggtggatgtggactccaggggtagcctaccattctccagcttggtagtgacacattttttttctttccctttttgaaaagcaaacttgacacagttttcgttcatggcatgaaaaatggtcctgaactaatctaaaatgtattgtattgtaagttactagcaagaacaatcaatgtttcagggatcttacttcttgccgagcagctggcccatccgagcttcccaccggccacacttgtgcagtgtcacaccccggtactttgagctcccccttgcaaatcctgtgctttggcgccgaagtatgtgcacaaactcctccttggtccaattgcgcatctaacaacacagcacgaaccaatccatcataaaccatcacaggccggtgaatgaacctccccttagaacctaaagaatcacacatgacaattgaactatattccaaacaacctgcttcaagtcgtcctcatagtcattcagattaaagttgatatccgcgtcgaggcctctgaacttgatcgccgcgcgatcataggccctgcacaaggggttctacaatctcagcacacagggcaaaccagagcaacaattaagatacaattggtgaccatttatagtaacctcgctgcggcatgagctgtatcgaaaccacctgaaaacagaaaaaaaaaacaaggcaggagcaaacaaatcggaatcaagctaagtagagacccaaatttagcagtcatgcgagcgaatttagcttgggagactagaaataggagctcacccaggtacacctgcttcccgcagtccctgccaaaattggacgagacaaacgaagagattactactccaatcaagcagagtcaagcagaggaagtcagcgtgagggaaatcgagcaaggcgaagctaaccagatgtgcgactcccatcgcccggtcctcctgtagaaggtgacgcccctgtactgggagctccgagacctcgggccgcggcggctcttcttcccgccggcgggggacctctggctctgcgccaccccgagatccgccgcgcggcgcggccacggcccctccccagccgccgccggcatcggcatcgtcagcggtggcgtcgacgacccgtcccccgccagcgccaccaccgcagacggcgaagggaagagctggcgcgtcatgacaggcgaggagcacccgtcctcgtcggggctcccgccgagcaggtcgaaccggaagtaccccccgccgccaccgtcgggcggcggcggcggcgtggacgagctcgacgtcgccgccgacccacccggcgactccacattgagatccagcaccatactaaccaaccgctctcccccgcgcgcacccccaccagccgcggggcgacagagcgagctgggtcgcccctaccgttcccccgtcgcgctcccctagcggcggcaaccggcggcggctaccacgcgggagagaggagcggcggaggcggccatggcagtggaggtggaggagagggaaaaggggggggagggatggatgggacgtgagggagacgaagggtatcgcaagtaaaaccatttttgtgctgcgtctccgccggaaaggctacgcgtacacacacgcgcggcgggggaggggtgacgtggcgcggcggcactgggcgggagatggaggttttttttttctttttcttttttcagaacggtggagactcctactagtagtagtagtatggttttgtgtatgtagggtgtattaaggaggagtgtgctatgctttgtttgacttgactctggtcaaatagttgcaatgtgtttgccgactactggtgctagtccctctaatctagattataagacgtttttacttttatcaaagttaaactgcttcaggtttaaccaagtttgtaaaaaaataataacattttcaactcaagacaaatttattatgaatatatattcaattattgattgaatcaaactaatttagtattataaatattactatatgtatctataaatttagttaaacttgaaagagtttgattttgaccaaagtaaaaacgtcttgtaacctgaaatgaatagagtagtatataaaggtagtcgtatataggattgcatcacagtgataaaagttgtattttccactcgacattgctttaatttattttttagaattatatactaatgtttaaaacgtattatcaaaatgtattgaatgttagaataaaactaattttgtattgtagatgttgctaattttctctatataagagtatatcaaactttagtaagtagctagagaataattaaatcgacttataacacggttggattttggttacatggttggagtacttcttttgaagtcagataagcatatatagattaaggttgcatttacttgtaacaataattaacggctctaagctagcattgttggctcgttttattacggagtaaggatatctacacgtctacctaaactgatccatgatatagtgaaaacaacatttctagagcacacgatataaattattttcatcgtttgctctgccattaagttgtaaaatagaatgaagcaacaaaaattgatttatgtataaaatttgtatatatgtgctcttggcaattttaaaaaccaatgctgaaaactaaactataataaaaaaatgcctcaaaattaactctagaattaagtctaaaaattcaaattttgctttgactcataagctaacgggcaaacgatggagcaaaatacaacgtgatgtttttaaaggtatggatatgaaatatagaaacaaggtgcttctttaaaaggagataaatatattccaccattccataatattcctcacaaaaaaataatataacatacatgtttttatatgcacaagacaagcactttctaggttgtggttaaattaatgtacaatcttttaaaaaaaatgaagtctaactcagcttctggacgagagagacacccaagcatggcactgcatattctacataatacaataaacttgattcataatcaagtataaatatcaaaggagcaaacaataataataataatacttcactgttaagaaaaacttttatgacatgatgtatctgcagggaccacatgatgcgagggagaaattaaaaattttaaaaaaaaactttgtgagcaacattggttagtgcgtgcagcatttcctgtcggcaaaatatccaccggtgtagtttcccattggccgccccatccccatggctgtcttctcctgtgctgctactgtccaccaccagcgtgcagtaatgggcaggaagtaccaaacacttgttacacaaacaaggaaacggatctgtgaccccgggatattttgcgcccgttgcacgtaggaactgatttatatatgcatatatatgtactacatgcctcctaatttaagtgcagttgtgagttttcgtgttcaacatttgacagttcatcttatttaaaaaaaataaaaaaattagttatgcataaagtattattcatgttttatcatctaataaaaaatactaatcatacaaaattttcaaataagacggacgatcaaacgttgaacataaacgttgtaaaattgcgttatttttggacaaaggtagtcctactgtcttcatcatcattattttatatatatatatatatatatatatatatatatatatatatatatatatatataagtcttaaggtgctacgtattaaacggcactcacagtaacca

SEQ ID NO: 81930 - DNA, 2053 bp, Oryza sativa
gcgacggttctctctgtctggttgcacgctactctgagtattccaacaccgtgctagatttggcgagatgagtaatacggtgctgcacggaagcttgaagccgctccgaccggcggcgacggcatcaagcaagagtagcattgtatgcggccaaaaaaggtcgtctccatgtgcctctccactgccaaagccatacaggattcatgtgtatctgagtcccttgctgtcgttgccgccgttatgaagtcgttctcatatgtgacggtgaccagtgggcagcggcacagacaatgtttcagatggctgcctgcttgcctcttaccaccactcctttccttttttgtcatgctttctctttctccctttgtatgtgtgttgcagccttgcaggttctcactatcatgtatttctgaatttgtgcaggttcttagcaaataactcagatttccttgagcatatcatttcaggataaaaagcataaaggttggctttctgttttgtttcaacctctgttactgatgtactgcattctttagatttggtctttgtgaatctttagttaccgagattcatacgtttgtttgcttcattcttttaggtggtcgaccatctatagttgctttgcctctcacacgagccacgaatgaagctccacagcttagcgcaattgtataccagtagatgatgctggttttgtttgccatcagtcatcttgattaccttggtgcacatgatatcatctgtttatttgaaagaaaactaaatttcgattcggtgactactttacagatgaacactcgacatgaatgtgtttacgcacaaaaagtatttggcaatgcgccaatgtgttttcctgcagtttagattggctaacagtagatactgctggttttgtttgccattagacctcttgattaccttggtgcacacagatataatctgtttagatataatctgtttatttaaaaggaaactgaatcttgatttggtggttagtgaacagttgaacactcaacatgaatgtttatgcataaaaagtattatgtcctttgtagattcttatggttagccagaggctataattagaagacgatgtctttgggaaggtaggtagggctgttcagccccaaacaattgttgatcagctatactgatccctttttcatgttgcaaaaccttttatcctatgccttcttttgctcaattggcctaacaaccaagggataaatagaaattgccacaggatcttcttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgcagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcagataaataactggcaagatattggaatgcctaagaatggtacaaaactaagagcaagaactttcggtgccaatacaacactgccagcctttggtcatgaaaacattagagaatcaacttagacatcaccatgtacgttgttattagtaccatcaacatcctaattaactcatcttaattagctggcactacaatactatatttttctgagatatgttatctctgttctacagaatttaattattgttgtatagtgactgctttcatttgttgcagatcttacaggtgggcttaaagtatataataaacaaagtggaacaagtcatgaatgtcatgcctaattgttgttgttttaaccaggcaacaaactcaggaaatcgagatgcacacttcaaatgatctggtagaaatccccaccttaaatcctttatactctacaaaccacaactatctttaatcatt

SEQ ID NO: 81931 - DNA, 19616 bp, Oryza sativa
tacacatgtatgttgattgcagtgctaggagtgcagtaaatttttttacatgggtgtattttttgcaatgatggatgttaataattgagggatatgatgagttagatgatataaacaaggcacaatgaatgaattgaggccatcctgatgttgggttgcacatgtattatattttattggatttctccttttatgcactatgtacaatagttggtcagagaggaaaggctagagctagaagactttttcactttctttttttccctctaaatatgggctgttagacagagttttactaactgatagcaataacaacactcctctgaaaataagagagatgtgttcctctgtttgctagatgctactggccagcctaatggtaattgattaattccatgcagcaccatatttatcttgtatgtgacagtttataatatactgcattgcatttgtccacagtttgatcatgcagagttataaaaaaggtggcgtggtggtcttgcataggtgggtttcaaagtttctatatcagtttttcattgatgtggttcaagtgttaaatttccttgggttttctgctcagaattgtagattttctttactgaaaactgcaagcgacaagttctgttccattggtcaatataatctttttggtgatattctgcaagatgtttagtcaaatccatgactattatatccagactagaaccaaatttataccacaaaatatagtatttattgctgaggtcgtaaggtttatttgtaataaaatgtgttcttttttattttatgtatgtatgactacctgcctttgtttaatttatttctcgcatgcttgttttctatacatatctaactttcatgtaacctctgtttttttacctgtcttgttgccggcagcgcggcaacggcgcgcgccacccctagtaatctacacacgtgctcccgtccccgatttccttgtgaaaaaaatatttggcacaagctagtagcattggctaaaggccatgcgagcaatcaagcgggtagatccgtaccggacctggccgtctactcttatactatctccgtcttaaaataaaataaataaaataagtatagccatgctatccgtatttaacatttaaccgtttgtcttatttaaaaactttatgaaaaatttaaaaaatcagtcacacgtaaaatattattcctgttttatcatcaaataacaataaaaatagtaatcataaaagaatatcaaataaaataatagttaaatgttgaatatatacaatgtaaaattactcttattttagaacggagggagtaccaattattaaaaatagaggagtaatttatttgtgagagggggatgcacgccgagaaaaaaaatggagtgcataaaaaaggttgacgctatgattgattgtttgatttgatctagtagatgacaatacgtgggaaaatgaactaagcaagaaaaccatagttatattattaacggtttaaaagctaatgttaaaataaaccagataaaaaaatctttgtattatctgcattcctactatatttcgaaacacatgaaagttttaaaactattgttttattagtacatataaaaaattcaagacatgggaagagaaaagcatgaggtatattcttatgcttattttcaatggttttaaatagccggctaagacatttagcggttgatgatattctcaaacaactatagcaacaactacagtgggctaaaaagaatcatagcggataaattatatatgagagaaaatagctaaaaccattctcaaatagttgtagtcggagatttaaaaccatgtttattttcctccaaaattgctctagaattattaattccatataaaattttaagagaatggatatgaaattatcattcgtttcaaagggcttcgtacaattatattctataggatcaacatcctaaaacacgggaaagcatgtggtgaaaacttggaaactaccgttggattgaaaaatagacgtccgagattcatccacgtcatcacgagtaaaagttttactcacggatgatgacgtggacaaatttcggacgtctattattcgattcaacggtagtttctaagtgtccaccacatatgtagtttttaccatatattttcataaaaaagcccttacatatttttttaaatgagattctaaacgagaagaggctagatataagatgactcgcactcctttttaaatagctttaaaaaaatagccaaagggacaagaagttgcatgaggagccattgatgagatttgcgagacaaatgagcagtagggtcccgaagttggcgtccatagtccatatagaccggtcccacggaagacaccggcacatgccgacagcccacggttgcacaagcaaagcaggtgcttccagcaatttcaacccccgaaaccccgggataatcgcaaacccaacccaactcaacctccacagccactgcagcgtgggccctacacacccagtggaatcaccacttggcccacatgtcagagccaccacccatcatcacccatggcaatggccacccgtcgcctcgcctccgcgcccacgcatcgcctcgtctctctctcttctcgattccacttctacttctcttctcttccaaaatctcgcctcgcccagctcgctcgggcagcgcacaccacgcggcgtccctcccgctccccctcgccgctaaatagcgcgggagccgcgggctccggcgagcgcgagaggagagaggaggaggcggcggaggaggaggaggcggtggtgcgtcgcgagcgcggaagggaaggggagtagtagggggggagtggcgtcggcgtcggcggcggatggcggtggagtaccactgctgcggggcggccttcttcgagcacgtggtgatcatcgtggtgctggtgctcttcgcggggctcatgtcggggctcaccctggggctcatgtccctcagcctcgtcgacctcgaggtcctcgccaagtccggcaccgaccaggaccgcaagcacgcaggtgcgcgccctgccattcccctgtgcccgccccgcccgacagccgcctgggtgtattccgacgggcggcggcgttcgttggtgtgcgtgtcgtgcctgattagatgggtttctggtaggatttggctgcaacttttccgggcttggcatttcgtcgaacatcccgcgggcgtcggtcggaccgatgaatcgatgcatgaacgttgttttgtgatgaatttggcgaatagagcggttgttgggagggtgattggaacgtatgggtcgtataattttttttttgggcgatcaattcatgcaatctacacgcggccttcccgttgtgcctacttttggttgtgcctacttttggttgatcaatccatgcgattttagaggcggcccaacaaatttttgtgtactttttgttgcgaaggtttggcttgatcacctgggaagtggtcgtattactgctgttttaggggatagcgacatgctctgcactttcttatttcggaaagtaagacctagtggcatagaaaaagtaaattaaaaacaccctgtaaaatctaaagtaaaccctggtactcatctaatttttgttttcttttgttgctatgttaggcgatccattcttgagctatttatttggctgaatgaaatgcatatgcttcatcttttttttttaaatatgtaaaatggcatgcgtcaaatgcaaatcttctcatatttttgtgaaactgctcatcttaacttttctcttttctttccagctaagatattgcctgttgtgaaaaaccagcaccttctgctatgtactcttctgatctgcaatgctgcagccatggaggtatttggctttatttcaagctatttgtagaccggttagagctttaaggttctccagatgaatgaacatgtgatggcatgcttctgtatgttgctaggctctgcccatattccttgatagcttggtgactgcttggggtgcgattttgatctcagtgacattgatcctgctgttcggtgaggtgaattatatatactttactatgatgttcagctacaagcctatatttttgcaccccatgctaatattatgttctggtataaacagatattaccacaatccatctgttcacgctatgggctggctattggtgcctcagttgctccattagtccgtgtgctcgtttgggtttgcttccctgttgcatatccgataagcaaggtaattatactcgcagactctgcaatatcattacatcagtatactcgaatgcacatgtattaaatatattttactttcttttttagcattagtatcctcgaatgcacatgtattgaacatttttttacttttctttttcagctgctggaccatctgcttggtaaaggtcatacagctcttttccgtagagctgaactaaaaacactcgtgaccctgcatggaaatgaggtaaacagaaatattgtgtcttaaagaagaaattagattattgctattatcctatgtatgtgagactacacaaaattgtagatcatagacagctccactttttaagaatttcgggtgttaaattgttaatacctctgtatatcatccgatctacgtatgaattaccacagtcagggttctgattcgttgggttgtgtgatgtgcaaaagcttaggtttggagattctatgtgctattttgaagtaatttattatcaatatcacttccaaggaaataacaaaagaaatacaaaacataaaaaggaaagggagagtgaacttagtggaatctgatgcattccttcctcaccctaagtggattttgactcagagggcataggcatgctggaatattactgataaacatgctttgctttttttccccctaacctttcatgctttatacgaaggatatggttttacttcataggttgtgattaaatactcatgtctgcaaccccggttagaatatagatcttagatgtcctaatggagcaggtcatttggttggtattctgcttacaggccgtccacagtccacacttgaaactggacaggcttagagagctagttggtcttacctgtaccaatcattgacttagtcatgtaaaaaatgaattcatgtttattgatcttcctattagtttttgcatgagtgttgaggttacggaaatctgttttataactgttttacttcaatttcaacaggctggtaaaggtggggagttaacccacgatgaaactactataatagctggagctcttgagcttactgaaaagaaagctaaagatgctatgacacccctatgtcaaacatttgctattgatataaatgcaaagcttgacaggtattggttgcgttacaattacacatgatttaattggccctaccatattcttttctcaactgcataatcctgtcattcatgttctcgtgcagggatctaatgcaaaaagtccttgacaaaggtcatagcagggtgccggtttattatgagaagaagacaaacattattggattgatattggtaatgctatcttccttttcaaaacaatcatacgattcttgtaaattgtatcttgtgttttgtctggatgaaactttttttttagttttctcatatttggcatctacctgttaatgccttgtagcattagattgagcagaacttgattaacaaatttggcaaagaacccaaaatcactaattaccatccagatatgatttatgtgcttcttatttaatttaatacatcaaaccgtatggtttgtcaaactctggatcgagtataaccattgaagtgccaccagttggagtagattctttttagttgtagttttattatgaactggcatgcaacattttctcagcacaacgataattcttttattatgaactagcacgcaacattttctcagcagaatgataattctatagtgtacttagctgtgtaaatgagcataaattgtgaaggaaggaggcattcaaattagcatgttataagttgcagctggtaaatgtgcatttaaattttaaaacaggcaggacagtcaacaccctgcatctgtgccatcttcaaacaaaatgcatagcggtaatgtgtcttgtatgacagatctgtatgttttgagagcatccatgcattagataatgttgtgatgtggatcagtggatctgcgctcttcaacaaaaatggatagcattatgtgtcttgtatgaccgatctgtatgctttgaaagcatccatggttaatgttatggtgtggatcactggatcttgatttgagctgctagtacatttacattaggtttgcaatttatttatctggcaacttcagatatgtaattgtgttgtactcacctaaaattagcaattttcaggtgaagaatttattatccatcaaccctgatgatgaaattcctataaagagcgtaactatccgcaaaattcctcggtacggtattaaactgtaaattgttcttttatccaacagtgcaacatcttaatggtgaaattgttcaatacaactgaatattcctctcactatgaaattaatgcctgctaaccactggtttactgcaaacacaaagcaacagctgatataattaggtcatctgcaaatgcttaacttatccgtagttttgttgtaatttgtagtagaaatgaattctggcatctacaaaagggaactaatttatattgcaaaatggagaagttaacagatatggtgtataatagaaatccaggagatagttctgttttcttcctatcatattgcaggcttgatcgtggtagaatatggcaacagtatctctaataatagtagcaagttactaaatgacagtgttagtagctaatttctagatttacctgaagtgcctgtttaccttaatgaaatgcttgaaatggaataattgaacttgaacgtatggtagtttaagattcagcatttcagctaacgcaaccttcatcttgttgaatgtcagtgtttcagaagacatgcccctctatgacatcctaaatgaatttcagaagggccacagtcacatggcagtagtcataagacaaaccaatgcaaattatgcagctgaacctcctgccaacgacggtggaactcttggtgagctccaaggcaattttctttctcagtagcttgcatgtggcatatatataacagccttttatcttaccattttctccttgttttctttctttctttccatgtggaacaaagaggttgcgatctcaattgatgataagcatggtgagaaggttgtgaagaatcttcctccactaagaagatggaagagctgccccaactctcagaattctaatagagggaacaggaatagaaaatggtccaaagatcaatcagatgttcttcaaatacatgaagagccattgccgacactgaatgaagatgaagaagctgtcggtatcataactatggaggatgtcatagaagagctgctccaggttagtagtttgcaaatattctctttttattagaggtttgtagaactgtccgtttgttcaactctatttgtttatttaacacatgctcagtggcgattcaacacagtaagatgcggatgatcagccaatcatatactactcataaagtagttactttcatgtttatatgtccaaccattgaaccatgagatgtgctgaacttcaatgccctacataactgctctaaaattaagagtagttacaatgacattgtgcaatattatatcattaattcatatttttcatgatggcacaggaggagatatacgatgagacagacgtacatgttgaagaacaatgacacatgccgcagtcacttcccattttgaaccagaaaatcggtgccatacctttcttttggctgaggggaagtgccgggtgcaaatatgtgtttatattagtacgtaatactgtacttcagcgtagatagaaacgggggttgaattggttcatttgaacagctggtacgaatagtagtgcagtagtagagagggacaaagggttgtgtgattttgcttggtcctgggacagtaggattgcgtagttatgaaactgtactggttatcccgggattttgacgcggtaatagtgccgctctgagtcaatggtgctccttcggaaggcttcgctttcttgtgatgttggcctcactcgaagcgtctgcacagtaacaataaaaagcatgacagccttatatatttctcgaaatctgggaaaaatctcactcatatgatgggaacgagcgtcttcaatgagtgagccacatgcgagaaatcgctcccgagtcccggctccatgagcactactcgtccggtcagaacaacatcaaatcgcttatatacaaacctgccgagatttgcggctcctggagatttttgagctggcgtggctacctgcgcgagccgacgcgtcatcggcgctgggtctggtgggatagatttgcggctcctggagatttttgagctggcgtggctacctgcgcgagccgacgcctcatcggcgctgggtctggtgggatttaataccctttgttttcctctgaaaaggaggaagaatgccgtgataatagcgcgtagccggcaggagatacaaatccagaagagcattcttcgtcatccttcatcctggttgttgtctgccattgttgtggtctaagcgtatgatcaaatcattctaaatagctatcttgttttaaatcaagatgtgatatgtcattctaaatacttctatccattcacaagagtaatacctatttcatattttagttttttaaaacaagttgtttttatttgtagtctttttacaccaagattcaaatgaagaggtaaattaaatgtttgatcaaaacccaaggagctataataactctcattggttacttgcgtgtatgcactcttggatcagagtaatatgcaaaatatgcaaaatgagttaatttatttttatcttaatggtaaaagtaatatgtgtaacttttatggaatgaggaagtagttttcttgttttaaattaagacgtgatttgtaattcgcagtcattttacctaccatctctaataattggctccagtttctaattcgagttttcggcatggaactgtgaggcactagaggttttcatacaaatgatcaactatgatactcagtgtcaactcaaaatacgacgatcaaaattaagtgaacggaggcgggagtatctatcaagctaaccagtcgagatagagctgccgcaaaagcattaactccgaaattcgctggaccaatgtagtcccaacaattaaacaaaccgtggtccaattcgcattcgctggatcatatgtactccaaacaataaaccaatatggtccattcctgttggtcaggagggagcaatggcgcacgcggacttcccgttcccgtatcagaattttaatcgcgtcgtgctacctacggccgtgtgtggaacggcgccggcaaaaaaaaatttgtaccactacagttcatccagattttttgtcctcgtctacacgtacgtatctcctcgggatcctatacgtagtagtagtagcagcagtaaaaaattaaaggatttgattactgtcctataacatcaggatttttttgctctgttcccagaataacgtagagagcgtatatccgtgcgagtgaggatctatttgtctcttgtttgttactactactccctctgtcccttaatataagggattttgatttttatacttgtactgtttgaccatttgtcttatttaaaaaaatttagaattattatttattttatttatgacttactttattatctaaagtattttaagcacaatttttcgttttttatatttacacaatttttttaataagacgagtggtcataatgtgcaagtaaaatatcaaaatctcttatattaagtgacggagggagtactactcatgatgatcgaccgcacaacgcatgagacgatcgatcgcttgtgcgatttgtagcgcgcgcgtagccgcgtatacgtacctcgtgcggccaatctacggtctacaggatcgaattgagcgctcctatatatactggcaaattagctatagctctgagggccgagcaggacgcacaagaagtcagtaacttggcattcattgtcccacatggttttatagagttgaagttagccatttaggagtagtttttttttcatctagtctgttttttaaacattaatttttatccgttaataatatcaattaaaatttttatccatcaatatttttagttgttttatttgttttttcacggtttatcggttctgtgtgcggcagatgtcgaaacatgcttgcttttcgtgttgtccatgcggtaatattatgtactcctacatactagtagggatgaaaacggagcggataaggatggatagtgctcataccatatttgtttttatatttttttaccggatacgaaaacgaatactgaaaatcgaataggaataagaatcgaatatgatcggacacgaatatggaaatattttttctcggaacacgaaaaccaactcaacttctaatagaaataaatatcaacatatataattagctcattttatacaaaatgaagtataatttataaatatttttaaaatttaagtaatattaatagtattgactagtgttaagagataaactactattaaaatctataaaggtatattgaaggttatagagttagaaagaaatgggggtatgtctcgtggcttctgtggatatccgaatagcactgttcaccgaatatccgaattattatctatatccgacggaaaccccgataccatacccgggagaaaatatccgtattcgtatccgtatccgaactatccgagaaatttccgatccgaaaggtatccgtatccgtttttgtccggagcggatggaaactatccgctctgttttcatccctactacatagagctagagaatacaaagatataaacaacttacatttgagatacaaatgaaggaatgtagggcaatcctccatcaacaaaacaagtatactgataaaggtccattttactcccgtgaagtcttgaactattttattggagcaattaacaccttgaacaattgaaaacaattcattttactgtttgtcggagaaatagaaaccaaggtcccaatcgccagctactcgggtcgtatttgccactgctccctaacacgacctcccatgacctgtgcttggggaaaattcgccaccaggtgtagccctccatgggctatgcttgaggcacatttgtcgcctttccccaagcgcagccccatgtggactgtgctcagggcgcatccgcctctaggcccgacacctcgtgggttgtgctcgaggcacatccgcccctaggcccgggccctgggctgtgctcggggcacatctgtccccaggtgtagctccccgtgggttgtgctcaaggcaggtccgcccatgagtgcggctcccagtgggctgtgctcggggcacatccgtccccaagctttgccccccatgggctatgcttagggacatcttccacctttccctatgtgctcgaggtagatgcaatgcattgactcaatcaagtctcatattcaatgcgaggtgacatacaccaaccctaggacaccacggtacggctccacctagccttcgaggctggtgcgctgacccaacaaccaccaaggtatccacatcacctaccctaagccacgcgtcgaaggaaggagtaagaccagtcccaacccaagacactagatatggtttctataaaccttcacatcatcaagaaactactctttcaatgcaaacaccaatgttccatacttaaatttaatgctacttatctcacatgatgtcttggatgttgtgtagaaccatgtctcatgcaagacctggttttcttctctttcctcatttaatcacttgccacatcatcttacatcctagatgacagcttatttatgctatggacaccgtcctagtcattgggttgggactggcctaatggggtggagagaagccgctctatgccccaccaacatgactgaaatgcaagtttagggccaatagtgcccggcccccaactatcatgtgacaaggccaagcataccaccacttgtgggttgggtcccacttgtgcacacatgtatgggcactgtggtatccccatgacatataaaaagatgaccaataccactgagaaagggggaatgttcaattgggttagacttagttcaactcaagctgcaacttagagagcaagagctcatcccctagcagacacaaataaccctcaagaaattctctgtaaacatcatcatcatcatcatctagctaagaacacagaagtagtgtgttacacttccgatcatcccaaacctgtctaaaccattgtttttttagcccttgatgatccatgagatgccaatcacctcgtttccacacacccgctccctggccgaatcccaaaagagtgccacttctccatgctagaggagtttgagctccgacaccactcattagcatttcttttctttgtttctcctcatacgagtcgtattttgaactaaaatttttagagccatagatgacacaattatcaaagttgcaaaatattttcaaaaatttcattactattttaaacctcaatatttaactagttttagtgtttcctacctatttaaaagtagataaaaaaatctttaaaatattatgggtaagttataatgcatctatcaattcaaccaaaatttagcgtaaaatatgacatatagagagaaacaataaacatgcatatcattaggaggaaggtgaaccattttcaatgtttcgggatgtagaacgagtcaaaaaaatgtttagggtgttaactgctatagcgaaattgtttgagagagtaaattagatttttcttgcaatatactccctaaggtagtacttaaaatacctgtcaataaataacatatttacaataactgatgtttgtccaaaaagtgcactattgatcgatttcctctcatatgtatttattatctgccagtaccctatggagttatagtacagccgtacaggtatcattcccatcattttaaaataattacgagggagaattttggttattagtttacttccatatcatcattgactcgatgatcctactggtacaaagtcaaaatatgtttaggactgctggcgccaggcggttctacattaatactgcttcagataaaaaaatatcgttcaaatttaatcctcaaatacaacgacttctctacatctatattttcttatcttagctgatcataattacctcttgttaaatccctcttctgactttctcatttttcattttaatcatcatatttatagaaggtatcattcgagaccaagacaagaagcaccatatcttctaaaattaaacctcatcaattaatatgttgtattacgtgcaactgcatgcatgtgaggcatgctacgatatcatttactttggcataaataaatgaacagatatgtaacgataccatttgcttatagatgaataaacaatagatatcgataattaagatgataatcatttcggaaagacctaaaaagttttacgaaatgatcagattggaatagaactagtttaatttcatattacttcttaatcataaaaaggaaattctaaaagtacttttatatttgggacagatgaagtgagctcaagtacacgtgtggcatcatttatacccgcatagcacaaaatcctcggcgaaccccatgctaaggaacaggcttacaggccaacgtgacatgcatttacactcggtaatagtatgccattcggacatatagtaagtagtaggtcatatcggccacgcttggcatgccacttacggccccgcatttaccttttggcagcccggtaccagtagtccagtagaccagtacacataagatggcaatggaccttggaccgtcgaccatacatcgtattttgaggttttagataataataataatagattaaacctttcaataagcaataagtaatgtctttcttttaagaaaggaaatacagtaatcttttctgaggagccattttagttcgttatcagatagtgtgaacgatcctgaaaaatccatccaaggagatgagatggaaaacataaaaggtctttcagggatgaagggagtgaaattccaatttttcaattgctgacacttgtctcatgtacttaacgctatttttcctccaaagtagcatgcaccttaattaggtctcgttaatggcaccacgacaatcctatcttcctagttggtacccactaaaaagcatttactcctatacaataagatatgcaagaagccatatcatcaacaattttaagccatcagatcatattaatataaaaataacaaccgttagattaagaagctacttattcatccaattcaatcgattatttattagttatccattcacctctttttgcttcatctcatagttatacatagcactgatacatattttgtgcataacaccatgttttccgaatacaatcaaattattgtttaatatgtgattattgtttaatatgtgtattgtgttttattatgcatgataagatagcatacgattattagatattattacccgaatccatttttagataaaacttgagtgaagtagagagatgcaaactgtctaaatacaacaatacccatattgccatgaaaatcatattcatatattataacaatacataatgacacttggaaaaacaaagcatgaattgcattgtgataacataagacatatataaatctacattatcatatattttctatatacatagagttgcatctaaccatttaaaagtatgattttgtttgacgataaaactacaaaaccggtgaaaaatacgcggccaactagtaccaatgaggatcatcaccacctctcaccagtggcatagctaattgtgatctagagcaatgataatccttctatatgtaataagtcaaaacaaaagatgatccatataaaatgtttataatattaggaagtacatctacaatagttctaaactcgaccgaattcttgggcgttctatgggactatacagcgccactagctagcttcatcattggacctccctatgctcctcgccccattacatttcgtgtttattttgtttttttaactccgatgggaaatccatgtgttctcaagctgattaattacctcctcacaacaatttcttttttttcctacaatatcatttctgccttagcctcattgcttttgctagtcagcacctacaactttgattattgttatcttatataaaacctcgcaaactcgtatctcaaaactttaagcagtgtttggttcgaggacaagacataatagattgaagccatttttgtttttaagggataaaatggaatggtccatttttttaaggatgggtgggtatgacctgtatgttaatgagagtgaggcggtgagatggattggtccgtcaaattttattttaggattaacctgtgctgagtcttgagggaatattctctctagtcatcgtctcgtttctaccaaactcaaccaaacaactttaagaatataacagcccctttacatcattcatcttgaacaaaacagtcaaacagtaaggaggtagacgatctctcactcatatgtcagcttagaaaatgaaccagaagtctttggacacaaggcttgcacgaatgactgatggttaattattactactccctccgtttcacaatgtaaatcattctagcatttcccacgttcatattgatgttaatgaatttagacatatatatctatctagattcattaacatctatatgaatatgaaaaatgttagaatgacttacattgtgaaacggaggaagtatatgactttgaggctgcagccagctgtgctgaataaggtacggtctaacgcccataaattgtactccctccatttctttttttttaacgttggttaatttaaaattgaacaaacaaacgtcaaatatttggagaagaaggtaatatatattcatgagaaatttcactaaccatgcgtatatcgacacaaatcatgaaaaccgaaaaatatggcctaagcgtccacctcctgcgtgggtaattgctatcggtaaatgcggtgatcaggctgagctcttttgttgaagttcccaactcacttatctcattttttatatatttttaaactactaaacggtaagtttttttaaataaataaatatatatatatatatataagaaaattgctttaagaaatcatattaatctatttaaaaaaactatgcgctaattagtcgttccgttttgattgcgagagtaattaattcccaataccaagtaaagaacacagcctgagaggtacttcctctgtagaaaaaaaacaaatttagcatggatgtgatatatcctactccctccgttacataatactcataagatattttgagttcggtctgtcaagattaattgtactaggatatgtcacatcaaccaaaaaccctttattatgggacggagggagttgttcaataaatctcgacataggctcctaggatatatcacatctatgcatgtctaggtttttttttttttgggggacagggggagtgctgtttactgccaaagagccaatgagcggaaggctcttttgtacgcatgatgggttgccaacccgcaacagacacaatcgcaatgacacagtcgcgattggaacttggttgtggagtactagtacgtacaacgctgtacacacatgtggtggcacgtacgccgcgtacgtacccctgcgccattttaccagtaccaccaccatgcatatactcctctctactcgcacatgaatcatcaaatcacattgatggcccctatatatggccctgtctgtacaacaacatatatactgttctagtacctaggagtagtatctagcgtagtactccactacgtaaatatatatacgcatgtacggttgcacatgcacgcatacgtacacggtacacggagaccaatgggaaaggagccatgtcgagcgtgtatattagctgctgcagtagtgtacatgtccggggcctgccggacatgccggggcatgcaggagctagctacggatggctagcgcgtaatctcccagacatatgccgtgcgacgccactacatgcacgagacgacgagaacgatagagagagcgtctcgctcccccatcaaatctctcatgtcccgcgacgcggcacacacgggccagagacgtcgtcgtacggggcccgtctcagtaaaagcacgtacgccgatgctacgctacggtgtggatcccccccccccccaaaccggttcaccgccccgccccccacgtagcaaagcatatcgcgtcgcgcgcgcgggaggggatgagatcaaagggtcgcgaaaatttgatgccaaaatatgccctgtctaccgaattgttgatattttgaatagtagtttggctattgtttagtttgctaacaaaatatgtcaataagatacgtaagttgctaaaacatttggcactactaaaatttgcttatcttttagcattgtcaatattctggtatggcaataaaccaaataagcttatcgtttttgtaaagtaggattgtttatagttctacttatatatactccaccgattttgaaataagtttattttcactcatcttatacatagcattaaaaagctaaaaagactaattaaatacccacatttaattaaatctaaatgcaattatttcctagctactttattaatttccaatgccatctactttcatagactttaacacaataatttctagaaaatggacttattttttagataaataggagagacggaaattaaacttattctgagacgatacagtatgaatttgattttctttctgtagcatcatattgatctcattactaaacagttaaatggattatacggaacgattcctctaaacagagtattaaaaagaattccatgcgcgcgtgggcggaaaaaaacattcggcgtacggcagctttgccgctttcgcttgatgctttccctggattaactctgctgctgacctgctgtaggagtatgcgtgagtcgactgagagagagagagttaaatgcacgggtggattatgtatgggcccggtcggtcgtccggtgggggcaaacgccacggatagagctcactgttgacggggcccggttgagtatatgacatgggactgttcgtgatgctttaattatacagtaacttgggagaaattcatggcaagcgtagaacacgtatatatacagtgttgtagcgttgaaaaaaaacgtactgaccgtgcgaacaaaattatgaggagagggccagctgttcaacaatcacctgatatatatagttttttcgattaagatgtatatttttttctcgattaagaaggtttttcaaaccactaaataacgtgttttgtatgatttttttatgtgaagttattttaaaatattgaataaatctatttttaagtttaaaataattaaataattaaacgctaatgattttctcgttttgcatgcgcacttaatcttcattttaaactcagttttgaacaggcctagtcatatatttttgatgttttcgatagataagatcacttcaagaatcatacaaggatattagcctcaatctctcatatctatcaatagcgaataatgtgcctcgttggtgtcggtgaggcctactagccgtcgcctccctccctcactcctcctactcagccgtccttattttattagctcttcttgttcaaatctgactagattcttcgcgttgcatctctatcaatgtctccgttgcaccgaacaacaacacccatcatcctaaccaccaccaacgctatcccgtattcatcctctcttgtcctgcggccgagaggcaccactgctacctcatcaccctgtcacaactaccacctaccattgggctttcacctccgatcctacggcatccctatgaagcctccacctctacccgacactcctccgcttctcgccccaaccgcgataattaacctaatccatgcggatttggccagtaacacggcaccgtcgatataggtgatacttttattattaaattttctgctgacagttttcctccatcccatttacctactggaggttaaagacgattctctgattgtcaaattattagcatccacaggctaggagtggagaaatattagtcacctgattggtagctaaaatggaacgaaatgggtggacattcgcatcacttcaagtgatgcgaggaattgaaagtatgagattcaccacaatggccaatttctttcttcttcaaataattttcaaaggagatgtgaaggttctaatcgtattggaagaaggcctcatgcaagatgtaaaaacacaagagaaaatgaatgctgagccattgtagcaggctgaaatttttacattttggtcctttttgaaaacttattttgcaaatagacccctgaaaaaacttaaaccggaaatggtcctttttggg

SEQ ID NO: 81932 - DNA, 522 bp, Oryza sativa
tcttaaagttctttaggtttgatcaaatttatagaaaaagttagcaacatctaccacacgaaattcccccaattagtttcacttaatttaaccttaaattttttttggttccaaatttggtttaaaaaatattactatatttttctataatttggcctgaagtttgacttataaaaaagtcaaacgtgataatatgaacagagggagtataactgttagggctaggcaagacctaatagtattttatcttaaagaaagataatttgactttccaacaaactttattccggctatttgcttggtaattaaagttgctactattgcatcgaaatgcaggtttgccctacactgcctttgatctctcctgcacgaggaacatccataattgacggcgtgctacttgagtacagcttgaaagccaagcgcggtggcggcggcgaccgcgacggcaacgacgtggagctcatcgacggctgcatcgagttcacttcgccgtctaccatgccggtcggcgagaaactg

SEQ ID NO: 81933 - DNA, 9094 bp, Oryza sativa
ataacaacttggtaggtgggtgcgatatagtataagaacatgagaattgaacatccgagtacaacaacttgacaagtaggcgcgttctagtacaagaacttgataatttagtattttgatgcatcaacttagctaacatatgctaggtgatttttttttcacgatatcaatatgcaattatatagtaatcctacgtatatttataatattggatttaatctttaagaattatacttcacatacaatttacattcaattaacttttaagatttttttttgttttcttcaccttcataataatatttttttacatccagtttaattgatttttatttattagttattaggataaaaataaaaatatgcttatacaaatacacgccaatatattgtcaaaataagtacttaaaaattgaatctataaaaaaatgctccaaataattaagttgccgcataacttcttaatttattgaatcaaaatcatatctaccttgtaagttattacatttatatgatcacttataaagtttttatattaaattatacctatctgccaagttgttgcactagaactttcatttctcaagttctttcaccaaattgcacccatctaccaagttgatgcaccgtcggtgcaatttactgtaaatcatgcttaaagtactttgtgtgataaaacaactcacaaaaaaaacaattgcattaaaaaaatcaacgatgtcatttattaaaaaaccagaggtagtatcaaatatacacttggagactgtcacaatgccattaacaacatgtaaaagagaataatggaaggactaaggaggatattgtaagaccaaattgcaatttgactatctgaatcattatctttttttaaaaaaaagtccactatgccagttgccaccccggaggcaccgagggataagggcttgcatattacacaatcgctggatgactggctccgcaatttcagaaaagctatattgcgagttggtcttttaattacaaccaagttcagaaaactgcttgtgcttgaaaaaacttttctgtaatgacaatgcacagatagctttattcacacgacgcatggaattgaagcttcctctgcaatcaatttcaggtttcaacagaagctcagctgagccaacatgaaagctgggaaatttgaattcagtttcccccagaggctgataatttgggttcaaatttcccctgattaagctccaatcctcctcctttttttttcttttttgtgggtagctccaaatttcttgtcagcacctcagggccaagattttcggtagcagctacaactccaaaatggcttcaaaaccgtcgaaacagtagatataactgctcaaatttatgtgctatgtcagctcatatggccgaccatgatactacatctgtttgatcttcgaatacaccaacaaattacaaccagcagtcgtagcaagtgtttttcttgattgttcagtcatgtttacacactgtttgtacacacttgtctttctgcatgatatgctattgtaactccgactcaatcagtacacaacaagcggaaattttggatgggatctagaaggaaagtaatccgatactggacactaggactcacgactccaccaatacacgaatggtggcttccccccataaatacatggcaggcatgtgcatctcaattcaaacaacaggttgataccacattggtagatttaccatgctgctaaggattatgcgatggttaatttgtttaggcaaatcaatggggaatagcattcaaaattggtggatcagggtaaagaccacccagccaccccttggcaacatatcggtagacagcctccgtgtagtgaatcccgtcccaggacactgatgctgttggattcttgcaagcgaccactccaggcatggcgcaagtagcgcttgcgttccagttatacacgccaccagtgccacagcaagccttgagaactccatcggcaccgaatcctgcagatgtaaatgttcagagataagccactgccttagtaggtcctgtttggggagtttaagattctgagaatttactgattggtagccaacttctgagaatttagagaaactgggtttttcagcttctgggttctagttaatttattttttggattctacaactacagattctcagaatctgggtttctcagaatctgggtgacaatctgaactgtttgggggagctagagattctaagagaagctgcagcagctagaagctcccccaaacagaccctaagactgaccataatcctttcatagttttgattataaaacgtttgtataaattggttgacacttttttattagaaaatgggataaacccagcctctgcatccaatcagatatacacagccaaaatcctggttgatgtatgtaacttaacaaagctagaacacagtatgtaccaaatcggcgaggttcttgggtgactcgaatgatgggttggtagaagtcggcgaagatgatcttggcatgagggtacttgcgcctgagcctgacgagagctgcgcgaagcagcgtgttgtgcctcttggccacgctgttgatggcacgcaggcatccgaggccatcgtagtccgtcctgttggggctcactcgttgcgtgaagtgctggtgcacaccctgttggtgggttccccggcacgaccacataaaccgcgccttggttgatgagactctgtgatgtgcaaattaagctgcagatttagaatgtggcttgacaaatattgctcatttttcttatattcagaagcaactttgccatggtgtgacaaagagatcaaacttttttcttgaaaacataacaaactcaaaccaaagtaaaacttcacggtattacactggagatttgctccaatccagcaaaaaatacctcgaggtaccggtaccctacagtaccaaatcgtttctgatcgttggatctaacaatgcccatcctgctcagctagattcaatgatctcaaacgatttagtaccgtgaggtaccagtacttcgaggtactttttgctggatcggtgcaaatctcattacactgagtgatgggtgtacctccactcccatggtgatttttttcacgactcgaggcatgtatgattcgacctcgtgtttggccttcccagccatccacatgaagttgtagtcgttcactccaaactctccaacgataaatagggacttactgaagcagttcttgaaatctgcagtttgttgaaatcaatttaagcccactgcgaagtagatacaaatactcattggttatatcttctctgaaggccagaatgaattcgattatctaaaaataaagatcaatgctgattattggcgcctatgattcagactactcgccatttgcatcttctttggttgtgttgcaaatcgatggcttgagctcctcgaaccagccaagctgcacatcaagtgaactgttcaaaagcttaaatgccacaatgttgttcctctggaagtagtcgatgccagtcgccggcgcgccaccgacggcgaagtttacgccatgggagacacttgagctattcgctagggaggctggaaggaaagggagaccaaattcctcggctagaaagcacaacaaagaaaagttagtactgctgagttgtaccatgtaatatgtaagtaaattgctctcatcgtcctcgtcaacttaatactagtacctccgtcccaaaatataacaatttttggctatgaatctggacacatagttgtccagattcataattaacaatgcttatattttgagacagagggaataccttcgttttgtaatatatggtgtcgttgactttttgataaatgtttaaccattcgtattattcaaaatttttgtgtacatataagaaaatttaagtcatgcttaaagaatatttgacgataaatcaagtcataataaaataaatgatagttatatttttttaataagatgactgatcaaacgtatcaaacaaaataaaaaacatcatatattaaaaaacggagggaataatattttggacgaactggttagtacgtgcaactcaatggtgcacataattaacgagcatgcaagttcacaatagaattctgaattctcctggtataatttgctagaagtatttctaggagttaacttgaaagaattgtttgtgtagcaccctgaatctttgaacgttactcaagaaagcgttttaagccccaaaggacatacatcttcgtgtgcatgtggcccaaatagctattaaaaaatatgaaaaaaaatatacagattatgatgtcacatattgattcacaaacatgctactccaaattaattagatactgggagtagaaaaaataacaattcaaaccacaaaaggtgtgtgtgatcgtgttcacagttattttctttcagtgtacatatattgaatttaatcttgcgtgtttgttcatagatgtataatacaacaaccatgcttcaattcttttttccatatattttacataattgagtgggccacatgcacgaaacaagggcataaatactcaacttaccaatgaaatcgataatgactcttccatcacttacgcggccagtgggatgaccaaagaatgacatgccgtaaggaggcttgtcattccatacgggcgctaccggagttgccatgatgacgaaattaccggtgtcgatgtacgagtctccaagagaaaacatcgagatgaaaaaatgcgaggtagagctcatatgggagagacagaagatgaaggcaatggagaatacaagcttgagctccatgatgctacttgctagaaaaaatttgaggagagaacaccagagacacatgagaagttgaggggtttgcaagccacttataatcacatggagatgatcatatgctttataaaagtaacactgtttaagacttgagaagtagtaatacacgttgtttaagtgatcaagtcttcaggtacgatttgacaaccgaggtgatccttcttattggtcaatccagaatattgcaaccaagctggaaaatatcaaagaccataaaggttataattgcaggacgaaagaattgtgatgttacaaaaatgcaagttgagtcaatatttgggtaaagatccacttgaccaacccagagacgctgtgagatgatcacggcttcaccgttacagatgtgttggctccgcttgttattgacgccgtttcagaaaagctgcgttggtctgaattacagacaatcttcagaaaactgcttgattgattaatggtagcttgaaagaaattttctttggtaatgacatagtaccgagcgtcctggaatctcaagccatcaattatgggatcctagcacacgccgccagctgtgccaatccccacgggcctttttgttttttgttcacattttttttcccgatcttttttcttttcttttttttttgctgtttctttccattttttttcaatctttcgcactcctctttacaaaatataaaattgaaaattttttattttcacttgaaagttttcaaatattgacttgaaagttttcaaattttgtgttgaaagttttcaaattttgagttgaaagttttttaatttgacttgaaagttttcaaatataggttgaaagttttaaatttgaattgaaagtttttcaaatttgagatgaaaacttgaaagttttcaaaatttgacttcaaaaaatttaaatttcgagttgaaagtttttaattttgtgttgaaagttttcaaattttgagttgaaagttttaaaattttgagttgaaagtttttaaatttgagttgaaagttatcaagtttgacttgaaagttttcaaatctaggttgaaaatttaaaatttgagttgaaggttttcaaatttgagattaaaagttgaaagttttcaaattttgacttcaaaaaatttaaattttgagttaaaagttttcaaatctgagctgagttggaagtcttaaactatatttgaacaaaatatggttgaacgcggcgaaaagaaaaaatcggtactaattactcccagagctaatcttgttttctaatatggcgtaattaaaaagcgaaagatcaaattaatcacatcgataatgacgttttctaatagggatatacgccataattaccagaagaaaaatcaaaactaatcatggtactagtcacgtttttttctcagactccggttttgaccactgcgctaacgacacgtgtaccaggtggacgtatgcgcgagttcgacatctggcgcgtatgcgctaattagttctttcctcaattattgaaaaccacatcttgttcacatgaaagagttgaaaattttgaaaagactggtagactcaggtcctcaatactgtctcactgtagtctactagtactccctctgtccaaaaaaaaaaacaaaccctggtttccgtgctcaacgtttgaccgtctgtcttatttgaaaaaaatattaaaaaaatttaaaaagacaagtcacgcataaaatattaatcatgttttatcatctaacaacaataaaaatatgaattataaaaaaatttcatataagacggacagtcaaaattggacacggaaactcaaggtttgcctttttttgggacggagggagtagtagtctactgcatgacttggattgtcaggtgagccaacccaaagatgagagttttaggaagctgggcaatttgaattgaggcttccccagacctccaaaaatcttatcctcagggctatgatttacgaagcagctagatatcatttatattactacctccgtcccaaaataagtgcagccgtaggaaccgtgtccgacgtttgaccgttcgtcttatttaaaaaatttatgaaatttttttaaaaaaatagtcacacataaagtactatttatgttttatcatctaataacaataaaaatataaatcataaaaaaattttaaataagacgaatggtcaaaagttgaacatgaacagtgcaaaactgtacttattttgagacggagggagtactatgaaagagagtagtggtgccaccacaacttttgcactattttttaaaaaaattagtccgtgataaaaaaaaatcgcagaacatatagctgctcaaatttccatgctgactggcatgatcaactttttttttggattgctattgtacgtaattccctcatcaatcaactaatactcattggtactataagggcgctggcaaggaggtacccctagcatttcctttcccttttcttttcaaagaggggtcagtactgtcgaagttattacaaaggtaacttatacgatgatatactttactgtttgcttgggccgaatttgggtcataaccacattcgtcaaaatatggttttttttttatagaaactttggcgtcaacccatcggttttctggtttttctaattttttctttgacagcatctgaaagatttaccctttgatttaccagaagtagaggcggtgtgaatttgttttaggtgtactccgatccaggtccagcccaaaacggcccacggagctctggtctccctctgaggcacggcttcgttcatcccaggcgtcactacgccaccaacctgcctgccgctgtcttgcccgcagccggagacaacaacatccgccatagaagcggttgcctccatgaagcgtccacggacagcctgccggagctagctcattttaaaacgaaatattaataaaaaaaattcaaacaataatgtccaactacagattgattgtacacactgatataggccgtgtttagttcctcctccaaattttttttaacgtatacggataatattttaagtattaaacgtagactaataacaaaacaaattacagattccacctgtaaaccgcgagacgaatttattaaggctaattaatccgccattaacaaatatttactgtagcaccacattgtcaaatcatggcgtattaggctcaaaagattcgtctcgcaatttacatgcaaactgtgcaactggttttttttcgtccacattaatactctatgcatgtgtccaaacatttgatgtgacggaatttttgaaagttcgaagggaactaatcacagccatagattacatttaccatgctgctaggattaatcatgtcatggtttttgctctcaacaaatcagtgatggtggtggatagcagtcaaaattgggggatcagcataaggaccatagagccaccccttggcaacgaaccggttgatggcctccgtgtagtgaatcccatcccaggatatcgaggccgatggatccttgcaagcgaccactccaggtaaggcgcacgcggagctgacgttgaagttgtaggtgccaccggtgccgcagcaagccttgagaaggccgtcgcttgcgaaccctgaataattaatattgcaaatgttgagacaaattaaactccggtcactatctcagtgatgcacaccgtagaattgtcatcgtgtttgagaacgaaagcacaaacaattcctataatctttgccaatttcgatgggtaaactatttgtactccctccatcccataatataagggattttgagtttttgtttgtactgtttgatcactcgtcttattaaaaatattggaattattatttatttttttgacttactttattatccaaagtactttaagcacaacttttcgttttttatatttgcacaaatttttttgaataaaacgagtggtcaaacagtgcaagccaaaaactcaaaatcctttatattatgggacggagggagtatatcttatgcatgattgcgtacaaaaaatatatatactacatatgtttcgtattataagtcattttgactttttcttaactaaccttttttgagttgagcaatatttttaacataagacacatattattaaaacatatttaatgttacgtttaataaaactcaatttgtattatagatattaaatttttctataaacttgatcatacttgaagagatttgagtaaaaaaaatcaaaacgacctataatataaaacagaggtaatatattgtatgaactagttggtgcatattactttcaag

SEQ ID NO: 81934 - DNA, 508 bp, Oryza sativa
gttactaccgacctcccaatgacgggtgtaccggttttggtgcccccaaccgtcattctcaagctataataggacctaccctccttcattttaacacacaccaagaaggattcaagaagaaaaagttctcttagtttactcactttgctctagtgctagtaggattagaattagaatagtcttccttagttcttcgagtctccggagaattcgggtatggcccttgtaagactttatccagtaataaaatattcttctttatatagttttggtccttgttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaa

SEQ ID NO: 81935 - DNA, 38662 bp, Oryza sativa
atgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaaacaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccatcattagtcccggttggtattaccaaccgggactaaagttaagatctttagtctcggtgcggcacgtacggcgcggcggcgcgcacgcacgtggtcgggggctggaggcggtggcgaggacggcggcgtggccgagacgcgcacgggagtgaggacggtggcacgcacgcggacgggggccggaggtggcggcgaggacggcggtgtggccgagacacgcacggcggcacgcatggcgcggcggcacacacgcatgcggacaggcccggaggcagcggcgcagcgctctgaggatctcctccctgtactccaaagctcgtgccgtcgtggtcaccggtggcttcaggttgggcatcatggcctcccaatatgcatcgcgctgcccaacaacatgaaaaaacgatcatgcaagcagtcaggccacctcactgagacattacatcgaacactaggcgtgcgtcaccagtaaaacgagccagcgatgccgagccgagcagaccaatctgcggggagcacggctgagaggacatcgccttcccagaggtggagttgtcagtcgtcgggccatgtgatggtgagctcctgcggcgacagcaccgatccaatggaggggaaggtgaaaggaaggaagggaaagcacagcccggagatcgaggtagccagggaggtcgacggagcgcgcggggcggagggaggtcgatggagcgcgcggggcaaaccaccgtcctcgctgccgcctccggcccccggccgcgtgcgtgcgcgccgccgcgccgtgcgtgctgccgtcctcgccgctatgcgcgtgagagagaggaagagtgagagagaagacagagagtgagagagagaagagagtgggtcctacatttttttaatcaataaaatgctgactgaactgccacgcgtatgccacgtaaaccaaaaccaccgcggattgagtcaagggggtaattcgtccggtttacatagttgggagtcaggaatgtccggatttgtggtttagggggtaattcggtcgaccgcgatagttcgggtggggggtaatccgtactttttccttataaaaatgatagatttatatgtttaaataatgtaaaaacgatgtgaacataatgatttgacattgcttgcatactgagtttaaaagatacaacaaaattataaaatgatatgtcatatttacatgatatttaaaatactctagataataattgctagtgcatgatgatgtggcgcacatgcatattaaactttagtagtcagtacacgtcaactttataataaaataggatatgttacaaaataggatatgatacatggtggctccagcgcttaccatagagtttgcaccatcgcggcaagaagcacttaatggcctttcttgagcgcattagttttatgtttgatttgcaattttctgtgagaaaagagctgaagtgatctgagaaagaaatgtttctcatcttgttgatcttgtttatttgttctgagaggaacgtgaaaattaaatcacacaatagacttaacgtacaaatgtacaatgggtttgatcactaggaaattgggctaatggaaacatataggtgtattatctttggaaaaaatacgaattacccccctcccgaactatcgtggtcaaccaaattaccccctaacccgaaaaccaaacatcgttcaccttcaactttcaatatcggacaaattacctccctcgactcaatccagagtggttttgtcctacgtggcgtacacgtggcaatccagtcagcattttatttattaaaaaaatgtgggatccacatgtcatactcctcttcctcttttcctctctcttgcatacggcagcaatgggtgtggcgtgcggcgggcgtgacgggggcgcagcggccggcggcgatggcgggggcacagggggcgacggccggaaggccactacgggcggtgagcatggcggatctccaccggcgcctcttctcttgccgctcgccagcggatctctggtcgacgcgagatggcgcgccgcgcgcatgccggcgtggggacgggggagggcggtcagcgtggacggcggtcctcttctccatcctgctccgagtcggagtcaccgagtagggacggaccaggcggaggtggcggaagcggagctcgcccgggcggtcggctgaggcagagctcgcggagacggagacggaccgaaaggtcggcgatggaggcggaggccgtcgcgtggctgcctcctcgcggaccttcgcctctccgccagcgccacaatggcgagcgccgccgcccgcctctccaccatggccgccgctgtgtgcgccgactgccggcctactccctgcatttcctccacctccccatccacctccactcacccccattccctctacctcccttcgctgacacttccggctgttgcccgcctctccgccatggccgtcgtgcgcaccgacctctccctccccgcgtgccgccgtgcacttcgaccgccggctcgcccccgcgcgccggtgcccaccgctcgtccccgtgccatgccatgcgtgccggcgtgcgcgccgctgccagtgactgactgagagagagatagatagaggaagagagaaagagggggtatgacatgtgggtcccaccattttttaaaaaataaaatgctgaccggattgccacgtaggacaaaaccgctctgggttgggtcgagggggtaattcggtcgaacgtgatagttcggagggttgggggggtaattcgtacattttcccttatctttatccttagtaccaacgtgtccatgcgtggcaatgtgatttagagcaatacgaacgacttgtctatcaaatcttctcgtcggaataatggttctttttatagtttaggttggttttgaaacagtttgatttttgtgtggggaagtacgattgggagaggaggacgacaatttatattttgagtgatgtacacggtattctttaaacttgtgcgagtgtatcatccaggttcttgaactcccaaaatacatatttaggtctccgaatttgttttaggtgtcatgccatgtcagcacatggagcgagttggagcccgtttagacctatatgccatgttggcatgccacgtgggcaaaagtaacgaatagttaaggaaccaccacttaagagggaaaaaagtatgtacaaatataagaagggcattttgataattgccaaatctaatagtggcaaatagttaaatttcccagtctcttatacccattcgctcatcttcattcactagtggagaaaccatcattgtccggtcgaccaaaaaccacaatagtctcggatgcagtaaaaaccgggactaaagatggtttttagtcccggtttataagtagaacgagactacgtgatctttagtccaggttggtgttaccgatgatctttagtcccggttcacatgctgtcaggtgttgtcaggcccctccaggatctttagtcgcggttggagttacgaaccgggagtaaagatcaaaatacactatataatccctattacttatcctcttttttcgtccactcttttctcatccacacccactcctctctccctccatctctaatcttatctcttcccttcctccttatctctttttcttcttatccttcccaactccccttcccaactcgatccagtgtgcgcagcaggagggggtgggcggcccggccggcggagggcagcgcggcggcggccggcgcggagggccgcgtggcggcggcggcagccggggaggaggggaggcggcggccggctcagccggccggcggctttgcttcgtttttttttcttttttttttcaaagaatttgtgatccatgtgtagattgagatgaagaatctgtggttcattgtatggattgagatgtataatttttttttggaatctcattgtatggatctgagatgtacatgatttgtgtatgatttgtatatttgggatgtttctttgatttggggtttgatttcggatgtataatctgtagtgtatatgattgatttgtgtatttgggatggtacgcatcccacctaatttgggagaaaataaattagagattaaatagtaagtaaatgaaaaaaaaactattgcccactcccatctttagtaccgggactaaagatcgatctttagtcctgggtatttgaaccgggactaaagatagggatctttagtcccgggcctatctttagtcccggattcatagtcccggtttgaaaaccgggactataggggggttacgaaccgggactaaaaacgatttctccactagtgattgtttggattttctaattgactcgttcctcttcttgattacaagaactaatcaactgattgtaagttttgatcttatttggaaagttcttgtggctttctgtgtggatttctctgtgtgcgccttcgaagcctcaatgaatcgagaacagtactaggggaaagaaaaaagtttgattttcctttcttgttcttgttgctgccgtttcttgttgttgctggtcgtggctttgttgaacgcgtcgctgccatcgcagctgtcgggcgccacccttgcagaccaccgagaagccgctagtgaagcggactagggcgtgcggcgacggcggcagccaagaagcgcagatttggccactgacaccactgtcgcgttggccgtcgccagccaccgacgccctcctcctctcccgcctcgccccgccagcctcctccccacccgccgcacagagaagtgagagagggaggaggaagggagagaagtggggaaaagagataatgacgttgcaggtctcacgttgacttagccactacgtcggataaaaccgaggtcaaaaccactaaaggacctaaagcgtacgaccttgtaagttgagggacgtcaaatatctggttttacggttggagaacaattttgtaactcgatgacaagttgagggaccttcggcgtactttttccttatcttggtcccaaagctccgtgtgattccggcccaattagttgtggagtcattttttcttttcattttggggatatctctactacttaaaagttccgtagtggtggcggtgactccaaacacgcgaaatatagaacgtgggatagcctaatcgaacggctcagatcgcctttctcttcctacgcatccagcgcacgcgtctccctcgaatctcgatcgctctctcctctcccctaccctcaaccccccgatccacgccgccgcaaccccctcaaccgcccgcatccccgatccgttctctccctctttcctccttcctcaccgtcgctgccgtcctccccggcactcccatccctttctcctccatgccgcacccctccccatcgtcgcagccgccccgtcgcccctgctcgcctgcatccaccacaccgcctccctccccagtcgagacggcgttgcctcctcgccccctccgcagccagattgacaccgcgccgttcaatccaccgcctcaagcaccatgcatcgtcgtcgttgcaggcgtcggcacgggcgcgggcgctgccgatcccgagtcgagacgacgtcgtccgctgctgcttctccaccactgacggttgccctgcgtatatcctccctattatcgcggtccccatctgctcctgaatcctgatccacaaaaacagcggagcgccgtcggcctctctgcctccctgcgaccaccagtggcatctgccccgccgtcggctcttcctcacccgcgactcgccgacgatggtgctccacaaaccattcaggccgtcactggtctccggagcgcccgaggccgacgtgtctcgcactccctataatcttgctttgctgcatcagtaacaacatcataacatatcgtggttcatacaatggatcaggctggtaattcgattccaattcttgctcctgaacttttttattggtgattccctctaatgttcagcagattgggtttggtggtggcagtgccgcaccactgatttgtgttagacattggtccttatccaaccctctaatctcttgattatgctcacttacgatgacttcagctcaggtggttgcaagaaacactcctagactgctatttagttttacgttacagggatttggctacagatagttgcaagctgcaatgttctgatatttgttatgttttagagcaagatctgccttatatataatgttataattaggcttcgaatttcttgcttatgttctttaaaaattccaagtaaccttttcagttctttctgtcaggttaattgacagatcgagttgcacttacacatatcttgttttaggaaatgctccaatggcccttgaatccagcaaagtaagtattttttttatgcttgatctgtgactgatctcaaacagataaattgaaatgagtaacttgtacacagataaaaaagtgacatgggacttgattagagttacggtatttttatcttacgaggcggcaacattatttgagttttatgagtcaaatattcttccattttttcctgtcatttggttgtgtcaagtcattatttgagttttattgggtaaattgtgtcctgactggccctgagttggatgcagtgcttaattggtgcaaaaactgggcttaagttgcagtcaatttccagtcatgtgtttgaaaccattgttttctgattactttaattaaataatccatgatcacaatataaaccatatgtgcaaatatccagtcatgtgtcgtgtgcatgatcagatgactgctattggctataatgcagtgattctgaaattgctatttgccgaggtttcctatttttgctgaactgctgcagcagaatagtgccaccaaatgaaagtgaacacgtaagcatattgtttgggagaagatcacagttcggaatttcagattataaccaagataaagaatcactcaactttatgatcgacttgctattcatgtttattactccctcctttcctaaatgtttgacgccgttgacttttttaaacatgtttgaccgttcgtcttattcaaaaacttttatgaaatgtgtaaaactatatgtatacataaaagtatatttaacaataaatcaaatgataggaaaagaattaataattctaaaattttttaataagacgaacggtcaaacatttttaaaaaagtcaacggcgtcaaatattttgggatggagggagtataaaatagttcctactgaacattgtcggctacttgttgattctttttaggtggtgtttgttcctctgcacaaataggtctgcacatgcacatgcgatttctcttacagttattttggtgctttaaaatgctttacgtattggtaatattagagcctagaggtcaaaaactattttgtatagagaaaattatcccacatagccatctgttgtttattcaagaaatattatatgtatcttcaggggaaccatatgtgatacacaaattcaattttatgtccattgttagagaatccatttgcttgaatcaaaattagagaatcatatatctgatggaaaattgtctttttaccaatatgtttgccttgcagattggtagttcctctcgtcctccaggcaccagctatagacaatatctatacctcaaggaagcctcttcatgttcccctcaatatttctttctgggtgcatgcactctatgcttgctatgcaaaacccaatgtatgtgaatgtgatccttatgctgcaaaggtgctactataaacacttcgttcttttatctatttatttaaacattctttgttggtgtcggtgcattgcctctgaattttagatcttttttagtgcaaaatgcatatgaatgtgtggcattgatattcccttggagatgaaacaaggtattcagtgtttgcaaattaacatttacgagtaggatttacctagctagcatggcctctttcatagccacttttgcatgtatgaatctttgtaaattgtggtcctataggcaaatagaaaggtaaaattacgtgatcaactcgagctctttttcatatttgtgccactcatatttgtcctaagttttaactgtattttaatttaatcttaaattcaggccaactactcttgcggatgttatttaataaatttggatgtgattgtactgcaagttaatctagaaattcatttccctgttttcataacaacaaaacttttaaagatgatatccctttattgtcattcaagtcagcattaagcttgctggttgaaaatttgaagtttttttaattcattctgaagtatgaagtagtatagaactttctgattttctattggtgtttagctcttaattgttgttttatctgagaattcactgctgactgctagcttaaccatctcaataaagctgatgaagacaaggtgctcgatattcagacgatattggtcaagtataacatatttcatattgaccagtgagaagcatccggaagaagtaaacgaatgagcattgagttccagaaaatggtgtatagtatagatggaattatgaaaagcaatcaacctcatgttttatgtatagtttttattattttgtgaaaggatggtagtgtcaatacgtagagtttttattaatttgtgaaaggatggtagtgtcaatatttagttccagaaaatggtgtattgtatagttggagttagcaagagtaatcgtctagctcatggttttgggaaaggattttggtgttaactattttttcgatcagattatcaaattcaaaactacaagtattttcacccgaatgttgttcgtgaacccgtgaactttattagcttcaaatgtttttattttctgatacaactcacatgctattttattcaccaactttcgttgtttgtagatttgtattactaccatatgaaaactataaacatgtgatataattattattcgtgctatattaaaatttttattataaaggaattacacttaataattatttaacattatcttactgtgtgcttttaaattggtttataacttttacccgttgcaacgcacgggcatctaactagtcaatataaaagttgatgtagacaatatttatataagttccataagaaatctatcaaatccagtgttttaattcgttatagtaattacttaattaattgcatggtaatgtaccaagcttttttttccctttattttttctatggtataggtgaggatataataggcattttaattctactatgcatgcgactatgaaatgccatgtgtacgtacgtgatattctttttacagagaactactgaactttaacaacttattacattcgtcctaaaatatgagcattttagctatgtatctatagataattatttatttagattttgtagctaaaaatatttatattttaaaactgaggaagcacttaattaaccctataacgaaagtgttcgcccgataatgaatgtaaatacgtaatagtacacgtataaatacatactccgtatatagtacatactactcctacttagatacacgcatgccggagtgttactcgtctactcgatacgtctcacatcatatccgtcaagcctgggccacacgatctgcccccgcgccccatctggacggacagaatgtgagcacgtacacctccgcgtagcacctcgccgccgccgtgtcgtacgggtagctgacgtacgccgggcacgcgtcccggaacacccgcgagtacgcgctgccgcggcacgtctccgccgtgccgtgcgcgccgcggcagcagaacgcgtccgtcccgaacgccacgcacgcgctcttgcacgccaccaccgccgccgccgccgtcacctgcagctccggcgggcacaccgcgttgacgttcttggcgcagccggggatgacgcacttgcgatcggcggcggcggcgccgggggtggggggcttcgtccacacggccaccggcaggttgtagccgtcgacgaggctgacgtcgtaggagctccccttgctctggtcctcgtggaggtccacctcgacgagggtggccggaggggcgccggcggtgccgttgcacgcgaggcggccgccgcagtcgccggtgaggcaggacgcggcggcgttgccgtggtggttggtggcggtggaggtgaagttgcagccggtgcggccccagaagcggccgttccaggtgggcggcgcgctgacgcgcctggactggcccggcgggaggaggaagccgccgccggcgagcaccgggtggccggcgttgggcgccgccgccggccacaccgggaacgggcacttgttcaccacgcggaaggtgacgccgcgcacgagcgccaccggtcctgatcatcatccacagcagcacaacaaaattcatggaaattaccaatgctgaaaagtaaattttgccaaaagaaaaagaacgtaggtgggtgtgatttacggtatccatttcatattaaaagaacgtaggttttattctctctctttaacagagtttataaaaatagctagcaatttcagtttcaaataaatcagacatattttattgtagattttaatggaactaatttaatatacaaaagccatggatgtgatctacttcctccgttttacaataagttcaattttcctattctccacatatcaattaaaacctaaaagactaaaatatcttcactttatcaaatcctgatacaattattttttgctttatctactcttaatgtatccatctcctaattttacaaactccaatataataatgactaaaaataaatttatttatgataaatcggagggttgaaaagtaaacttattctagaacgaaggagtacctaagagagtaatgagcaggagtagtggtaggggatgaacgccggagagcaaggataagcacgccatctgtgtctaaatctatatagcaaaccagagaaactaactaagctgtcatggagatggtgcagtcgcagagagtaaacaagggtttttataccctgcaagagtctgcaaatacaatgatgccatggctaaggagatagctaagatcaatgagcaatgtgccatgtgtgtgtgtgtgtgtgtgacttgcattgcaatggaagcaaaggaagacatgatttggggtagcaggccagcagccacacctggtgcaggcctgagggcaaaaaggttgagtggtgaggtaggtaaaaaaaaaggatttaaaatggatgtgccacaccacaacttgaaaactgaatttaaaatactgctagttcattgaatttcatcagcccattttggtcatttgggcatgcatcttcccttgaaaacattataggagtactttctattttagactttgagcacagatacacaattatgtctaagcagaatttatcggcccagttgactggcagggttgctgggccttctagcctcgcccaatcacttgacagcttgagctaggatggcttatcctggccggccgacggtcgatacagagagcttctacttcaaaattcttattccagtaaggcagtgtttggcaaatgtctaaggcaaatgatttcctacccatcttaaatcctaaccattcattctctctcacccatttaatcctaacattttatttatttcccaatctcaatcccacccctcatttcacattatccaaacacaccaaagttgaaattgcacctcttgtaactgcgttcggcagcaggtgaaagagaagatttctctctcgtttgtcacgtgcacacttcctgaactattaaatggtatgttttttaaaactttttaataggaaagttgctttaaaaatcatattaatctatttttgcaatttaaaatagttaatactcaattaaccatgcactaatggctcatctcgttttgcgtatattctcaatcttatcttttcctctcctctcaaacatataaaacggaaaatgcactttgaggatcagctatataccaaccctggaattgagctatctttgatagtaataggtcttaaccgtacctttctcttttttacgtgtacgcttcccaaattactaaacggtatgtattctataaaaaatttgctttaaaaaccacattaatttactttttaagtaatacttaattaattatgtgctaatatgtcaccctattttctacatgtataatataaagaagtataaagaagcatgtcagcctgtcaggtgctgtgctatgttgctgaccacattcctctcgaacagagcaagcacagcgaacagaggaggtgaatcccacaactctgaacaatcccgtcgtcttccaacagcgtctcgtccatctgttccaaccgccttttcttttttcaaatggtttttaattggaaaatggatttgccacatgattcacgatcagtaaacgctttcagccttttcatcttacaattgagtactccatcaatttaaaaaccatttgaaatgtcgtaggagataatataccgtcgtacagtatataccgtcgtgctccatcaattccatctccacgtgttattgtctagtatcaatacagcataatgtcgtaggcgataattaatcagagtatcatgcacataagtaaaatacaaatacatgttcctttcgttttatattataattcgttttgacttttttcttagtaaaacttttatgtttgatcaagtttatgaaaaatgtaatggtattcctaacacgaaataaatatattattaaaatatattcaatgttagattaaataaagtttcaaatgttgccaaaattttctaataaacccaatcaaaatttaaaaaattgacaaaaaaaatcaaaatgacttataatatgaaacagaggcagtacaccaaatgcccgttgtgatcctaccccgaagtagcctacaggctacagtctcagagacagggttcaccaaactgttctcaagccaaaacagggttaaaccttttctttttctcgcaaaaatcgtcaactgtttgactcggcaaaaatccagttatatttttctgaagttataaaatttagtttggttaaaggtaaaattgtataaacgatcctaattataaaccttgttttaagattatacttattatattttattttcagcaaaaatcctacccgccgaacgctacctggataaaattggtcttcccccttcccgtgcggatgagtcattgattgggctaatctatatctatactaatataaaaaggatgagttacctccctccaatcctacatgttgatagatgtaatccctaccgtccatctgtagatcgctgatccataccgtcctccgcgatttaaccatctccatctccaccgcagaaatttctccctctacgcgcaaagaccgtgcgaagactacgcctcaccctctatatgcgcgactccaccgctaccgccgccagagccaagttcttctccatccgcctccggagtcgtgctcctcgctcctcctcctcgcgtgtactgctgctgtgctggagccgtggtcttccccatacgacgtcatctccagtcgccgtcggagccgaggtcgtccccttccgtctccgccactatcgcacagcaccgctgccccccccccccacccccctggagacgagttcttctccagctaccgctggagccgtgctccacgctcctcctcgcgtgtattgctgccgccgccggagccctggtcttccccagtccgtcgccggagccgaggccccccccccctcttcccctgccctcgaagctgaggtcttcccatccggcgacgccactgcagtccaccgctgcgctcaacggagccgaggtcatcctcatttcacatattaatttgtagtagtacatagctaatgtggcaagcagttgtggcaggctgcagcgttgtggcgcagcgccgtagtgacgagcagacgcggcaaccgggcgacgaggagcgagcagcaggaggtgagggcgaggagctagcagatcaggccatccctccatgaagggcatcagacgacgaggggcaagcagcagcagctagcagagcaagcggtgagtcctagcccggtgccggtgttcatactcttcgtctctgtttcagtaatgcatctagatgatgtgatttataagaattgagcttcgcgattcatagttttgatttattcgtagattttcgatggagaagaaaacaatgttgttaaattattatgcaagcaattcaagtagtaccaatcaaactgatgagaacagaatggaatttttgctgattgtgcacaaaataagaataacaataggtaagttttgtcacgaaatgagagatgaaataaggatggtatatttgttggtaaggttataagatcatttcaaaagaattggttagataaatttaattggttagaatatagtgtcaaaaaagactctgcatgttgtttctattgttttctttttaagatataaatacaaacccataaattaacttggttcttttaggtcgaacctaccctctatttctatcctgtatttgccactgacgcccttggaacaccactgccctgatttcatccactcttggctccatttggaatctggccatcgtcctgcaccctgcttcccattttcaaatcaacttcagcacccacattctcctggaaggtatgactttttttttcctattagcactagaagtgaaagcattgaggtaaagactaatttgaatgtccaatgaaaatttcttctacccgtgaaatgtatgtcaatctgtggaccggtgattgagtggtttcatgttaggctcaacagaattatatgaaggccattgagagtaatttattaaatcctttttgaggaaatatgaacatgggcaacaagacctatataggacactaaatttcttacttctgaccttacatgttaactgatttgcatgaacttgctaggaagggggggggggggggtttcaactgacacacaggtcatatcatttgtttataatgcataactaaaaaaaattcctcttgtcagcagaagtgtatagttctttgaagttgaaaaattcaatcccatttttgaatggttttcacatgcatactctgctaagctacttttctgtaagaaactaagtataactttgtaaacatgcgtaacggagtataaagttcatactttgttgaaaatgccctttgtgccactgtgtcaattgaaaaacatgaaaatgtgcaggtttttgtcctgctcaggaagggggtgtcgccaaagtgaattcaagacagctagcattcaatactttacacaagatccaggagccaccagcaatgcaagtggttgtcttactggtactgtacattttcttcaatagaatatagttgaaatgtagtattggggttctggtattaatgttctgtgatcagtatttgcaatgtattggagttgaaagatgcaccttctgttgtagcaggagtaaaaaaatgctggaatgtaagtgaatgttacatgtacatatgtgcaaacaatcatgaccattactaacttatttgttctttctgcaggtatgttgtgatgatcccagagtccaaggttggatgcttcatatcataaaggagttgtccatgtatttaggtaccatttgttaatatcatgacggccatggtaaagttcataatatgtcaatgtatatagttcattccctatcgttattttacttttcctttgagctgaaatattgcccatggggttagctcatttgtgtggcattggtggtatattctgattgaaatttataattggttgatgtactaaagagccaaaaagctaccctagacctttaactgttaaccttgtatagatttggaaatatattggcaaggactcatgtgacttcactatatcatgctatttatgttgctgattaaaattaaattgaggtgtatcactgtggcaattaagctaagagtaatcagattcctaatgttttgagtttacaacctttttcctttcatcgtgaaggctgcaatttatttcagtaagatacaatgtttctgctttgaggatcaaacccttcttccaatgcaaagaagaaaaagggaaattcagccaatgtgcaggtatagcaggaacaaatgtgtaaatattagatgccttgcccatacaatctctttgagatgtagctgttggtactttcttatgttccatggtgccagtggtatgttctgcaacttgagcaaacacgattttcctttttttttcttctcttctttcacagttgctaatagtcattttctgcacaaagttttaattgcaggctactcaagaacctaagaagttctgtcatgaagctgttgtttttctggagtcccttttggtaacatctattagaggacacttgggacctcacctataaaaaacaagtaaattttgaccattgcttcatattaagtgaatatcctctttatatataccaatgatcaattttggagctcaggaaaatggaaccatggcttcatttccttaaaaagtgcatcggttgaatccacagtgtatattctgcaagttataagcaaggattttgatgctccttatttcttccctgaaaatttcaagtaaagatgtgttttttggaattttgaatatttgcattgtgctgatgacttctaattactaacgatgtaattcataaattttatctatcagcatatgcttgcttagccggtttgttattctttttatttggatatacgtagtttgcttgaaaaatttgatggggctaaaagattatttggtttctcaggaagatgcttgatgctaatgtcttctcgagctttcagattgtaaggtacttttcatgtttttttaaaccagtactgctatccatgttttaaatccttttcatcatcattgtggatatattatttatttgtagcttcacaagaaaaagagtgtggctgtggactccaggattacattgaatcttgaaaaggtatgcactattccaatttcagatgatgcatttccctgatttgagatgtttccttttttccaatctaacaaaggaaacctttccttgagggaattccatgaaatatattggtttccagatttcaagattgttaggtcatttcgtggctgccacttcaactgtaggtgtgtgcatagtttagcaatatgacctctttagattaatattgtggtgaaggaaaatatataggcgttttgacaactgttagtgtttctgaaatgttcacacttgctatctactttttacttcaattaaggcaactatgaacaatatttttttttggaattatgtgatgaccatttcctgcaagtgaaatggatgtaaatttgtgttttgtagaccacatgaacttatgtggacacacggtaggacctgtaggacctatatacatctcattggtgatcatgtaaatgctatttttaattgctggccatgaggggtatatttgaagtattgttggagaaaacataaagtccttttttactccctccgctccattttaagtgtaaccatgagtttccgtgcccaacttggatcgtatgtcttatttgaaatttttttataattagtatttttattattatgagatgataaaacatgaaattatgtgtgacttatgtttttattttttttcaaaaaattctcaaataatacgaacgattaaagttgggcacgaaaaatcatggttgcacttaaaatgagacagagggagtattagatattgtatgctgtgggtactggggtttaattcaatagcactaagaaaaatatcttgctttgagcttttcaagtttttatcaagctatggcaaattatggttggtattgttagctgctttgcattttttttagtgtttaaaggagtatgttaagttactataataacttttagtatgtttgtatattttgtgtgacatatattacatgaaaagtgcaaaaaaatttaagtgttttatattatcactatagctaatgtgggaaacgtgcattgcgattactagtttcttctaatgtcgatccacgagggccatatcaggcaggtcaagcttgtccagcgtggttatgtgatgagtccaactagaacttgtcatcacctaagaatgatgttgcttacaactcatagcaagcaagtccttcacctaatatcgagtcaaaaaaaatagcctaagagctctctcgagtcgggctcaccttataggcacactggacgggcctaacctaggtgatatgacccgctgcgaatctacgtcaaaagaaatgggacaaattaacttcttttttgaacgactcgcacgagacggtgcgaagttctattgatagagcaggaaaaaattacaagattacaaccctggaggatcataaccagcaaaaagaaaaaaaataccaccgcccacacaccgacagcgccaacacacacacacacccgggagaaggctagcaccgaaccggccgccgctaagcgtgaccgaccgccgctagaccaacaaaggaacatagacgagatcgccccctagaggatgccaaaatgatgtcttcaggaagagaagcgacggaagaaccgccgccgccatccgtcagggctcaaagaagtcaagactgggcttttgccagacaaccgcccttgaggggtgagacagcacgacaacgccctcaggagggggaatgaaccatcattgtcggttcagctacagccgagctgggttttcacctgccgctcaccacctgcgaatccacggctgacgcaccgatgctccaccatcactcaagctctgccgacatgtgggacccctgcaccggcgtccctcgccggtcagccttggtgcgtcgaagaccgcaccacacccaccggcagctcctcctcacaccgaggtcacctcccccaccgtcggctacgcctctcgcgccaagccggcctcctccaccggatgcacctctcgcgccaatccggcctccctccatcggccgcgcctctcgcgccaagccgtcctccgtcgccgtcggcagcgcctctcgcgccgtgccggcctcctccaccggacgcgcctctcgcgccaatccggtctcctgtcatcggctgcgactctctgtgccaagctgacccccgaccctcctccgatcgctgctgcgccgtccaggtgcgctcgtcttccacgcccctggctagccgtcgaagaccgccatgcctcccaccgtcacgcctccacttgctgccgccgtcgatcatctatacgacgccgccagacgttgtcgcatccgccaatgtccccggccgccagacgctgcctccacagccgcggcagctacgagccagccgccgtctccaactgtccgtagccagccgttgtcgccgcaagccgccgcctcgtcgccaaccgccacagcagttcaacggaggggatccggtctcccgccgcagcaggccgacaccgcgtgcagccgccacgacaggtgcggctgcttgagccgctgccgcatggtccctgccgcggctgcctcgaccgtcgctgtcttcgccaaccaccgcagcagctgcctcagccgtcaccgtcgccaccagccagcgcagtcgtcgccgtcgccaaccgccgtagcagctgcctcagctgtcgccgtcgtcaccagccaccgcagacgccgccggcaccgcagccgccgccgccaccgcagccacctccagcgccagccgaccgatcagatctggccacggccaccgcctgccactgcagacatggccatgccgctgcctcctccgccacgccgccactccagccaccgacactgccacctccgcgccgcccactcgccgtccccggcagtccgccgcccggagcaacaaatccagccatggggggggggggtcggatccatgcatcccagcgccggatctggacgccgccgtcggtttctcctcggcgccggcgccttgccctgagctccgtcttgccggcgccctaaccagcttgactgcgagcgagggaagagagccccgccgccgccgtccttgcagccgcctggctttgccggcggtggctcgggcagcggcgaggtgggggaggggaggagggggtcgggagcggcgcggcctgtttcgctgcccgcgtcgcccccgaaggcggagcgaccgagcgttaaagtgggccgacaaattaacttctcatatgcgcaaaggaaacaatttcgactggataacgttgggtgggtgagttcttgcaataaaataggttataaggtgaaatctcaaaactaagatgataattagaatggtcatgcaattttgccataattgatgactggtttgtgttctcgaaccggtctaaaaagttcagttctcgttcagttctagttggatgagccgctggcagttgtcatcatcgtcgtcgtcctcttcctcctcctcctcgaagtagccattaacaacaacagtctacctatccatagcgttgggtggactactgccatgacccttttttttttccctttcgacattcagattagctagcagcagccactacacagctacactgtagtactgtaccactgttcctccttctactgcatgtggggccactgcacttcgcagctgaagaagaagaagaagcagcagcagaagatgaagccacatccgccaacaacccaaaagctccaggagttaatggcagatcgaccagtgcttttttcttcctcgtgttttcttttcccgtttcttataattaatcgtgcgatcgtaagattttttttccgattttttcttaaaaattgtaccaagtttttttccttttaaatgaaaacgaatacttgttattctcttttgaggtgtaccaaaagaaatattaatggcagatcgatcagatcggctggtggtagtggcggagtcaccgtctggctagtccggacagccgctcgggctcatcgacgaaagctccgttaaattttaatgttaatgattaaattgatggtttgaaatttctatagcaaatagcactactagttatatcgaaatttatctggacataaaaatctttttggctccacaactaaccggtggtgacacacatccataccataagtatcagatactacctctgtcctatataaattgtaattctaggttgtttagtaatatattaaggtttaagaagaaatactatgatgtcccttattaaatggcttatagctgagagtggaagggtggttgagggtaaaatgggaaaaaaaattgaattacaagtgattaatggaacaattagtactctattgtgataattattttaggatttgaaatacaattattatgggacagacgtaatagaagaggagagagaggaataataagaggatcagaatggaagggaatggagtggtgcagaagtggggatggaagacaaaggctaagcttgtgtggccgcatccagcgattccccagcgattccgacaaccaccagcaacagcatggctgattgcccgtacggtcgatcgcctcgcggatgctcggcctaaacagttgtgatcaccaacatcactgttgatttctgaccccaatcagtccatctctcctaatgatttttttactgtttcctaatgatgtcgaaatgtacatcaacttttaagacattcgacgtggttgattttcgacataacatttgatgctccgttttattaaaaaaaaataagtgtcattataacttgttttatagcagacgtactttaagcgtggtttatacttttttatatttgcactaaaattttaaataagacgaatgattgaacactaaaatcgatatcgtttatttttaaatggatggagtaatttaatttaaatgtatttgactgctggcatttcaaaatgtcacttactttttttacttatttataacaataatattgactatttcaaatttattttttgaaaacagaatggctacttttgttaccttaaacatagtttcaatgtactataactttcttgcatctttttttataggtttcatactagtaattagaaataaaaaggtgtcctcgtgactgtgccgttatctaaaacaccatttatttgtgattagagggagtcggaagaaagagaagtcgatctaattatactccataaataccaaaatgatcagcttggcttatttggaaacgaaaacagtcccaaactatttcacttgagcaattaatctcctaaataattttttggctcattttatacctcaaactattggaatggttcaacttaacacacgcacgcaaaccctatccctatgagcatcttcgaagattgggccagcaaatccatcctggagattgacgaagtcaccacaggcgcctcactgtcgacggttacgtcgcctaccactgaaagcacaaagccgttaaatcctggaaaattcactcccattgggagtcgaacccaggacctatggtgctactgaggctcttataaccactaggttacaggctctttcgttactcttaatggtatttctctcttctctctatataagtcatattttgtattaaaatttggtagaattgaagatgcgttatagtttacctctcaatattctttagaaaaaaattatcattgtttacgtaggttgaaaacactgtgactaatttaaacatgaaagttttaaatttcaagcaaatactcatgaaaacattttagaactttgataatgatatcatttatagcttaaaaagtttcagcttaaaatacaagagtgaaccatttctaatagtttagggataaaatgaagaaaaaaatagtttaagtattaagtgctttaggggagtaaaatgattttcttttctttggaaaaaatgccaccttgcataggaaaaatgatttagcaaggaaaggaatattggttgaggctaatatgtacttcggaaaaaaaaagtaacggaggagagaaacatcgatagtaagatattatcatcgatagtaagatattatcgactcttagcaaaacaacaaaaaaggaattttgttccttaaggacagggaaattaatgaatgataaggaaaggttttttctcttggtgaaatgaaggctaaagtatttatcagagtgaattacactttaggctaccttttattgctatagtttcaccttaatcacctataatccaatcattttttactttggactagctaaatttatatttgtttgctttggatcacccaaaaccacttctttagcacatcaacaacatcgaggacgttggctatggcacgctggcaaaatcatccacctatgaacatgccatacctttgtcggagtataggatggacatggctagtgaagagagtcgaagtagtccaaaagtacaacaaacgtaaagttagctactttaaagtgaaaagatcagagtaggggtgttcaaagtgaaactacaaattcaattcactctatttattatctcaattgttccaagaaaataataaacagcatgtattgcttataaaactgtatgaagtataactgctgtactcgttctactcatgctctataacttggtacaagacattccaaaataaatccacctatgagtataccattaactttgctagagtataggataaacgtgactagtgaagagagtcgagtgaagagagtcgagataatccaaagtacaataaaccttaaaaagattagagtaaaggtgtccaaagtaaaactaaaaaataaaatatgacccaaaatataattcactctatttattatctgaactgttccaagaaaataatctctaaacaacatatattgcttataaaactgtatgaaacacaaccgttgtactcgctctaactcccaccctataacttagtactggaatggaggacacacttgtaatggggttattattggacaagacattccaaaataaatccacctcccgtataaatgcccgaacatttttcttgggggaaaacagatcatatacatgcccaaactttattgatccagcctgtttttacgagtctcctccatttcttagagcaaggataataatagagctcactttctactattagctaattttaaagccaacacatataataaattagctataaggttggctacaattttttctcctctctctatctctcacttatacattaattgtatttgtcttgaagcttgcatgagagccaacacccttaattttttttgttacatctctcctccacataagcttatagtaggcttatagatcattattatacttgctcttagggcacccgctatggttatctataggctctctacaagagatccatgtcagcatattttcctacttggaagatattaaataaagagagagagcaaaactatctaataacctggagatagtctatagagaaaaacgatgcaatgcattagagagctatagatacccatgtaggcgtactattgaggtggtttactattaatctagtctattgctgagttgtacatgttttatagagaacaccttctcttactgccgtggtagtacttgtcagatgaacagagagacatttaatttcgatcaccgtcaattatgacttatctccaccacaattaacgccaaatttctcaattaatcagtgtgcgacgacgtagtagcttctaaactgttgctgtgacacgcgtcgcactgttgccatgacggcgttaattaggcgcccataatcccaatgattgagaaacgaatgaatgatatgattcggcaatataattaatcgctgatgggcacggtcggacatatggccccgtttgagggattatctagtagcttctccgagaaccccaaaattctcacaaacattatatttcatattattacccagattatgataatataattttcttccgtttcatattataagtcgttttgatttttttcaaacatctttacgtttatcaaagtttgtagaaaaatttagcaacatctataacactgaattaattttactataaatttaatcaaaattaaaaaagtttgattaagaaagaagtcaaaacagaaggagcatataactataatatctcaaaaaaatgaaatctaaattacaaaccagtctgaaacctgtcttttttagatttttaaaaactagctatgaactaattgtttctcataataaaaaacaagtaaatattagaaaatgatttaatattaaataattagaaaggatgaggttttaaatccagattatctaacactagctgaaagaccctgaacgtttctcactgtttctcctaatcatatgattcatatgtagtatcgcgtctatatttcgaacagttcagaaaaaaaaaatagaacagtgccggggctctggtattttcggctcctaccagtcgcggccaataattcgtcgtgcaacggctatcaccatcacacacacacacacatacaggggtatctaatatatcgtgttcggagtgatttgtcgtcggttcttttccgtttaattaagcatggtgtcgatcgaaatcatcaaagagttggtgccattaattttggacccccaaactatatcggcaagtaccttcttctgctaggtactgatgattgtttgtatatatctccacattggaattgaacgaaaataatttttttttggaccagtaccatcgatctgatatattattgcatataaaatttacaaacagtcatgttctatggttcaagtcatataaaactctagaactgggagattttagaaaaaaacttattattacctatcattaggaatgattgagcaaattaatttcagaaaatcccgctgtggttgaagttgaagaatctgtttttttttacatattccaatatgtttttccccatatttatgtatgttttgaagttcgagagcgtacatgttctataatatctatacatttaagaataaagtgcataattagattgcttacaactaaggaaaactatgaatatatacatgcaccaatcgatagagccttttcaaaacttttttaaccaaacacatgcatataattttactcccaaaaatcaggagagcaggcctccggaacccctccttgatcttgcaccgagaggaggagacaaatcagattttgggggagcacatcgcgtaactacaactacgtcgactgctttcccttcatcgtggctggtggcgagaatagggatgtcaacaataagagtgggaatgggaatggcaacggcaacggttctctttccactaccatcgcaaccactattgtaggaccctatgttattctcctcttctatttctttctgttgattctgcttttatgcaaaaataagttatatatatatatatatatatatatatatatatatatatatatatatatatatatatatatatatatatatatatatgtttgtttccatggtttacacctatagcatgtcttttttttatccttattgttgagaataatccgtttatggctaacgctatcatggtttatgtttacatcgttatgatttgttttattattttctagatcaaatactatggtaaattgcttatattgtcaacagacgatgcccgggagaggccaaggtgattctggagcatgggcaagagagctactgcttacatgcatacacgtgtacgatctagatgccgcctaggcccatgcccgtccctgggcatgtgcgagctgcgagatcgcacaggccccccaaaaaatagggtctttaatttaaaccaatatgttccgatatacttaggacatccacaatgtgaccataagagtgagccttaagactttttttcagctatatacattgtggatagggacataaggcattaaatgctaaaaaacagctctaagcttatagttgaacttaagagattaaaaaatgatatctaatggagcctatcagcatatggttgcgaattggtggtatgtttcttctttaatgggatccagtgggacccggcttgttttttatccaaggccataaccattgtagagatagatatagctaaagctatctgcacataggctcacccctatcgctcattcagcaacccaacattgaggttgcccttagggtctttcggatggaacgagttattttcttcacagctccgacaagtattcgatggtaaacataactacatccaagaactatattttgtgacgacgctatcaacgtgcattctagacaataaggattcttttttttttatttagtaagaaaaaccgaattgttacgatgattcttcttttacttagccagaacactaatatctatgtgggtgagtttgttgacatcactccagttattattggtcacaaacttgtttgataaataaaggactactaaactaatggtaccttttcctgatatagttataaagaaggtaaaacagatcaaacaaaaatcggtgatattagaaatccgttccaacatatttcacacagaagccctatagctgagtttgggaggacatagaaaacaaaacaaataattagcacggaattaattaagtactagataaaaaaatcttaataaataaattaatatgattttttaaaacaacttttatatagaaatttttgtaaaaaaatatatacagccttattagtttgaaaagtatatacgcaaaagaaaaatgaagaaggtaggttgggaaagaagcgagaattgttaggaacagttcgtgccgaggccactggaacatgggttgtcagcaaaatggtgcccgtacgtcctgatagatggatggaaccggcgatgaaaagctcgagctaccaaagcgcgtaagtactgaaatttaactcccggcgctgccgcagctgcttgacgattaagccgggcgctttccctcattgattacgtactccggctgtgtttaagtttccttcaaactttcaaaaattccatcacatggaatatttgtacacatgcattgagtattaaatatggacaaaaaaacaaccaattacacggtttacatgtaaattccgagacgaatcttttaaatctaattacatcatgatttgacaatatggtgctacagtaaacatttgctaatgacggattaattaggtttaataaattcgtctcgcagtttacaggtaaaatctgtaatttgtttttgttattagactacttttaatacttaaaatacgtgttcatatacaataaaaaaaatttagagaaggaactaaacacggcctccgtcgcctaactgtagcgccatttatcgatcactcaatcagcaatgcatatgaaatgtgcaatgcaagcatatgcacgaaactcgtattaatttttccccatactgacacaaaaaggaaatgtacgaacacgtaagtccagggcccacaaaccagcagcaggtggatccatcctggtgctccttaatttggttgggcccacatttttaacttttttttagatggaatgaactagaagaaatgttttcatgcaaaagttaagcaagttcaatggattcatgtgtgtaagctgtaggtggtcatcagaattaatttgtttataatgatgtgtggaatgatgcattaatcgactgctcaaacacgtacgtcgtcaggatgtggtgttccgccctgtgcacttacagacatgtcaccggctgctcgttgacttgtaagctggaattcttattatttttaaaccttttaaattttaaaacaaatcctcccaagacttaacttttattttaaactttttggccacgtcacctgggttagcgcaacaaaacaacacagcctcgccacccacagtgaacgtgtcgatgttatcttgtcatgtcacaggaggttagcatggaagtgttgtttggccacgtatcagtacggttaaaaggttcacatttagaaataagtttatgttagtttatttttaaaataaaaaaaatcaaaaaaatagattttataaattttagagtttgatttaggtttttttttcaggcctaattcttttcttcaacaaaagctggatgaaaattttgatattcgtggtatgtttttaaagtgctaaatggtgtgtttcgtgtgaaaactttctatatgaaagttgctctaaaatattggataaatctattttttcatgtttgtaataactaaaacttaattaattgtatcttaataccacctcgtttttacgtaaaacacttaatcttcatcttcatctacataagattcaaacacccctagaatataagtatgaaaaaaatacccttaaattgtttttgttgcttcatttattttcctgggtttataagacgagatattgttaattaacgctgcggttggaatgtattacaagagaatcgtttttcaccataataccagaaaaacgtcaccatgttaggggcgaggaaatagttgtggaattccttaaggattctacgtttcattcactattgctatatattttcaagaatttcaactattagcttaaaatcttatcgtaattaattaaattggcatatagtgagaaactcttaggggtcttccagctagctccacaagctagtgggctagccggcctgggttcaaagcttcaccccttctatttatttgatattaggtcattccctaatatttgtgtttttaaaattggcatatactagcaaatatatgtttttcaacaggaactttgtaggattgggttctcgtgaggttttttttggcacttctttaaagtactaagaacatggttatgaatatttatatataactcaatcaattatcctttattcaaactgacttaatttttcaaacttcataatgcctttgaattcccgagagcactcttatccacctttgtgcaaatcactcattttaaagcatagaagcaagtcccagattggtaaaggattccatcattttccacaatatctggaaagatttcaaccactagctcaaaaaatcatgttaaatgttctcttaagggcatgtacaaaggtaaagtttaatatgagctctctgtattaattaatatcactagagactatcctcctacaataatagagacaataatatttctaaaccattaatacactaaataatttttttgttatacttctttccttttctacacccttatgccacaaactttccattaataaatgctaatagtcgactctgagccgttgtcatgcgtagcaacgatgtttctcattccttctctctctttcttccacgttaccaaatttacttgcatgacaacgaagagagcccgttaactattgtacatgccctaacaagtcaacagcacaaaagtcccttcccccttttgtgtctcaagacacatcccttcaaatttaccaacattaattttatttttctcaaatgtacctaaccatctctctttgggaagtattctaccacctatggtatgctagtcctctttttacctaatactacaccttcattaattacattgccaacacacttaaaattatactacctttggttaatttaaaattgaactaaccaatgccatctaaataaaaatagagggagtaccatttatgtaccatacattttaagacaaacagacttcgtgtaccaatcagttcatacagaagccatgttcgaatcaataacgaaatatgaatgttcacctacacatcattagagatcactgtcctctcctcctccctgtcaaactcttttcctttgaaaaccaaggagaccaccatttcctttttgtgcagtactttgtacgagtactgatgggattaaccggataatatagacatatcacaataattaattctagtgtaaatgtgtaatgctgaatgcttgaaatttaataaacttttcttggaaggtttttggtaccgccacagctgaaataatttctcaagtatgttcaacattgtggttggaaagcagtactatagcgctatcttggagaaaaaaaaattcagcaacagttttggacgcatatatacatagcatgtcagagttaattaattaagtttctggtagtggtgaggaaatatatagttatgataattcctagggattctaccgttttctcagcaactttcgagatggactttgtaggattcgatttattcttgtaagcatttcctgtatgcatgttacattttgataagtactgaagaaatggttatgaatattccagtacaactcaatcaatttctctcatttattcaaaggattatttaaccttttcaaacaacatcgtgcccttcaaaggacccttgattatcaaaattccttgaccaattcatccatatatcacttatatttttcactattcatagacaatcacccattgtgaagttaagaacctcccaaatagcttcaggatgccatcattttagctcttttaattttggaaagatttcaaccattagcttaaaaatcatgtgaagtattctcttaaggaaaaagtacgaattacccccgaactatcgcggtcgaccgaattaccccttgaacctaaaaaccagactttgcttaccccgaacttttaataccggacgaattaccctcctcgacccaatccaaagctgttttgtcctacgtggcgtacatgtagcaatctagtcaacattttctttaaataaaatggtgggacccacatgccattactcctcctcccctctactctctctctcgctctctctctctctctcaggcgtgcgtggactagcagtgggcggtggcggcggcgcgtggggaacggacgtgcggtcagcggcggaagagcgtgtggatggcgcgatgggcggcgggcagcgccgaggagggtgttggaggaggcaggcagggccgaggatgagctccgcgtcaacggcgatgaggcgacgaaagcggtggcactgctgctgctcccttccctggagatgatggtgaggtacccctctcgagctccgtgccaacgacggcgggtgacgagtccgatcctccttggggagggcgcggcgggtgccgcgtgcggcgcacgcagtagggagggcgagacgagcggcgggcggcaccgaggacattggaccggcaccggaggcagccgtcgtgctcatcccccatcttcgcctcatgcatccacggaggctcgccgacgtcgccgagcagcaggagccgcattggacgaatctagtcgttgtggaagaactcggcgtctcgtcgccactgatcagcatggcgatttgggcaccctatgattcgtcttttggcaacgccttgccaaggaatctattttctgttatggtctctgcagactctgcttctgccgctggccaccgtctattttctgttgtgctctctattttctgagccgctcccacgatactggaggggatgccgacgaggctgaggaggactatgaggaggagctccgtgcgtcgatccgcctctaccgccggccaccatctcctccttctctagccatagacgcaaagcaagagagagagggtgagagaagggaagcagggggaatgggattagggagggattggtgtgaggaaagagatgacatgtgggcctagatatttttttatgttttattttgctgactagatgccatgttggtggccaagtatgcagattgaagtcaaaaccgtccaaaacagtgttcgggggattatttccggtataaatagttcaaggtaaacgatgtctggtcttttagtttaggagggtaattcggttgattgctatagttagtggggaattcgtacttttaattaccttctcttagcaagttcaaacactatcacaggaatacctatcactgtcgactcattgttgtgggttccattagaaccgacagtgataaatggattcggggtaaaaagaaatcgatttgtaacagtcgagcaacactgtcgattacttattgtcggatcaactataggtctttcatctggcagtgttggaggtttatgtgatagtgaaagcacacgaatttctttctcttcccccttttgttatgctttaggacacatcccttgaaaactttcctcaatttctcaaatggagcatataagcatatctttttgggagcattcctcaatacctacaacatactactctaatgctctcacctaatactccgtcttcatctgctacatcgccaacagacttttaattataccatttctgaatattttttccacttactctacgtgttatatatgacaaacagtcttcgtgtacccatcagttcacccaagagagcctcatatccatgacgaaacatgaatgattcacctacacttcataagagaccgctgttcaccactgtcctctccctatgcctctctcaagtcctttttctttgagaaccaaagagaccattactaaaatgtgggttaattggatccatgccattgcaactttaccaaatttataaaatgacactactatttgtcatatcggctatatgccactggaagtttctaaaattggaaccatgccactccagccaccttttccgtcctcctctctcacgccgtctctgttcccgtcctcatccccctatggtgcatgcatgcagtttttgttactgcattcatcaattttgttaccgaagtaaatgtactacgaaagagtttttacttctattggtctcgatgcactcatgttatgtgtgatcaactggaacaaagccacagaggaagtatgacaataatgtttaacaaaaattataacattgtaggagtacttacaaagaaaaagcaacacatctggttttaatgttttcaaatcaaatatgttgagaactattcagggtcagtttttgaaagtttgatccaaaaaaccatcggacttgctaaaaatatgatgccacagtttttactaaattttagtcactgttttccacagaggaaataggaaagatactggcatatttaaatacagagagtagttagtttttatacatccattagttattaaaaacacatatccatccatgacaaggtgtctcttgtaacttcactgatcccaaaatatattgtcatggtctctcttagagatgctcgtaaagacaaggtgtatatttatatgaacaagtatacccgtatgtatataaacgcttacgtttgtatcatattttcttaaaaaaaaaataacgaaacatgaatgattcacctacacttaattaggagaccactgtcctcctcccctctctcaactccttgcctttgaaaaccaaggtgaccaccattttcttttttttttctttttgcagtactttgtaccagtaattaatcaactaactaatcatgggattaaccaaaactaattcttgtgtaaatgtagtgtgcaatgcccagctgccccttacctctcaccaaccaaccatatgtttcgcccactcacacacactgacactgccacctcactctccactccactatatataccctcgctcgcgcgcgcgcactccactcgcgcactcgcgctcgctcgcacgaacgcacgcacgcacgcacgcacgacgcgcggcgcggcgcggcgaggcgaggctagctcaattggcggcgatggaggcggtggcggaggcggtggcggcggcggtggcggccggggtggagccgttcccggcggtggacaagtgcgacgcgtcggggcgggaggcgcacgcggtggcggccgacctggaggggacgctgctccggtcgcggagcgcgttcccgtactacgcgctcgtggcgttcgagtgtggcggcgtgccgcggctggcgctgctgctgctgctggccccgctggcggcggcgctccgggcggcggtgtcggaggcggcggcggtgcgggtgctggtgttcgcggcgacggccggggcgcgggtgcgggagatcgagtccgcggcgcgcgccgtgctgccgaggttctacgccgccgacgtgcacccgggcgcgtggcgcgtgttcgcggcgtgcgcgcgccgccgcgtcgtgctcacggccacgccccgcgtcatggcggagccgttcctcgtcgactgcctcggcgccgacgccgtcgcgggcaccgagctcgccacgtggcgcggccgcgccacgggcctcgtcgacgaccgccgcggcggcgtcctcgtcggccgccgcaaggcgcaggcgctcctcgacatgttcgccggcggcgacgtcccggacgtcggcctcggcgaccgccgctccgactacccgttcatgagcctctgcaaggtactttacaaatataatttaaccattcttttttggaagtaattacaattaatcctctccattaatttttactaccattctatcagcatccgtactgcaccggccgcatgtacgtacttaagtaattaaatctataataactggataattacagtgacttatcagtatcacactgatcacaccgggtaaccgtgcttttggaacagttttaaacaagagaactttttaaccaaattttacaaaacttattaaacgaatttcatgcattaccaagttgataactacttaaatctttatttgcatgcatactgtcattatcaatggcgacatgttgacaaactctcaacaggagcatgcatagccctcttataaaattcgcaaaaacaaaaaaaactactctgcatgatcttccatgctctatgatcatctccatcatgtaacacaattagttacatcaattctttaaaaaaaataaaatttaacaggtgaaatttttaggaaaaacaacacgattagtagaagtacatgctactgtgtgacatgccaaattaagatgcaaaatcagttgctggccggggtccgtacgagtgataagagggcaccactgcatgatgaatctggatggactggtgtggtaccgaatcgcattgcatctcgcatgtgttgtggcagcagctagatagttagaattggtactagcctttttttttcacatttcattttttttctcttttgtgcatgtgcaacaattaattggagatataggagtactgttggcactgtagtggctccagtatagagaggagatgaggaggaaattggttaaaaacaaagttgtgggtgtatagggttttaaaatccggggataattcacggagcgtgaaaaactggctttgagaaaagaagttgcgagtaggtttttagaaatctggggataattcacgaaacgtggaaaatggtgcaagagtcactcaattgttttggaattttctttgtgtttcttgatggttttcaaacatggccatctggaaatcactccatattattcagttctatgaaaatagtagtcagctagttcttgcgtgagagttttttagcccaaaatagctatctagcctcgtgacgaaaaataaaaataactttacaccacatatacacattaattagttagaaattgttgctcaacctacttgaattgagaagaaaaagatccggccgcagacaagaaatggaaggctttttcttttcgtgttgtccttgctgtacttatcaaatcatcacacataactaaacggctaattaattagcgatcgatcgatgggttcggttggctcacatcttcagctcagcaagtaaatttaagtgcgtgctggttaaggacccgacacgccgtctacccatatttattaattcaatctcatctacatctccagctcga

SEQ ID NO: 81936 - DNA, 797 bp, Oryza sativa
ccacgtgggcgattcaatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctctccaagactgccacatcacttgagcagcgctcgaatctgggcgtgcagattcgtttcatctggagacatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgccctaaactctctctttgctgtgcctcaccttcgccacacacactcgttctcaaccctctctttctccaacgacatggcacggggctccgctctgctcgacggtagcgtactaccgccttcccgcattgtgagcgagaggcaggctgggctgccgcgccgcttcatgccggaatccgccaccggccgggagatagtgatgc

SEQ ID NO: 81937 - DNA, 14300 bp, Oryza sativa
cctcacatagtccatcacattttctatcacatagtgcaccacatacgtcatactactaacaaatagattaacttcatagttaatcacttcttctgttggcgccgaatagcttgcgagcccggagtgtacctacatttgaaaatccaatgtttaaaacatttaaaaacaaaatgagggaaatcaaataacatttgagaatggtaaactcatttacctctttttcgctgcctgagtggatcgcaagttgtattgggtgggttgcgtcccctgaggcgcatcgggaagctgcgacatgtctatctcctcagcgtctggtgcgacgtagtcctcatcctcctcgtcatcgtcgtcgctaggtggagccggcgccttcccctttcccctcccttgtggaatgcgtgacgacgacaaaccaccaacttcttcacgctcttctatcctgatggagtgtcgagcgatacttggacgacgaaccaccgtagtaaacacgaacaagtctatccatctacaccaaaaaatcaaatgtaactttacaactaaaattaaatcttccttcctaaacgtagtccaaaccgacatattataaccaatgtataacttaaattgtctcaaagctactactccacaaaaaaatatttaatccacctacaaatatcaacaagtttactagcgcattacacatcgaaatattacaaatactccgtcatacaacccaacctagttctaagtaactataattaatttctataatgcaaccaaaattttctccccttcatataattaatgagtaaaagtttaacctataggctatagcatcaagtccatcaaattaaaattactttcatgcctcaaccctaatttttcatctatccatctaaccaaaccatccaaaaataacattaccacatatatggttcaaaaaatcgtgacaccaatgagtacattgcaaacatgtagcactacaacaagctaatcccaagaacaaatgctaaaaatcacaaaatttgggctaaaaagaggttctagggttaccctccgatctacaaattcaaccaataaaaacgaaaaaaaaagaggggggaatggaggagtctacctttctcttcgatttccacaaaaaatcccgcgaaaaacgagttcaaatcgagtggatttgaggtggagaggtgagggggagagagagggagaagaacagcaagcagcggctcaggctaggactcaggcgaaaatgggagtggggaggagaaaggtggtggggcccacggggtttaagggcgcggcccacagaagaggggcgcgccagccatgctagcgccgtcgtatgaggggcgtcgccagggtggctggcgcccccttctgctcagtcagcatcgccacgacagctctagtgtcacggtggcacgggcgcggcgccatggtggctggcaccaccatgttggaggacggcgccagccactctggcgccccaaaaaggaccattcctggtttaagtttttccaggggtctatttgtaaaataaatttttaaaaatgatcaaaatgtaaaaattctacacgaggcagcaggacgtgacaaacggatcccgtgactccgtcggtgacgaggaaagccctcatggttactcttgtttttttatgctacacaaatcgttataagaggttgaagaaaaaaagatatcacaaacaaattatatctcaaatggtctacaaaagcttaactaattccaaaaacatgttttacaacatgatggtgtttcctaagaacattaatgttataaaaccagtcccaaaatcaacatcggtagctaaacgtgaaagaaacgccataggagatccaaacacgatgatgacaccgaggcatgatatttggtaaaggagttcagccgaggcctacatctccgaggcactgattacgggcgctcctcccggatccagcatattacagcgtatcagagttacaacgactcacggccggtcgccgctagcagctgctccctctcgctatgctaagtcaccatgcagttacaacaggtccacctctctatttaagagagatccaaggatagagtccgactcttactctattccaatttctaaactgtaaccgactatatacacatattcgacataaactctaacaattaaaataaaaaataagagtgaatggcaaattggactacatatcgtggactaaaaccacataaatttgcagtcttgcagattagaagggggcgagaaacattgcaccaaacccccaaattgacaactcaaatctacataatgtaaccaattcaatcaccatataagttagcaccccgttcctattctctatcttgtacttactatatttggcaactcaagccatataacacacataatttagaagaacaaatttgcatggtgttaagtgaaaaggatggttatgccctagttcaatgcgaaactatggttaaaatatctagcctaacgagcaaatcagtctaagaataaacaacttctccttttcacacaaacaacattttaaagtaattaatttcacgagaattaattaaactaacacgtatgaaaaaaccatgtgttctaaggccatggccaacgctccaagctagagcgtggtctagccctgcccgagggaaatattcatgccagctcggatgggaccgcaccctagcagaactacgcgacccacagcagagcgccgcgtttcgtcagagccgtagcgaggaaagcgtgaggaaccgcattgggaagaggcatcgccccgtgtcgttgccccacaccgggaaagaagatatggcgaggggatggatgggagagaatggcctacttgggaggctcaccgatccaccacctccgggcctgctacttggccaccctgagcaccgctacatcgatccgccgccacgttgatccccacctccgccgtcgattttctgtcgttatcacatcgatccccacctccagtacatctatctgtcgtccccgcatcgatcaacgccagggaggtagaggggagctcgagctcatcgccttcttggcggtggcgtcaaagagagggagggcagaagcggcgcagctgagaagggaaagctgacgggagaggtggtgtcgccgaggaaggggaagaggagaggcgaaagaagacagggagagggaaggtgtgggtctttatatatgtttgtgatatttaggggagcatactacaaatattgggcttatatgcgaatagaaaaacacaaggatttaaatgcaaaatatgaccgactaacaacgtccgaaacgcaaaagcaatatgaaactatggttggcactctattagggatatcacaagtgtggttttatcccatttttagcatcttctttcttatgggggctatggcttccaatggccaagcgaagctattcatacataaaaccttctcctgaagggatagcgaacgaggctttcttggcagataaccgcacaaaacctaccatcatacaacaggccactactgtcttgtgtcctcggaaaccggttcgtcccacggtacaccatcaccaactctttaattatttaggtatatacatctatcatttctataatatataacatgcattcattcacatatttcgtagcaaagcgcgggatatcaactagtctgcatatatggctcagacatgctaactagctaggcctggtccggaaagcccgtggccggtgcagttcaatatccagcctcatgttggccagctgcctctctctcatagcaaaccagctgatgaagagccttcaccaagcacaaaatgtggctgcctgtcctctccttgttggcatagaacaatgtctctatcttgctcaccctggaatctgcagaattattcgatcggcttctgataatattgcagtgaaagtcttgcacgtcgtcggcatcctccatcctggtccaaagaaacaaaataatgaagggatgttggacaagctatatctgccctttgtcttgcatgtattttgcatagtctaaactctattcagttttcatgcctaataggaagttggaatgccgtggaagaactgttattccttttttttgttttgctatttatcagttgccaggaaatttcttatttgtcagtcacctagaggtcctagaccaactgcagtttagacttgcacaaaatcttttaccaactttggtgcatcttttaatctggtatgttctttttttttaagagttcacccggatgcgtgtttttatatatgatgattttgctcactgtagttgcctgaattttttttcttggttgtcgttccactaaatttgtacggtgtgttgactaaacttgtatactcttggtacaacctttttgttcttttacagattaaattgctaatttgtgagttttggatgttgatctacttagaagagtgactaatgacaaaaaaaactgtcacttaacaaatactccctccgtcccaaattataagcctatattttttctacatggtcttcggtgacatactttgaccattaatttattccatgttatgtttccaacaaatataaaattagcatcagatgaaagtactttaaaatataaatctagtcccaaattataagcctatattttttctacatggtcttcagtgacatactttgaccattaatttattccatgttatgttcccaacaaatataaaattagcatcagatgaaaattagcatcagatgaaagtactttaaaatataaatctagtgatataacatacataatatttagcatatatatggttaatattattattcgtcaaaagttactgagcttgatttttttaaaaaagaagttgccctataatttgggactgagggagtagatggtcactctctaagtctatttgatgagcaccactgattggtggtatagccaccctaatcttgggctaattgaactgatggaagagacaagattaattcaaattaaatgattaaagctaaaccaaacaaagagttaaatgatgaacaacgaacttaagaaataaaaagaagtgaaactagttaggctataatgctctaccgtacctgttcatcgcctgttcgctagctccatcattgtaactaggtcgtaccccccgcggcctttgccgcggacccaataaaaagcataaaaaaactaaaggatgaagagacatcaacaaatacaatacaatattttggtaaaataagaattgtgtggataatctaaacattgcaaacgtataggagtaaaagatagcaaattagatgtgcctgaagccctgaacattgctaatagcatattagtttactaatgcatacggcgtgtcaataatattggcaaatgaacaggaactgcagcatctcaatacacacattaacaaatacggtacatcataggcataagaacatcatcaaagaccaagtgtgtgcatattggtggtagcatatacaacctaatgattttgcatagtgcattacatatagaggtacgcacaacaacaaacatggaaaagtttgtagcattgtaactgaatgaaggaaaggaaatgataatggtcagcctctgggtttggttgtcgtttgcaactttgcatcgatagtagactaccaggataacaacaaatagatggcaccaataaacaacttgatcaacctgcatgaacatatgagaaaagggaatcaagtagaatgccatgatattactgccaaataatcaaaaaagaatgtgttcggttgtgtttgaaaaaaaaaagtaatatgataaaattaaagttgcaagtcttggcaaagtaaaacaacagaagctgttttgaactatactgagctcagtatacatacataattatccgtaatctgtttcagtgagctgaaaataaaatgagtaaatagcacatactatagtgtgctttaagaagtaaaaaacaataggactaccttttttgtgtgtgtttgtgtatgtggagacacaactatttaactgaatgtattttttttttcatttacagcagtaagcaatttagaggaagggaaaaaatatatgcatcaatatttcctgtatttcgtgccatccaatgcagagtttgagaccatatgacatgagggtacacaaaaatgatgaacccatgtatatccaagggaagatcaacaaataataactttaaaagaaaattacctttgtatttaggtgaagaactgcacactacagtgggaacatacaaccacacggaagaagcataacacatcatatatctctcaatttgatgattttgggcaccatgcactacaatctggaaatagtgaaatatatagatgttagaccaatcgatgcaagatataaacatagaaacatagcgatgagaatacctggtaaaattaagcacgttgattcgcgatatcgctgaatatttcagtatacacgacattatgtgggatgaagcaatattatcgaattagtcctcaacgctgaattagtcctcaaagcaatattatcaaattagccctcaaccaccaattttgacatggaagccatcaccacatgtaattgcagatagtagcctcacatcacagctagcggcaactgcaggaaacagatcaagcaatcagggtcaggcagagcaaaaccacagagaaaaaaaaacagggaaaattagagtgggatgcttaatttcttaacctttacagatctctatgaattgaacagggattgggtactcaggtctgatatagggggcattcatggcggaaagacttcatggtacataaagaaaagtaacactacaaaatatagaacaaaggctaacaaatttatgacacattggttgttagctcacctcttatttgttttgcctaatatagcggcctttccctcacgttttgactcacaaagaatatattcgacaggacatggacatgatgttaaggctatgcactcacccaaatcgaactggttcttaacactattctcatgcactgatgtctggtctgacctagatggatttaaaggaaacatgaataattcaagagatagaaggaaatacatggatagtagcagcacacacagctagagtcatagaagctagcaggcagtacctctgaacccccaacccctgggaaaaaaagagcacaaattacagatgcaaccaatgggtggaaacgatcctcctaacacaccatcggatgttctatattttgtatcttgcttttgcagaacttccattgatagtctaatttaaattgggcaacaaaataatctgtcacaacattgatatataagtccattccaatttgagctaaattttatatgtaataatgaaaaacagcatatacaactattttgcatcataactcataaatttaggtgcagtccaaacatgaatttcttgatcttagtttagttctcttggaaactactgcacaatgtagccctcgagcttcggaggcctgaatctccaccaggtgtcctctaaaaaatgtgactactacataacattggtttaactaaatggaagcaggtcagcagcaggctgagtggaggagacgcagggaacctggtgtagcagcaacactacatgactgcaaacaacaatgacggggaagaactacatgactgcaaacaacaataacgggaagaaataggtcaggtgcaggaaggagaggattgaaggaggattaccacggattgggctctcctggaggagcctgagatagctggagctgcagcaatggctacgacgacccgatctttggatcggttgtggggggaatcgaacttgaagggacaataaaaatagcttggagggactatgaaggatcttctagaagtttcaatgtggggaggagcttcgagggtggccaggagtcgggctcagatcggcagcggcggcgaccatctcgtcccggtgacgaaggcagcttgcccagtatatcgtagctgttgcaaccgccaccgccgtcatcgccgtcagatccaccacgggaagccgttgccgcgggtggatcgggccgggggaaaccgccggcaccgtcgtcgccgtcggatccaccgcgggaagcggccggcgccatcggtgccgcggcactccacccctctctcttgttttccgctggtgccttcatcgtcttcgcgccgggtcggtgagacaggagggagaggaggagagggactggcgacgccggtgaggggaaggcgcggcgtgattacggctagggtttcgatggacggccaaaacaactcgcggaaggatcggacggccaaaattagagtgaacagtggaacagtgccaggctgcgcaacaccgagccgtacctcaccgaaaactagagttttttttttctatcaaaaaaaaagaaaactagagtttttatagatacaatctggtaatcacggagaacaaggaaaaggcttattgaacataccacccattttagaaaatactttgaggcaagtcaacaaatatatcagagcaagcaacgtagctgggataagattgttacgaaacgcattgtccaacaaaatcataattgtgatagaaatacaatacaattaacaacccttgttgtggcattgcttaatgttatttgtcattatgagtttggattgaggcataagtttttgtagacatttaagttttcagaaacatctgctactgaaataagaaattacaagttaattctccacgtgtcatgcattacttagttgacaaaacagtccatattgtcagtatggcagattctacattcattttctagatttctctatttgtattgtgttcttgtccatgtgtgtttgtcaccattagatgcaaattgaacagtacagattgagattgagatgatattctaatcatgtgctgatgcacctttatttttgctcatttatacaggatgaaggaggaactaataattcatatgaaaacatggctagatacatgtaatatttagaactctcttcctttgtacattctattatccactcgttcttgtacataaccttctatgcttcttaatttatatgatcatctttaatagttaatattaccttgtggattcagcaattggcacaagccattgcaacattctattcatttcagctctgacctcttcttcagatgtctacgataaaatattagtactgagatcaaatttgaaatagatgaatactgtatgatatttctcatgttgagttgttgtaaaagagagactaccttatctatggacaaaaacggcttcaactttctataaaatactaatttgatgcaaggaggaagcatttggtataatgcatctttagcttccttaggaacagacttcaagactgagggatcggttttctcaaaggccaatgcctgaaaacaatgaagtcataaaaaaatataggacaaggcataatctaaagaaagaacaatgtcaatatctgaccattaagtggtaatttaatatcatttttcatgttgaagatggcatagcaccagagaaacagtgatgtaccagtttatttatctgcaaaataacttttgaatattgcaaggcaagtccagtggaacctaacgtttccccaagcaggttgcccactgcctctacataatggtcttcaccagtatgcaaaaaaactttgttgatctccaaataaatgagcagcacaatgtctacaagtttttgtacaatctgcaacagaacatatggagcattattgtaagatatggatcagatagaacaaatattgatgacatatcaagatgttgcactacatcatccatcttcttggaccaaagtgacttcttctgcaggtttgccacagcaatcctttggttcttcactgaactaattgttatacctgcatacggcagcggttttattgaaaccggcaagagaatattcacattaaatttgtatcttatttggatgcctatgtcaaaaatttaatacaaagttacaaaccactttgtaccactgtaggtttcccctgttcgaacttgtccaacacacacatttccttatacagttcctggcaattaatagaatgagagaacagaaaaggcaacaagatttcaaaaagacaattatcatgaattagagagtatgaatcactgaccatggtgtattgtgcacgttttaatagatattgcattgcagaaactgcttcttctttgctgcatgccagttctgattccaaaataacgtattctcgagatttgtaaagtagctctaatctacattgacaagaagagcaaaaagggatacatgaatggagatgaatcaatgagctccactataaattagctggtaaaaattcatggtaaaaagttgtatttgcagggtcaaagtagcagaagaacattatgttttgtttacttgttaaaataaagatccaagttgcgccatacaggatctttgcacagctttccaagcctaataacatctaaagcaaatcttctcaactgttctctgcatagtttgcagtaaatatatatataagtaatcttggaaagttcatctacaaaacatccacatgaaaatgcatagcttaccttatgtcagcttgatgaataatgagcaattgatagtactgttctgaaatcagagtgcggacaccttcacactgaagcacaacttcattcagatgactcacactttcttcagagagggatttcataaggtttgatccactgacaattgtgttggccacctcaaaggccaggatacctatttttctttctccagaagcagcaccatcagatttcatcatatttgagcccctgacaagtattttggctactccaaaggccatgatctctatcatacttcttcttgcaggaacacaggacacggcggcggtgctttcggtgttcgaagtagatgatctagcccccagcatgctgtcaacataggttgcagcaatgacctgctttgcagtgtttgaggtcgatagtccagtccttgctatggttaaatcatctaataagtttgcagatttcatggtgaacatttgtagtgcctgtatgacaaagatgtgtcatacttagggatcatgatttttctatatgaagtataatgtgattggagaagagtaaattacatgcatgaactccagttgggaatgcagattttatttgtatgttattgttcaaaatcaaggtgctggagtcattgaatgacagttgtacaggcacataggaaatttccaaaggaagtaaaagaggcacttcaatccataaaatattacaaattaaataaatattttaattttacttttaaaatacttgctaatgcattagaatcttttgaccgatagaaagttatattgaaccaaatggtgcatgcaccagcacaaaaaatttgcatatatattcactccaaatttcctatataatttattgatgtagattataccagcaatttgcacttccgaatttgtgtgaagatgataatatgtgtgtaaatataatagtatactgagacagactacattttatattatgatgccactgtctattttgtaatttacaggaaatatcatatatgacaaatttatagacattttaccatgtgttctaacatatcctctattgaaaaattcgatggaaatcgttatgtgttaagtgtaaactatagataccgatgcatgacactcgcattataaaattttatagtttattttacaattgcacattactttttatagtgctctagtaactaacatattctaatggtcaaactcctatgttcaaataatctgcgataacaagtactccctacccaaaataaatcaacttttgtacacaaatctgggcatagctatagttttgtacactatgtaatcaacttttgtacatgaatctggacatagctatgtccagattcgtttacaaaagttgatttattttgggacagggcatattatacaaaatatgagcgccaaaaaccatattgtttctattttcatataaactaaaagaacatccaatcctaccatatgattagtttgatttggagttcctgtggacattctatctttacagaaactgaaattataatcatccattcccaacataatatgatgagctctgttctgtgcagagttcctgtggatagtctcttatgtttccatgggctctaaaactagctctatgtaacaaaaagaacgcttgttctacacctaaatgtttttgtagataatggaagataacatccaggatctgcatcacacaaccattctatacctagttttagcacaaggaattatgatagagcatgggatgagtaatcttacctggcctacatgtgaccaatttttacactctgtttcgttaagcttttggattacatttcaagcactaggccttttctttgggtcaggatcaacacaagcgagtcctatctccatgcatgtgtatatttgttggcaacaagtcttcattgatgtgcatcccactgttcgttccaaccaatccctccaattcttaactacctaacaaattttcatagtgagaaattatgaaaacactagcttaaaattaaattcatcttacatcctctatgaaatgctggaaagattctctggtgcatatccgaggataattcctgtgtcctgttataacctcgatgattatcactcccaaactgaatatatcagatttggttgagattaatccattggccaagtattccggtgccatatatccactacatcataacatggaagttaattagaaatgatacaagaactaaacattgcagtatgtacttgacaaacttatgtagcagtagcttacagtgttccctcacgacttccagtgataatccgtgattgttcatggccgaaaagccttgacataccaaaatccgcaatttttgggcccatatcgtcatccatcaatatattttcaggtttaagatccaaatgaataatatggcattcctcatgaatgtattgcaagccctaggaaattcccctgattattttgtatctcatgtgccacccaagtccataggattcagctataaaagtatatcaaagcacacgcacaagcatacaatcatgtaagaataagatcacccaacacttgtattttcaacaatgccacaatatttataatctaaagtgataagcatgaaaagagagataaaaatcattattgtaccagaaatatacttatcaaggctcttgttatgtagatactcgaaacaaagcaaccgtcttggcatttcaaccatgacatatttcttgccattcacttgcaacacttcccaccgtgattcagcacagtagcctgtaaatcgtactatgttcgggtgcttgagatccataaggaatgtaacctcgttctgaaatttatcatctttcaacatgtgtatctcgaggagcttcttcacagcgatcatttttccattgctaagaattccctgtttatataaattgtctttcaaatcttttttttatagagaaggaatgtaacctccttctgaaatttatcatctttcaatgtgtatcttgaggagcttcttcacaacgatcatttttccattgctaagaataccctgtttatataaattgtctttcaaatcttttttttaaagagaagggtatttttttacccggcctctgcatccaactggatatatgcagccttttttaaattaggaacttagccctcaattaacccaatctgaaattcgctcctatgaagatttgaactcaggaccttagggtgttactcaggtcactgcaaccactaggctacatgcctggtaatacttggggtctgtttggttccattgcccagctagcctagctgggtaagggcaagccaactcgttgccagcttgccaggcttgccatataccctttgtttggttggtgtgctttctatggcaagaattagtggctagccgtttggttgcttcaacgaatcatctttctctttagagtattttgtgccgcttcttttcatattgagaaaaataatattgcacacagatcaaatttttttaacttatggctttgtcacaagaacactacagattcttccacagttaacttggccacaagaataatacggatagaagtagtaaaaagggcaaagctatatgctaaaagaattccttgaaacaatcaaacatctttttgaactactttattacaagttcgaaccaaagcatatcaattatttaaataatatctaaagtgcatgtttcattcttaaactatttagcttgaatgcatagtaattattcaaacatctcagcaaagaaattacatagcagctggatagttttgtattatccattgggtcacatattccttaat

SEQ ID NO: 81938 - DNA, 18053 bp, Oryza sativa
  unsure (1)..(18053): unsure at all n locations
cagccactctggcgccccaaaaaggaccattttcggtttaagtttttctaggggtctatttgtaaaataagttttcaaaaaggaccaaaatataaaaattccaggttgcctcgtaactgttggttgatttttattatctaatgccggttagttgggataagaataaaatcttactggtttcctttcctaacaagaatcaataagagataaagtctatttttgtgtgatcggtacaaaaacacattcagattctaattagagataaagccattgagtcccaccagtgtcctatataagaaagagtagagaaaatagaggtgacaactgaactctctctaaccctaaaaccctaaatcaattcgtccgatcgattttgaaccctaaaaccctaaatcaattcgtccgatcgattttgacattggaaggggttcgtgagagtttccttttcgtcaaccggagagcgtagcagaagaggagtgaaggagaaaagcaaaggaataacatcaaaaccacataccggtttcaatggcttcattctcaagccagttagatcgcccatgtaattaagcagaggtgattatgtttagactaagactcaaagtaattaagaagattaaactccaacagtaaccaactccatttcctcgcccctgtcgtcaaccctgccaataagcaggttagcacttaggccctgtttctttcggtttgagattattataatctagattattgagtcagattactataagctagattgttataatctgtagtagaataagcggttagttgtttctttcctagattattagagcctaaattattgggtttgcaagtctaaagagagagtggggtggtatggtgggtaatttttcactcaataatctggaaaaagctcacctaaatgagcttatcagattataataagttgggctccagattataataagctacttcaataagttgtatgtttctttcagtttactcttagtaatctggattataataatcccaaactgaaagaaaaaaggccttagcaccctcggctactatgcctcgtcgttgcaccgccaagaacagcaacaggtgatggagagagatgaaggttgaagaaaatacaagagacgttggatatcaaaccaatggtgagattcaatcgactatctccttcaatcgtctgataaataggaaagccgtacaaataatcactaaataggaagaaaactaactaaacaacccccctcctctcttaaaaaaaacagtgcaagtttgttcgcccccaaaagaaaaaggaaagaaagagaggaaaatttgtaccgctgcataattaatgtgaaaaaaaaagaaaaaaaataaattttacagactcaagtgtgtaaccctcttactcatactggttgttcttgtgaatccagtagtacaggcatatgtacaacaaaggtgcatgattgcatcccagggcctcacttaataagtacaagaaacaaacaaacaaaaaaaaaacagagaaaaaacaaaaaattacactcacctagctaactaagcaattatatgccacacttgctgctgatggtgattaaaagctccaggttgatccaccgggttaactaataattaattaaaccacccaagctaatcactaattaggagacagtaattaattaaaaaaacattctgtccgtgacgtcacttcttcttggcgatagcgccgccgccgccgtcgtagcggcggctgctgctgccgccgccgccgccgctcctcacctcctccggcgcgatgaacgactccgggcagaggccggcgacgttgaaggcgacgtcgtcgatggtccacgcctcctccatccgcgtgacggcgcgggcggcgccgacgtcggcgccgaagcgggcgaggtgggcgacggaggtgcccgcgtgcgccaccacggcgccgtcggcggcgcggtagtcgccgaggcgggaggagacggtggtctcccagtacatcgccggcgcgccgggggtctggatgcgggtgagctgcgagtcgtcgaggcgggcgaggaggccgctccgctggctgaagtagcccgtcatgccgtgccggatcacctccgccgcgccgtcgccccaggcggagagcaccgacggcgccacgtcgagccgcagcgcgaagcagtcctcgccgtcgacggccttctcgccgacgtgctccgccgccgagaacaccgacgcgatcgtcaccgggtccagcccctgcacatgcacagccatgcacacatgtacgatcgtcagcaccgacacttcatcggcatgcacacgtggacgcttctcattggtgcagatgcattgtctatattctactcaatccatcctaaaatataagtaattatgcttcagattcatttcagattcatagtaataagatatttcattcaaccaaaatctttaggacactgacgtgtctacgatttttctatgggtggtccaaattatatatatttttcaaataacctaaatataacaaagttaaaagtataaatggatcaaatgtacattataatatattaaatatgagctctttttttttctcaaaagttttcttttcacatatatgtatatttatgcattgggctaggatttttttagtggtcgtatgaccaccgggatcatcctctagatccgcctatgctttaggatggagagagtatccgtttcatattattataagatcttttagttttattccaaagtcaaattttcttactttcaccaaaattatagaaaatgcactaattgttcaccattgcattgcattattttgctcctatttttcctgtagttttaaaattttgttaggtaaactcattgatggggcatcaattttgtttcataattaaagatataaaggctcatggcatggcctttttattagacatctagacagattcattactgtggtacagtgttcatataggatgccattgagccctatgaggatgaaaggtgcttggtagtagcatctttttggagtcctatgtcctagaactgttgttattgagaaaaggttgatgtccttatgctgttccaaggacatctctgctctcttatggatgtaaatatgagccataaattcagaggcaagaacatgcaggtgcagtgtattttattgtgccatgggagacaaaaaagaatgctgtgtgaaatagaaagccagtacacttgtatgttgtatcaaacacatcatgcccaaagctcctctcttttcacagtacaaaaacagctaagacactctaggatgcccactgatatctgttcagcagtattcactatagtacagagcatccagcataggatactgttgagagtaacccccatccagtttcatttcacacacttttgccagagagatttggtgaagtttggtgtgttggcaattatacagcatgaccagcatgcagtgctgtgtgattatgtactaaattagtactaacctgacatggggactatgatgtgttccatctccattgttgatctgggtcagctaatcaattgccagaaaggtacatctcttaatgatacaccatgcatgtaaatgatcccagttattctgatagtctgattgggtttcagaaagactaagcaaactgtttcagtgtctataaggaaaataacatggatgcagactctcactcaaagtggtttaacatgatgtcccatgttcaacagaagcttaactttctttgccatgctgatgtgaggcagcttacaaaaagtctaaatcaattgacctaatagaccaaattggtgtaacactcaggacagatacacctacttagatacgcactgctgcatcctaaaaatatttaaaactatttgataacatgaagattttcagaaatcagaatgcatgagtggcagtgcatccaattttcctactgccaagctgttaaagctgtactagccaatcatagtagctagagatttcaaaggacaggtcagtggcctaaccataatcataatccatgctcttttatttggtcctcctatgaggaccggataaaatggtttttcaactagctatctcagcagttgctagaatatccagatatatattaaaaacagtactagtcgatcggctaatggtatgttcagatatcttggttaactttcaccaaagaagaatgatactactacttggcactagagtatcatcaatttcagacacagatttatactagcctcagtttgccaaattgctcaagatatatgcctcaaaagccaatcttgtaaacagacgagtgctacttagaaggaagcaaagtctgcggactctgcatcctcacagaaagtttttttcaagagtatctcaagagtgatctgaatttttttttcaggaaatgaggggcagcagcctcagatcccgaggtgaaacagtggaaatgaaagaatgccatatctgcacctttattttcagccaaagattcttctttcacaaatgctccccaattcttcaccctctttttttgcgaaataatactcccacacacccagcacacaaattaaagcacaaaaggcaaaggcgaattcagcaaagcgatccacaaaaagaaaagcagcgatttctacgtacacgctcatacacctctcacattgcttttgggtagcttcccagtgtactccgacatacataaatttcagcttaaatttttgtctagagatacttgttatttctcattcaaaatggtttaaatgttttaaatatatatacatgctcacattttttaggataaaggaagaaacttttattgttgaacttggacaattatatcaaggcaacatctacataactaagcatacagccaaacctattcgcatcgttctccgaaaaagagtttacatcattgataaaggaataggtttccaaagataagatcacctaatgtatgtctgtatgtgcttgcaaaattatcaggtattttggtcactttttttataaaaaaaatgacatgtttttttttttgacacattggtaatttctattcgccattcgaacaaaggccccatgtatatatttgaagaatacacatgaagtactcctatttattttcttatgaattcctttgtacgttacgtatgcttgtacgtacaaaatgtatgcgtacgatttttttttttcgttttgatttctttcggtttagacatttataagtctagattgcaatgcaaactaatgcaaaactaattatttttttgcctaaactgaattttaatcggattagaggaggagctaatcagaatggccaaatggcagggacatgcggggtgccaacctggagggctcgccggagaggtctcgcgccgccgccgcgcgcggcgtgggcgtcgagccagggcgtgcggcgccacgcgacgcggccgtcgcagccggcggcgacggcgtgcccggccacggccatctcgacgagccacatgtccggcacgagctgccacactacgaagcacccctcgtgcccgcctccgccgccgccgccgatgccgatgccgccgccgggctccggcgccatggccatccgcaccctccccgccgcgtacatgctcttcgccgcgccctcgatcttggcgcaccccgtcgtcgcccggaactgctcgaggatgtactgcgccgacgacgccacctgcacgacacgacacacacgcacgacgtcgtgagcgcgcgtagcacgaagaggaagtccggcagagcgagacgcggcggcggcgacggcgagacgtacgttgcgcgggtggcgcgggaggacggggacgggggagagcgggcaggcgaggacggagaggagcacgcggaggtcgggggaggggcgtgcgtctccgccggcgacgccacgccttcgccacctcccccaccgaaagaaaccggagcgggatgcgcgcccgcgcccagcggtggagcgccgcgtgcaggccggtcttccaccgcgcccgcgctgcttcctccccgccccccggctcctccgccagcgtggccagctgcggcgccatggacgaacaccttcgttgcctcagctcagctcagctcatcacttgtgttaaaaaggagggaagagaagagacaagggggagtttgacagtgtctggatggtgggcccgggggaggttgggttgtggggcccactggcagggagggtgtgactgtatgcctggaaggtggggcccagggctttgggagagctttgaagggaggcaagaggattgagggggtcgggggagggtctaaatcttgggtgtgagaaattggagctattttagcactaaatgctggtatgggataaaacattttgatcatgttttttttcctactatttcaacatcgattttttacggctaactattctttggtatgtcatgtacctgctgaaaacaaagcgcttatagcaagttcgtcaatctattgatatgctggcccaatcttttagagaggcttataagggtaggaataggatgtatgaaagtatgtttgtggggtgagtgtgcatgtatttatataaacgtttgtgtttgtgcttttttttaaaaaaaaagaaaatatacaccagaaaagaatttcttaataatttcatattatttatgtatgcaaattcaatgttcaaagttttaatgacagtgcatgtttgcggataggggtaaaaatatttttaaacacaaaaataaaaacagtgtacaatctaagacaagggagaagcctaagaagaacagtggatttgacagatcaaaactaattaagcatgaagtccatgaagaataatgagcaacatgacatttcggtttagcaacaagaacttgctgttggtgtggtaacccatcctggggtgatctgatggccacctgacctggagattacatattgccaaatcgttgatgattcctctcaaatcatggcattttcagaatgatctcatcttctgaattgaaggccccatcacgattcccaactactgcattgcattacatggcatttcagggccttttatttttctttttattcagatgatggcgacactgcaactctttttcgtagctcatgtgtagtgtatgtgagatggagaatgaagaggagggtattgagggtgacatggcaaccagatgtgtaataccttacctactactagtattgtttcctctgtatttagcatgcattggtagggttttttttttgtactggagaagaagaatccaagctttgatctttttgcattgtgatatttcagaacagtattgaaaaaaaagacttttagaaccttgagctttcttttcttgtttttggaaccaacttgagccatggagatcaagacctgaagatgaaaagaatgacaacttaccatctgagttttgagctataggtgttgaagattgatcttgtcaggaaaagaactttcagagttacattccaggagttagtgtaaatgttaagcttctgtaaaacaattagctgtcttatttaacagctgagttatgaccttagtaacaggatttactgccatgttaattcatgggtcctcctgctctgctatgttagtagtatatatctatgactgcttcaagacccttttctgtggcatttatcatgatcctgtggacctcaagtacctcactggcaagtcaatccagacctttatttccccagcttttctggttcccaatgattttaagctatttgatccgtgcactgatcacatctgcatagttatgtcagtattaaaaaccatggcttcactgttgctgaacccctgatgcatactcgttcgtttcaaaatatagctatttcttaaaaaaaaaaattcacggagattaacaagataggtaaaaagactaggttatcctttattaattatcccagatggtgggatgtgggtgggggttatggaaatgaatagtattttgaatatttcatcactataaatacctattagtagtttataagtagttatattttaaaacaaaatttgaacgctagaatatattttaggaccgagtgagtgagtatataatagctgcatgctttactgctggtcatagtgtgccccagcaattatcatttaactgatggatgcctttattttgttcagtcacagaactctcatggacttttttttttctgtattggtattcttgctgtatatccatccaattcaatacggaacaagggtcaagattaggatagaatactttctgattcattacaggaagaagaagaattaaaaaaagactagtagttgtagcttgcaggcttatccaggaaggatttaggagacagggatattttcaactacttgcattgcatactaagcaaagagagagaatatcagtttaagggttactgtcacaactgatggctgggttgctgtcacttgagccctctcatgtactgaaatgaagccacatggccaaactgttaatgaggttgtttttcatatgatatgatttcttttataggttcagaactatgataacagtcttacaggtggctgtcattttcattatgcaaccagtgtttgttggcaggagaataaaagtcctagattgcattgaacacactaatccatttacttgagaaatgtgaatttctgaaaaaaaaatgatatgcattcagtctcactgaacagaagaagaatttatatatagatgatcaaatcaagcatctattcttatgttcataatagcctcatcatcaggatagcactgtagttggatttctctgttatcatcactttgacctgacattgtaacagtacacttccaaatttgagtgtcagacatctctttccctgatgctattttaagctggaaaaattattttggctaaacctccaaaagcatctgttggagctgacatgataagccacttctttttatgagcattgccatgctaatgaatgaattaattgttcctaaatttgtgacctcctgcatcgatttattttgtgtagttatgatgtgccactttcggttattcactctctcaagcaacccatagctgtctaattgctgtccttgaattaacctctggaaaaaaaaggacaaggattagagacagcattagaaaggtagtctctgcttcttctgaaaagacaaaggaaagggacaatactaactctgtagaattactgcttccatgcttgtctgatcatggccactcattttgtttaacttctaagcaattatgcaagctaatgttttcagactcaatgtcacattttattttccttgacaaaggaaagtagaaatttttcacctgctgaaacaacctttttagaacaggcaggatgtaaaatctacatattttggagatatctttacttgcaaaaagtccaatcaacaaatgtcctagttgtgaaaaagaatagataaactcttcagcagaattggaagctgggatgctgacctggaaagagtttgagacaatttcactagggaatatttccttcaaaaaagaatttgagacttatttccttatataacttgttcaatgatcaagtactacaaattagacaagaaaaaataaataaatagctacaaagttttaagaggtcatctttgtgtaggcctcaaattatggcccaacaggtaacaagcggggtgcctgagaagacttgaaaattgaaacttatttaatgggctgaggtgagatccaagcccaactcaatttcacacaatttgatgtagccaagagatgaaattgtcagcccagtaaccatagctgaaaaagatgtgttgtttggatggcacaaacaaagttgaacaaatttatgcagcatggattttttttcccatttagttaagcctaaataatcaatccaccaaagctgaaaccacaaactgcaatctgaactagtcatttcagaaaaaacagtaatctaacatgcactctgaacctagtcacttcaaatcaaagggttaacatcttggcccttttgttagctcgcccaagctgaagttctaatctaacatggtaatgacacctgagttttgttagggcctgtacatattggagaattatcactgttcctgtgaaatacctgtcttcttgcaggcagcattttcttcagggcagggattcagtccatccctatgaaggtcgaactgacacatatcatgagtcatgaccgagatgtgttccagttcatttttatcttaatgaatgaatggattatggttatctgattttgtggtaatattttagaggaaaaaacgaataaattaactattgctgtttaaaaaggttgttataattaaaatactattctatgaaacgtaacttatatatagaacttctgaaaaatcaaaccatttaaaactttggaaaacatgctcatcataatctatctagtatatgtatatatggccacctatttttatgtcaagctaactccatgcagcatccgagccaagagctctgagacggtgagacctgcaggaccaagggtagctaaaataagcgaactgagcgtagctggtaaggtactttgtgttggctgcttactcctagacttatgtggatgtttgtatttacggataattattttttcagtggtaagtgacgtacctgttaacagtgagacacgtgctaattttgtctatcttaatatatgttggcccggttttcgaatgtgctcatagagataaggtatgtgtttcgcaaaaaaaatatatatatattaggaaagttatttgtgccatcgtaaccaactccagcaagtcttgtaaacaaacccctcaaacaatttttagggctagggaaaaaatgaaatcgagcctagagctctaaaatcggaaagcccctggcgctatatcctaccgtacatacccccaattcccaaggctctagaccacagcccccattctccgtttattcacgcgggaggaaatttatggtctcgtgcctcccactcttcttcaccccatgcgagagccaccacactgtaggccctatctagccagtggcgtccctggcttgccccgtgactccgctgccccgagcttggccaccgatgcctgctccgattgaggctgctgcctccctgccctactttagtggccacttcaccacccctccttttatttgtccgtgcgccaccaaaaaaatggattgggtgtaccgctgatggatctggagatccccatgccatgatgccagtcctcaccttttggatgtccctaagcacccctaacgtcacaccatcatctccattcccgagttggaaccctagcagaaaccagaatatcgtgttgccacctcttgcacttgatgacctcggtgatggcgtaccacgctcctcacccagaacccctaccttctccatatggcactgtcctagcaatcgctcatcgttcgacaattccgcttcgctgccatgcgtatcgtggttaccgtgccagcatcacataacgtgcatgtcacgctacttggacttgtgtcgctgacgtggggatcctaggaaataagggtggtttcttggatttggtggagtcactttggccctcaagaaattggggtagacccctatttatcttttaggactgtaaaatagggctatttatggagattcttagagttgccaaatcacatatactctctctctctccatgatgtcaagaaactaataggaaataggtaaggggtccataatgattccataaagccacagggcaggcaccgaaatggggcttatattagcagggactaagaaataaacgttgtctactgaaattggatactgaaattggatgcctcttagaggtcttaggaaatagggacggccctcatttagtatttggggctacaaaatactagtgactattgctgaatatgctcatattattatatcgctctctcttttcaccatcatctcaagaaactagtaggagctagataacggatcataaatgatgaattcataaatccacaaaaggcaggcaccgaaatggagcctatatggctatatattactgcccatggctcaccatcacaatcaccagccagtcaggcacagtcatcagccgtgtagatgaaatggagagtatgcaaatcaccagtcgccctcatagatcacacccatgtctcatctcatcctcatcatcttgcagatgcaaatgtatctagcatcgatcctagctagctaattaacctaatcttcctccccaatgaacttgcacacactgcagtagcatcagtgatcagtgatcgatcagcttctgctgggcccctgcatatgtctgtctttgaggtagccaacgcggttacacttttactagcaccaacaacccaagaacgaactgcgaccggatgcttcgtttcagtgctagctattagcttcactcgatcgtcgtccagccagctgtggctagctcactctcacttgatcatcaggagtcaatattactcaaccttcagttcagcgtgtgcaggtaggtagggtcgatcagcctagctataacgatgtggcatgcattattaggcctcgtttagttcccaaaacaaacatttttcacccatcacatcgagtgtttggacatatacatgaaatattaaatgtggaaaaaaaataattacacagtttgcgtgtaaattgtaagtttgcgtgtaaattgtaagatgaatcttttaagcttaattgtgccatgatttgacaatatggtgctacagtaaatgtttgctaatgatagattaattaggcttaataaattttaattttataacggaatctgtaatttgttttgttattaaataatatattttatacttcaaattccgatgtgataccccaaaacaaaaacttttgggaactaaaccgggccttattcatcggtgatcgatgcaatgcaagatctctagcttgatcacccccactacccaactaataatgcatttcgatttgatggttccctatatggacgatggattatctgattttgcgataatatttgagggtgcaaataaccaagttaacaattatagagttgaaaagttgttcttaaatgctattctacgaaacttacacatagacaaactttttgcagaaatcaaactattttagagagcttgaaaaacgtaccgtacgtgataatttatagtaatctgtaaaagtaaaagaatgtatccctcttcgctacaccttattcacatcttgtacaaacaaagctataaactgcataataacaaaaattctagtacatgtgtgtcaacatataggatatcccatctgttcaggaatatttgtctgttttgaacgagagtagatggactttgacaattatccctttaagcaacttctaagaaaataggtttaaatgtaatacgttggtaaagaactttaaattacgaatatattgatacaactttgctgctaaatttctctattatttaaaagaaattattttttgttaaaactagacaactcatattcgaacaattattttaaaagtaaagtgtaaatcttttttggatacggcacagtttaggccaaagataggtgacagatgcaacagaaaatactttttaggatgagatttttgcgcttctactcggagtgatccaaaagccactaagtacagatccttccatctgtgacggcccataacaagactggaatttgcgggccgtcacaaggaagtaatctcaatcgggccgaagtttcgcccgattgagatatggtcgcacagccatggtatatcggcataaaactaaagctcatcatggatgacacttatctgtgacaggctatagttgagacccgattgagacgagggttccatatctcaatcgggccctaaaagaagcccgtcacagatgagggtcatctgtgacgggctccaactagaggcccgattgagataagtttattgcccgtcacagatgacactcttttttgacggcattttattaaggcccgatagagattacttgtatgctcgtcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcatgtcttacttttgcaatactgatcttataatatgtgcctctaatttgttttttttttgtagcaattgatcgaagttggatgtatgccaaaaatttgaaacgtcattctacgaagtaccgaaagggcgtaataaattttatgaatgccgcggaggaggatcggataagaagaaacagtgattacatgtgttgtccatgtgcagattgcaagaacgagaatatgtttgatagcggagaggacgtacacggacatctgatacaacgaggattcatggagggctatacatgttgggtgaagcatggagagcaagaatcaggaagtggagcagcagcagacagaagtggtgcgcataatcaggaagatgaaaatgagcatgacatgtttataccttctccattgggcggtgaaatggttgatgtggatcacgatctgctgcaagacatgttacgtgacgttgaggacctagcccagaatgagagagatggaatgaaattcagcaggttggtaagtgattccgagacgcctttgtacgctggatgcaaagcaaaacacactaaattgtcagttaccttggacctaatgaagctgaaggcaagtagtggatggacagacaagagtttcacagatcttttaggaattttgaaggctatgcttcctgttgagaacacattgcccgagacgacatacgaagcaaagcaagttctgtgtccattggggttagaggtccgtagaattcacgcttgtcccaatgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcagtgacatgagtagtactcacagcacttggccagtttttattgcgaactataacctcccgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttctgtaccattaatgactaccctgcactcggtaatctttccagaaaaactataaaaggaaagaaggcatgctccgattgcaaggaacatacacgaagccggtggttgaagaaatcacgaaagatggtatacatgggtcaccgaaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttactggaaagatcttgatgttcgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccatacgagatgcagagacaggtaaagtgtacctccctccagcctgccacacactgtcgaaggataagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcatcacacgatccaacgtctgtgcgccttcttcaatgcaattggacagaaggttatagatccagaagatctagatgggctgcagactgatattgtgaataccctctgtcaccttgagatgtttttcccactgtctttctttaatataatggttcatctccctgttcatctggtgaagcaaacaaaactatgtggcccggcttttctaagggaaatgtggccgtttgaaaggtacatgggagttctgaagtcgtacgttcgtaacagagctcaacccgaggggagcatcattgaaggttacacgaccgaggaggctattgagttccgtgttaattacatgtctgatgccgatcatatcggagttccagcgtctcgtcacgagggaaggttgtcgggtgttggcacaatcggaaggaaaagaattaggcccgatcaagcatcgtacgcgcaggctcattacgctatgctccaacatatggcagaagttggcccatactttgaggagcacctagcgaaaatccgagatgagaacttggggcgatctgatgcatggattaacagagaacataattctcggttcaacgaatggttcaagaatcgtgtgacaatgtccacggatgtcccaaatgagacagtacagttgttggggatgggaccgtcttggaccatagacacatggcaaggatacgatataaatggatacacattttacaccgtcaaacaagatgacaaaagcacagtgcaaaacagcggtgtccgtatagatgcattccaggatcaagttgggtcaaacacatactacggccacattgaggagatctgggagctaaactacgtcaagtttaaggttcctttgttccgctgccgttgggtgaatctacgcactggtgtcaaagccgacaaggaaggtttcactttagtagatctatctaaggtcggatacgccgatgaaccatttgtacttgcgaaacaggtcgagcagatattctacataaaagacccttcaaacaagaagatgcacatcgtgagggatggaaagtgccgaattgtaggagttgacaacgtcgtcgatgaagaagaatacaaccataatcttcatgtaagacctcacattgaccttgacgatgatccccaagagcctgtggcatgtgctcgttcagatcataccgaaggcacaaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttgaccatatttcaatttgaaatcatttagtatttacaaatgctgttaattagatttgtcatattgtcgaaatcaatttcaagctgttgggaaaaaaattatatagaataatgaccaaaataaaaatagtagatcttgaaaggctctacaactttgttgttgaccatatttccatttgaaatcttttactatccgaaaatgtattatgactaataaaatgaattattacacagctgctatatattttgcactcataacaaatgaaagatggaaaatgagtcatcggtgatgggccttagtttacggccgatagagattaatctatctcaatcgggctttgccgtagggcccgtcacggatgactcatcggcgacgggctccatactaatgcccgattgagatgacagccgngcccatcacggatgactca

SEQ ID NO: 81939 - DNA, 82008 bp, Oryza sativa
  unsure (1)..(82008): unsure at all n locations
attcctgcagcccagcgaaattgtccctaacacggagcgccgccgcagccgcctcacgcgcggccacctcctggtcgcgctccacgccatcgacgtggccaccgcctgccccccgcgcggccgcctcctgctcgcactcctcgccactgctgccggtctcgcgcacggctgcctcctattcgtgctccatgccaccgccgtcaccaccgacgacgaggaggacgatggcatcggcgcagcaaccatcaccgccgtggcaggatctcccggcagacctgcttgcgctcttgctcctccacctcccgtccctccccgaccgcatccgcctttgtgtgatctgccgctcctggcgcacggatgccgctgccagctacctcaccgacggctgctcccagctacaaaaaaaaattgtgatttcgggtgggggaaggtggcgccaggggcaatctcgctatttcaaaaaatttctcacctcttttgaccaagaaattataaaatattggctccagtgtcctataaccaattacacaatttttgtagtgtgcatcagccgtatcacgtttttgcagtgtctcccagccaattataagttttttgagtgtcctacagcaaattttgccaagttaattttatctagacttacaaaaagaaaaagaaaataacaaaattatatttatgtgaaaaaaatccaaatacaaggataagtgctctgaacttctgaagctttcaacggtaagcgtggacgacgactccacatgagcttgaccgctccatcactcatcatcgttatactacttaagtgcctcaccgccgcgtgaaaaatatcatcagatcgatatcccaattaattccacgattgatcgatctctcgcgcggtggccaaaatgccagagtccatagccgagaatcgcagcaacggcttcgtcttcgccgtcgtcgtcgtcgtcgtactcgccgtgctcacgctcatctgcggctcgacgacgtcgccgctgccatgcgccggcagcgccgcggtggtggcggcggcgtcgtgcgtcctcgccgcccggcggatgctcgccgtcctgtcgccgtggttctacgtcggcggcggccccgtgatccgccgcggccacgagtggtcgcccccgttctacatgtacgcgagggcttgcgacgacgatctctccggcgtcgctctgacgttgggagcggcggcgttgctgctggccttggcgctgctgttcttgcggcggcggcgttcggttggtctaaagaaagtcgataaggtggagggaaaatcagagtgaggaagatgtaaaaaaagattattataacaattaaaagtaatttgtatttaaaacttttatatatttggtcttaacaataataaaacttctatatatttagtcttagcaataaaaaaactaacgctgtcaaaataaggggcaaaatgaactgcaaattttcgctttaaaaattaattttagcagcagcttactttgattgaagattcattgcccgtcgagtccgattcgtttattgcactcttctccccttaacttcacttccttttgtccatcgatcttgtgatttgtgcgttatgtcacatattagaaaatggcatgtaatgacaaacaaacaaacaatgaaattaagtggttgccatttttaccaatttttttgcggtgaaaacggtcgatcgccatgggaatttggccctcacgaaggtcatatcactggccgactttgggtcatggaccgtgatggaccaacacttttaggctgggcaattatccaaatacctaatttaaagttttttttctcctctaagatggtggttttcttaactatttgtcacttttatctatgtggcatgccaacatgacaaacaaggatagaaaataatgtgggacccagtagttagcctcacatccctttcatttcccctccagcccatagatggcgacggtgagcaccttggcgccggggttgtggtcctagaggcccaccaccttgtagacggaggcggcgatgacctgggcgtggtagacacgacgatgcggatggaagcagaggaattcttggtggcgaggcagacgtggcaagcgtccagcttgggctcgcactccctgcagaggcaacggtggtgacatgggagaagcaacacagtggcatcgccctcgccacacgacttgcacaaccactttgacactgctagcgaggtagcgacggtgtcaacgggcaccaccgcggcgcatgccttcatctcgaagcaacaggactggccgtcgttggccgcggtggcgagggggtcagagtcaccgagaagccctcgacactactggagaccggaaggctcccgtgtgctcaaaacctacggtaacaggccaaaaacacacggtaacgacgttaccgggtgctagtgcacgggaacatatactcggaggcttcatcagtttaccgtgcgcacttcccgggtgttttacgattatgcgcacgggaaggccaaaacacataccgagtgtgctgaatcacacggtaaggctgccgtcatagctggactcttgtgtaacggagctcctaacggaacggtggcttaccgagtgtccttcacacacggtaacatttggtgtgttaccgtgattcattcacacctggtaacatgtggtgcgttaccgtgtttgaagcacccgctatgagaacatgtgttaataaaaaaaaatatatgctatttgcaatttgtttactatatccatcagagcttatttccatcacaatataaaccaccaacaagcacacaagagcacaacacattccaacataaatatatatttcagtaaagaggttacaattaataattagcatacaagcaattcatggttcatgtcagttaaagcaatagccaaagttacaatagctaggaacatattatttggttgatgcaaggggggtggcggcggttcggtggagaaccagagtgggtcagaggtggcttgctagggttgaagtgttctatatatagccatatctgttgatgaatctaagccgtccgatttaaatccattcgaccacagtttacaagcagttttgcttggaaaaataatactattcacacgatttctgtacaaatccctttaatgagaacttaaatattcaaattatatataattgttattaaaacttagtttgtttgcaattgttccaaacaatatcatgtgtttgtatattaacagagtgggtaataacactacttgtttatgtgcaccgcttgaagtcacaccgagaacaacacacaggtgggaaatcctaattataacctactcaattaatctcatccaaaacgatatgtggttttgtgttcgtatttatactcatctgtgtccctatccaagtagaacatgggaatcaagccaggatatggttcatctagttctgttggtcttgactagctagtgcgatcacaactgacgttgcctttctatttaaaagataataatacctttcttgcacttttaaccatccggctctcttctcaatcatttgagccatcttgggtactgtgacatcctagcccaattaggatttggcctatgtggctcctgtgagctgtgtgcgcatgtttagtatcaccttactagtttagcacgagttgaaccaatttacaaggcatcttccctccaaccatgccacttccgggttaacccttttatacgaagcgatgaagaaatataagtcgagtggtgtgtgtaagtgggtccgcccgtcggatgggctgggctacgcggttctgaagggagggctattacaggtacattatctcctacttgtctatgaactcttgacggcgacaatgacaagcggtgatggaccgcaacgatgaaaattatcgagttttttttttggatttttatttttgcatccatccacacacaaaaatctgattttggcatgcagatgcgccacccatgtggaaagaactcttgacggcgacaatgacaagcggtgatggaccgcaacgatgacctagctagggttttcgagtttttttttggatttttatttttgcgtccatccacacacaaaaatctgattttggcatgcaggtgcgctacccatgtggaaagcgattttcacatacacttttgggcaaatggacggctcaaccacacgaaaaaaaggttttggaatatatggaaaatgccttttagtagtgggtaagattaaccaatccaaaataaaaatattggttaaaaggatgatccaaagagaaaacatcggtaataaaagttagcgtaaagtgaaattcaatctaataataataaatcaaaattagttgtattatgtgaattttatcgtctactatattgggagtgtctagattgtagcacacgtcatgccaaatttattttcacaattttcctcattttctatacttttacaacttttatgtgttttttagattttataatattttcctgcaattttcagttatccgtaaaaatattgtgtacagtgagttgtgaattatagataccctattattgcgagttgtattgtctactactctactatctttgagagtgtcgatataaataattttcccttacattttacaattttcatgcatttttttatactttttaaacttttcttttaatttgaaattgttagacattcccgtatgtcaaaacgaaaaaacaggcgggaggattccgctccgttgccgccaacaaaatcatagtgcgtgccaacaaaattcaaagttcgtgccaacggagtgaaaacggaagtatggaattcagtcatgttaccgtgctccaggtggtcccacacggtaacttctctgttaccgggtgtttcgtggtagcgcacgatattgttgggacgttaccgtgttcctagtcctacacccggtaagttactgggtgttttgttaaacccacggtagcatctggttgcacacgggaactttcccagctccagtagtgcgacagcttgggcgggggcgaggcggaggagatggttgagcgtgccgcagaggtccgccacgacgtccccgttgctacgggtgagcccgcaccacgcctggctctcggcggttttgctaaaaatttgtcgacaaattttttgttagaaatctcccagattttccaccgtccaaattgcattatgatttgtgctatctgtccgttacaaccaaaaaaaggactaccataacctccgtgggagtcgatcccatgatctgatgctttgaacgtgaaatattttgccagctgagcaagaaggagcaactaattgtttcaccaaaacaatacttacttattagttatactgtattagttatactgtatgtacatattaattatattattagttacactataattatatatattagttacattgtacttacatattaattacatattagtcacactataattacactatagttacattcgtaagtacagtgtaactagggtgtaatttttttaaaagaaagattttggtgtagttacattataattatactgtagttacattcataagtacagtgtaattagggtgtaattttaatttttttaaaagaaagattttggtgtagttacactataattacactatagttacaagtgtaagtatagtgtaactagggtgtaattttttttaaaaaagcttttagtgtagttacactataattatgtattagttacactatacttacatattagttactgtaattacactatagtatagttacaaatgtaagtatagtgtaattagggtgtaatttttttaaaaaaaaagcctttagtatatgtgctgacaagtagttagttttgtggcttggattaacacgccttaatctacactatacgcgttgctttttaatttggctagcaagttggccgtttggtggttagaaaaatctgtgtgattttataacaaaaatctgtcgggtgttatatagatagatccggctctcggtggtggcctgacagaaccgctcctccaggcctccttcaagagtaggcttgattgatgaataggccgaatacatgcacgcgaaggagaagggccaaatttagttatgggctgaattcattcaaggaaatgatgtgggcaaaggaatatgtgcactttgactcccttaactagtggccaaatctaattcgtgggactcaaagtggacttaatttccgtgggcaaattcatttttggcccattgaaaaaagaatactgctatatgtacaacccaattatacaactagaaacatgcaaccataaatcaatcaaaggaaatcatgtttatatcattgtacccatttacaaccgttgatcaaattcagtcgcaagtgagttggacagttgggtcatatacatagcaatttccttgaaggaatggtcatctttatgtctaatttactgaacgaacctaattaaggttgtgtcttttttgttcctgactcctctctcgttttccacacttttttcaaactgttgagcggttccttttttttttcaaaaaattcctatacgaaagttgctttagaaaaatcatattaatccatttataaaataagttagctaatacttaattaatcatgcgttaatgtaacgttccacaagattagttcccagcaccaaggaaagaacgcaggcttagctcatttacggaggcctgtttagtggtccattcacgacggattcggcccattagctccataataatgatttcgataaatgtgaatctaagacaaaatgtatacactgcgataactattgcgataaaatctaaggtgatcatactaacttaccgcctaacctaaccaggtagctatagcttgtcatgcagatgcagcgaagcttctgttgtacaacgatgaagctacagatcgaagactttttccatcgccagaacagcatcatcctccagcaaatttgaatggtaccttctgaaaattccccaaatatcacctctttcaaaagtttgaatcagctagttcttcagaaagctgccattgctattcccatcttcagaaagctgcctttgctagtgagtggccctggccttggacgtgcccaataggctatttactgcgcacgcacacaggcaataagatatccgcgatgttcaaatggactgaaaaatatgacacattccaaacatccttcatggtttctgaaagtttagttaccatatgagagcaaaacatcgcattttactcattttccaaataaccttaatgcgagggcataaacatccttcttctttgctgatgtagcttcactcaccattttcactgcctacattagaaaaacattatttcagaattaaagaaaataagatatgattgtatgaccagtaccttgtgtgtatttcttaaaaacaaaaaaccatagaaccgaaacattgctgaagacttgaaaggcatcaaaagctaagttgaatgcacaccgctgacagaggatgtccctgcgtcatcaattctctgagttcatgctcaaggaaatcctcagatggagtttcatcagctgaaattaactttccctctatgagcactgtaatttctccctttggctgccgagttgcaaaggcttcatttgcttcaccaatagttccccgccaaaactacaagatgtatgtcaaattcaggactacaaagagaaaataagtaaatacaaatatttatgagtccaccatgtagaatataagggtacagcttggtctacagataatacacaaacaattcagtatagctgattggcatgaacaagaccgcatattagtttcttaattcagagtcaataccaagtagaatctgaccagtagcacttcgcagtaggttcagcaatgtaaagctggaaatgacagcactacaagttaagagtacctgcttatagtgggtgggatataccatctgctgtaactaccagctgaagtatatttattttatttgaagaaacagctctagtattttattgaagattgaaatataaacagagtaaaaatttgttgattacctcttcgtgtaatttcgttatctcccttgcaataacacatgacctgaatatcaatacataaacaaaagaaagatcaacaacgcatgcataacacattagcaccacatacaaatgggatgcagcatagagtgcagtatttcagttgtttatataatactactacaaattccacaaaaagaaattccagatcatgcaataagcaatgatatacatgggtgacagaatatcaattacctagaatcaccaaatgatgaagcagcatcagaaagaaattggtgaattccatggggaggaacatagaaaatttgtgtggcagcttgacaggcagatatttcaagcctttcttttcttgatcgagcatgctttggtaaaaaccccactagaaatgaaatatcagaactaacaacaaatattgttcattgttgataaataaagtaagtacataatcattttattaccaaatgtaaattcatcagttggcaaaccagatgcagaaagagcagctattgcagcagacggcccaggaatggggataacagggattccctcagtagcacatagtctagcctgtaagcaacagtacaacatgcttaacatctcacacatctagaagcagcatcgggctttaaaaagaacagtctctgatgctgttactgctaacttgagtagtgtcaactaactgatagcacatgtagaatgtgcttcaataatattgttatttgcagggcatttcactattagacactattcattgcctatttgtttattcatggtttaagagagtagcaggatgtactattcaaacagattggcaagtatgaatggtcaaaggagtgaagtgatttaccagttccatgccaggatcactaattccaggagtaccagcatcactaatcaatgcaactgcttccccttcatgaagtctctttaagatattaggctctctttcacgctcattaaacttatgaaagctgagctgcaaggtttacagtttagactaagttcaatggcactcatcacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaatgccctgcagcaaggaccatccaagcttaaagctaggagcatgtttcaggaaaggagcacacgctccagttacagcctattactacatggaggtagcctcaaggttcagccaaaacaactatgttttgtttttcctttttcttcttctttttttttgtgcagaacagaaagcatgccctccctgatattttcctcatggtaaaaagtaaaggggattgataaaaaataataataactgatgctaattgtgctatcaaacaattaaagtttttttttctccctgtagagattttagcagaacattgctctatttcctcttttattctaaaagaagtgctgctaatcagctgattgcctattcacaaattttgttaagagtttacaacaattgtataatcagacaagtcccaatactttcgccttttctttttaagtaaaacggcataccactgtcagttctattaccctggtatacccttatgaatcactagatattatgacatagacatcaaaattcagaagatatttcgtaggcgtcagcttgatgaccaagtgttttcccacacaaaaatgtttgcagattgaccccataacagattaaaagctgataccttaaggtgatatcctcgaggttcccgattggcgttgccacaagatacagcccggaatccaaatcctgaagattgtaatagatcaacaacagacatcatgaaatagtcatggacaatctaattgaccaatatgtacatattccccacaaaatacagtacgaaagcattcttgcgttctactccagttctccagttcatacagaagagtagaagacacaagcacctgcataaaaagcaacattccgaacaacagctcttatttcacttgagagctgagaaagttcctcatggtccacaggtacgaatttatgcttgctcaaacattagaagaacatccgctcgcaatttggcacatagtaatgcatgaaaaacacacttatcttaacaattgctaaatgtctcaatactcataaaccaaaattacaccttccacatcacctatgattttagttctacggcccaaaccaatgcgttgttctgaaaataccaattttttttctagctcttctgagatgcactcacacagtgaaaccccccacgcccacacatactgaggccatccacccgtgagaaaactttgcaagagaagtgaaagaaaatcataagctgatgtactaatggagacggagaggtcaccggttccgaggcaggtgactccggcgagctgccagaggcggcggcggtggagaggcggccggcgagcggagccgtcgcagtcgtgacgcggagagggaggaaggggaggcggcggggtgccgttaggttcagggcgagggcctggaggcggagcagcgacgccatgggctgcggcggcggcggcggcggccggagagggaggcgaagcgtcgccgccgtttgctcccggagcgagaggggctggagaagtggggagtagatattgtggtgggcttcgctaccgttggatccgatctggacggcccatattggcccagggtttaattttctgggcctttgcctatttctcccaggtaaacctgcatttttaggatcgttttcaccgcgattttttgttttaataagaagtagaaaatggcgctggctagttaaccggtataggcatatgtaaaaaatgaataagcattcaataaagccgttatatattgtaaaatttatctaaagctctcctaatttgtaaaaccgttatatattgtaaaattttgaaatcctaattttttttcaacaaaattttatgaatattcaaatgttacttacaacttgtgttttatctgatttttgcaatgtaaaaaatcatacataataatcgataccattggacaacctatcaaatattgtcaaccacaagttagcctagccattgttattatgttttacgaattaacattgaaaatctatatgtctgttgacgcacccattcattagcccctattcttgtcactcactaaatatacacgttagtggtgcgcccaccaaattatagctattgtataacgttagtttactattctatttaggaatattatatagtatttataaaaatagattaagttctataaaatccgtgcagaaatcatatgttcaaaatttagttacaataattcttagttgttggttaggatcctagggtgtgttcgggagaaagagttgggaacccctccttcccggcacgcaaaacgaagcttgtattattgcatgattaattaagtattaactatttttttaaaaaaatagattaatatgattttttacaactttcatatagaaagtttttgcataaatcacatcatttagcagtttgaaaaacgtacgcgcggaaaacgagagaggtgggttgggaaaatgggggaagaacacagccttagtgtccacagtatacttttcctcccaaatattccatccggctataaatatttgttatttagaataaggtttgattaaactttgaaaatttaaccatcatttttaaatacaataagtttgacaatacttttaaacgtaaatctacacatacttttttattgagaattagcaaattattgttgattatcaatttttttttaaaaaaaatggaccaaatattgtcctaaacttataatattatgaccaaagggtgtactgaaaatccattggcgcatatatagtacgtccagcacaaattcacacttggatttttaatttctttctctatatctcaagcacatctaataactttacatatttgatatgtgtaatatggtatcatataagttatgtgataataaactttaaggtgtgaaatgatttttttccgtgcaatcctcgtgacagcggagagctagcttgctcaaacttgaagccacgctcacaatgtacttatgtaccaagagtcgaagactccaaagaagagatcaagagaccagaaaagtcttaccaattgaaatgaccacaggtgatgctcaaaagagctaacatgcataaatccgatcacaaaagcgtttctatccaaattacatctagttaataaactaagtaaccacaaaggtatcgtagcatcgtccccacaaggttacaagttaaaaggtcttagaactaatcattaatttactttccaaagtcacagcgcaaattgatctttctcgatcattttctttatcaaccataactagtagcgtcacatcatgcatatgggcgtgtttggttacctacatcaagcctaacttatatccacgtatgcaattgtcaaatgtttggttgcccgcgccctctacaaggcctggcgctgcacatgcatataaaggcctcctgactccctagccaggcccaagaggaagccggaattgagcttcactttagagcttggctgagcgcgtacaagtgcgaggatgagcaggtgcagtgtggggatgcatgagttggtgcagtgtggggagagggggtcacacatccgatccagtaacctccctcttctcatttgcttgcttggtgcctcacgaatcgtcctcatctctactgttgttagccatcatccgtcgccatatgaccaccgtcatcgtcatcaccacccaccatgcaacgtcgatagttgctttcctatcccttctcctcactagcctccggcctctcctcgggacaaacgatagtgcttgagggatgccttggggatgatagatggcctccatcttcttcccgtcggtcgtcgcctccatcttccacgccggtcactaaaactcttcctcaccgatgaccaccgcatttcaagtctctgtcgcccctttttgaccccgcaaaacactggatctagctaatggccaggattggcgccgtcggatccggctcagaggacagtatataaatgttcttgacatgctattctgagttttttttcccaatcatgcaagacatacacatactacacgtctacaccacaagtatacacatgtgaatataccccgttaatacatgctaaaaggactatagatcctaaatctcactaaattattctatatgaatggtgtccaaaaatagcaagctagaggagtagatgacagcccaaggaggcaaagaaagataatcccaaatctcactaaattcttagataggtcattttttcctgaaagcattgaatcataggatcaggatcctatcggattcggattttacaaaagtgcatattttttataaaagatctgtaatacattgcaaaaattaaagcctataacattaatttgttaaatttaattgacctttttactattcacattattttcgatccactttttattaatatatagtacttacatatagaatcatatgattgggatcctaatgagatactacaaccatatgatcccacgagattggtagcatcagcatatgaatacaaatagaataacacgagattaattgtttcggcttgctagctaggatatcttacaatatacgatcggggatcctattaattaacaaccttgctactacttatcactcattttgcctagtagctttcaattgagacagaatcagaaatattcaaaatttcttctcagaagcttgttgttcgatctccaggttaattttcatgaacactatatatcacacagcagaaagtgcagtacggtgataattgatgaaatggtggctttgcgtcgtcgtcagtggtgccacctaactgcatgcgtgcatgtgtgtcggcggtaatcatctgcaggctgcaacaggggcagcaagcaaagctggattcttgggcttcacacgtgcgagcaggcgaagcaatcttggaagcgatctttccatgatagtaagagaaagatccgtggcgacgacgacaccacagctgatcatgcatgcagagccgcaagcatactacctgcagtagttaatgtcgttggaaaattatatctctcggcatggaaatcgagaggaaatccccgcacgcacggctgttttctacccttcgcatgtgggattaatgtgatttaatttgtgaatattttcataattagatgattacgcgtattgattggtagcgccaaatctttccatgttttggattgcccccgatctcccttaccttcatattaataggggagaccggtgtcatggatagatgatgatctctccacgatcattttctccctaaaaatcctcaaaccttatctgatcagttgagtgctagagggagaacgtacggctgttatgagacagtgtaggtggagaccaaaaggtcaccgctactctgcaagtgatcgtcggcgaccccctcgggatcaagctggtgtcttcaccgctacgactatttcccctacactgacaatacatgaggtggttcgaggttctacatcctctacatccacttcggttcaaactagatcaattgtagttacttcaaacaacggtcatttaaaatccaattatgtattatagtgatcatagatggctaagcacttatgttagtggatcatataatctacaaatgtgctaatataattaaactaatctttgtgttttgagagtggtgaatgtgattgctagctagataaaaaggaaaagctgatgacgatttgatgaagctgctgataaaattaaaacaatctagctaagagagtagtgatcgatcaagatgctactagctagctagcttgtctgaattgatttcctttccaaccaattgatctagtatcgtcattgcttcacgagttaaggaagatgaaatcatcaaactcagtgcttcatctgttcatcatcgcatgaaatgtgcaaatgcctggaagaaccaagagagtacttaccagttaccacagggcaagacgaagattgttgctggtgcaaaaggatatcagaggaggtccagatgagctccatcactgtccgtcttcttcctctactccgacgagttgttgaggggaatgaagcctggtccgagaccgtccacgtgtacccaccactgtggtacgatctcaggccagacgacattcctctcaacaagatgatcgaggggaagaactgaaattaatggaggagagaagaactgaagaatggaggaagaagaaagcttttctcctatatactagctagctacctgcgtatatatgcagcaaatgatcgatgctgcaatgcttttccacagccttacacatgcttctttcttcctttgctctctcttgctgctttcacactacacttctacacccaacacacgaaactgtcaactgattttaagttatttcgggttattttatgtgcaattgtgtcaaggagtgcactgtatgtatacttaattaggagatttaatcatgagcaatatatgcttggcaatggaattcagtcatgaggtgcatctgccttagtggtaatcatgagtaatatatgcctcattatctgaaaaatgagtaatatatgcttggtaatgatcatgcagattaaggcagaggagaagaacttcgcaaccaagattctgtggatggtcaactggatttgtaaaactgcaagcagggagcagaaagtcaattggctggttatgaaaattaagcgatgattacgcatattctcggtcatgattaagcatataacacatcactagccagtgaacaaactagaaattttgcagttaactaattagagtttaaaaacattttgtgtatgtctttcaggagtagtgctgcatgcatgcagggctctgacctgagctgatgattttattcgcaagcaaagcgtttggttccttgccctttgcattgcgtttgcatgccgagttgttttgattccaagcttaacactcaagaaactgaccatgaggcgacctgcaagctagctgtaacaacaaagatcaccttttggcccttttttttgtgtttttttcctgcattttttaatgttctcttttgccccctttttttattgatgttggacatgcatgctgcacaaaaatattttcgactaacaagtttttctgttttcttggtatcggaggttcaatacaaaaattatttctttttcatcaagcaaatattttttctctatttccatttatactcagaaaatataacaatataaaaaattatctgtttattagtgttaagcacacagattttctttgctttggagtgaactagaataataacaatagtttaacatgttttaaatttggaataagttcactttgactcccttaaaagtgacccgaatctaatccatgaccctaaaccgtaaaaccggatatcttcacccccaaactattgaaactggtgcaatttgactcccttggtggttttggagggcagtttcgctgacgtggcggtgttgacctagtgttaacagtgaaatttggtaagcccaaagttactttcggtttagagtcagtatcggcttcaaagttctagaatcagcagatgggagtcaagtctccacgatgtcgtgttcttggtagcgtcggatcaatcaaaggaagcttatctagaagagttcgagttcaagaaggatacgacatgacagttatctattaattagtcatagtttgttagttttcttttatctttaggaaaatgtgtttagtgtccgataagaactttatcttttcctttttagtttctttcttgtccgacaaagactagtatctccctataggtataaatatgtacacccggggtcattgtaatctatcaatctatcgatcaataatactctcggcgcatcgccaccctcttccctgaggtttttacttatcttccggcagaacttgggcacctgacgcagggctgcatcggctttcaatctccagcgaaggggtaagtcctacgttctgtcgggccctggtgaatctgtcggctacgttggtgttgttcaaggctgcatcgattcgatctcttggatcgctctggtttggttgatatatttgcctacctgatatctcaattctatctctaattgcattgtgtttagagacgcatcggtttagttgggactgtttcagttaggtctgatctcctgtcttagccgatatatctctacaatcataatgttgttctaaatagatttgttatatccatcacattagacagatctatcggctcattgagtattagattatcatatacaatctcgtgctgcatcggttagattcgatctactagattgttgttgataatataagtcttgttaagccgataggttcatgctaatgttttatcggggtgctagccgataagttatttggacgttgcatcggcttgtagggattgcatatacatataagttggatttagccgatggcaacaaaggtttcgctggagatcgaaagccgatgcagccctgcgtcaggtgcccaagttccgccggaagataagtaaaaacctcagggaagagggtggcgatgcgccgagagtattattgatcgatagattgatagattacaatgacaccgggtgtacatatttatacccatagggagatactagtccttgtcggacaagaaagaaactaaaaaggaaaagataaagttcttatcggacactaaacacactttcctaaagataaaagaaaactaacaaactacgcctaattaatagataactgtcatgtcgtatccttcttgaactcgaactccgacgagatcgagcggggggtcggtggtctacgggctacagcttcggatccatctgcatcgccgggatcagagctcctcgccgccatcctccaccacctccccgcatccatcctcgcatcgtcgtcgcgaggaggtgcgacctcgtagtccagtgcctcctcttctcctctgtccctccacacgcatcagctccagcgcaggaggacgcgggacgtcgacggcggaggcatcgagcaggtcgagcggtagctttggcggcgtgcgggcgattgtgagtgcgggaggaggcaccggcggcggcgacaacacgagctcgacggctccgcctctcccctctccattccggcccttatgcgccgccgccgcctctcgtgtaacccaccacctccgttcctccctcacctgctctcctctcctctcctctctccacttggcgaggtcgatggtgaggccgccaccgccgccgctctggcccccgcccgccgccgccactgctttggccctgcccaccgccgctccagctccagtcgcccgtgctccccgcggccggcgaaggggagagaagagaaagagaaagaaagagagaagggaggaagaagaaagggagatagaggatgacatgtggggcccacatgtcagtgggccccacaattttttattttgtgtgtgaatgactaatgggtaccacgcatattttttatttctaataccacttaagcgccacgtggaaagaagaccgagtcaatactgccacgtatgcgccacgtcagcaaaaccgccctccaaaaccacccaaggagtcaaattgcaccggttttaagagtttgggggtcaagatatccagttttgtggtttagggtcatggattaggtttcgatcacttttgagggtcatgaagtgaacttattcctttaaatttagcccatgacagacagattgggcccgttccaaacaaggcctgaactgtatgggccagaattctggcccatccaagcaaggcctacatcctcttttcggccctagaaagcccacttccaacacggcccatttattcttttttccgtttcattcctccgttccgttccacgctctggccatcaaaacccctcctcctcctcctccccccacaaaaccccactctccttgctccgcccccgccgcgtcgccgtcgccattgcgccgccgccgccgccgccgccgacgccgtgcgtcgcgaaggtgatctccgcgtccctagctctctccccctcctcctcctcctcctctctctctctctcctaccttttctccgctcgcgcgcatgcaagcgatgcggcagcagcggcggcggccgtgctccggtgccgcgcggggcggggatcgccggccccatttctgctgggtttggcggggttggggacttacttgggtatcgagctgggaggtgtacggcttgttggtctaatccatggggttatatgtgtcgctctgagttcttaaggcactaaagggggttggttcgttttattcattttttttttgtttgcttgtttgtatgctttgatgcgtcggcgtcgctatagcgagttgttctccgttggtgaccgtgttgggcttggttcgagttttcgtttcgggcaatgcgcaatgatgctacttggtagtacttgggagcagagctgtaccaggggctaagctgatcaggttgttctttgctacgattgagcttcagattacacagttcctttgtttgtgggactgttaggatcccggtgattgaggcttgttatactgcgtctgtgtgcaagccttgattgagctcttgatttgagtcgctcactgcggggttgatattcgatgggattttgccaggaaattttacttggttccatcattaaattgtaggaatgtcactattcagattgttctcattactatttatccttttcgatgattcagtgctaccaggaatgctgggatgaattcatattgtgataagaaagaggttactgtagcttttagcaaaactaaaaggcaagaggaggatgaagtgatttggagaatggtagaacaaggcgctacagatgatgaagagtgtggtggtaccaactgttcggctggcgaaaatagggatcctggttggcctggaacgagtgtcttcaggatgctgattcctgcaactaaagttggcgcagtaattggtcacagtggagaaaggcttagaagactgtgtgaggaaacaaaagcctgcgtccgagtaataggtggccactttgctgctgcagagcgagctgtaagttctccatttagtagtattattttttttcttgatcatccttgacttcccattactatttatactagaatactgtttccttttctgcctgcagtatgctagcatttttttttctttttggcaatgatgatcttaattgagtgcttgcaattaaattttatagcatttggccacaaacaatactgcggggtttctttcagagaaatgtatgaatgattcatgatctggctaacgtatcaagtatcaactagcaaaccagaagtggactatagaatgtacttatcctggatgcagatggtttttctttgcttttagaatgttgtcctgttacgatgttgtgttgacttccaatcgcttttgtggtaactgaaatataacctcctatattgtttttttttgtctttgtactttggattcttatataagttggtctttttcaacataatttttgcaatagcttgtgattcataaaaatatgggcatcatttatgtttagttcaataatttcctcaattttgtttctttcaattttttttattggaaggtaatcatttttgcaaaggaacaacctgatgagccaaaacctccagctattgatgcactactaagagtatatgagtgtataatcaatgatgatggtttagatgtgagatataacaatatagttgtggcacggattcttacaccaagtgaacaggcagcaagccttattggcgatcagggttcagtgattaattatatcaagaaagcttctaaaaccaacatccatgttattggtaactttcttactttgatgcacctcttggaaccactagttccttctattgataaatttgatatcagtggtctccaactctccatatatacagatgcgggtctttggatgatgcactagtgtatctataagctacatgaatttcagcttactgaagcacatggttactcatgttgcttggtgactctactgcattgaaactaaatttcttaagcatgcagtgatgttttagccccatcaaggaattaaatggactactacatcagcatattctgtcaaacatgtttttgctggttaattataagctgagattgtacctgtgaaaaaatatgttcatgcaggaatagttaatattgcgtgtagctatgtacatgttgtcaggtgtccatattttcttatgtgttaagaaagtatttgttatggccagtgttccgtacttatgcggcccgtccaacatgacatccgttgaaagcggaccactggcgagagataattagtggattagatatccctacttgctatctttgtctatgtttccattccattagattgtttgtttcctttttcattagagattcttgttagggaccatcctataaaaggatcaaccatattattttaagaattaattgatctttctctttcttttgtcactcacttaaatagttacagagcaagcagagaagttaatatacataatgaactaggacttggttacacttaaaggattctgatatggcatgaaaattatgtgactaattaacttatttctttgaatttatcaagcaatatcaacaataacacaatgattgcccatggatgcaatgaaaagaaacagttttaagcatgacttcatccatggcggatggagcagggggcgcgaaggtggggaccccgggcctagtgctttcagcccatcatgcctgctatgtattcacggtcaaattatctagtaaccaagcaatggccacggcattgcaacatacagagtagcattttagttgatccgttgattattattttgcatttatcgttcatctattactagattcataaatatggctaaactaaattacatagtttttctcaagtgatattagcaatatttcccgcacaaatggcagtatgaaacaacaaataaaatcttggagggattttaatctcattgatgccatggtgatctggtaaaacatatgcaaaccatccttctgaatcctatttttttattagtgttgttccacggccccttcctcgcctctaaattttagctctgcgtttgacactgacttcatcaaaactacaaaatgcaacatctgtttaatgcgatgacgcatgggtttcattgcatccatcatttggataaaatgggttgcacttttattttaaattcaaaagtttcagttatgattgacctaaatggtattatattagttccatttggtgatatgcagtttcagtatctaatactactttcaagattaaactgctattatttggtacactttccagccttctatatataatcttaataagtactcattccatcatgtcttgactatgtagacggtgacttgccacctgttgcacttgaagatgatatgattattgaaatttggggactgcctgcaagagtgcatcaagcattggaacttgttgcttgtcatttgagaaagtacctggttcatcgaagtgtcatcccactgtttgacccccatgtaagttgccactattttgaacatttgttatttaatgagcaattgagcataccgacacagtacatttttgtcctcgcaacatttaattctgaggaatgattttcttcaggtgtctattccaatctcacctgtggatatgcccccattccactacagtgaccatcatgagggccttctgcacgaagctagtccaggctattactccctatatgctgaagcttttcaacttgaacacccatggactgatactagttattcaaggtatccaatggaaaactttacacatgctgacatatttgaatacagacaagaagcaccagtattttttgggagatatcggtcagtcacacctccacattatgggcatgaagcagaagcatatttatcatctccaatggaattatgtttgcataacaacctgaatacatatggatggcaagcaactccaccaattggtcgatcagatactgttgaaagaatacgctcccttatatctgtgtatggaaaacaggcacatccacatccgctgaggcagacatatcaatcaactaaaatggaaaaacatccacactcggggatatctttgtacagaagggatgatcatccaacaagggtatctccatcacctgctactgaactacccccatctcctgctgtttctgcatataaatggcaagtatctccatccttaaagatgtatccttcaactaatgtcgaaaaccttcaacactgccgtgtttctgcatgcgctccagaagaactgccaaatgtggttgtgccttcgttaactagtcaatctcctgcagtcacttctcaggtttgtatggtttttatcatagactcttgctgacttgttttaattagtcctgtcaacattatttacttcttgtttgctgacatgtttttattgtctgcgcaacactatttactatcatttttggacggtgggctgcttggcaggttataatgaagatgcaagttccaattttctatgctgaagcggtaattggcccaactggtgcacgaattgattacattcgccaagccagcggatcaagcgtcgtgataaaggatcttgatgacagtgcaatgtctattgagatcactggaagtgctgcaacagatgttcaaattgcagagcagttgataaaggtagcagcagcttttataattttgttgttgttgttgtacttacttctgatgaaatgactagtctaagtaagttcattgcatttctgttgacataactggtctttacttttagacaaggttctatttctgttttatgaaaaacacaacatgactgcaatcctctcttttgtgggtattgcttccatttattgtaggcaaaattggttctagagtagccaatttttcctttattgtaaatatagttcaatatctagttttcaatcttattttacctactggacagctaattaattgtataagattccatgtttccgcaaacagaccacatattgctattcatctaatgctcgctagcccagtccttgtatggaaaatcagggtgctggttgctgtcctggtgtatcaggttctagactcttcgttgatatgcatgaactttgacctgaatagcagctcagtacccttgaaagttcaaccacttgctaccgggactgctttttgctttttggaattgcaccttggtttctgtagttttaccactattgtgctgagagcctgaggctgtaagatgaattccacgcttgtacgtttgccttaaaaatatcaatgttgccctaccactctcctgaccatcgttttcttttccagaacttcatggctgaagctgctgccgcttcccctgatcacagttatgacttcattccatcacatttgccagcaccgagatctccagagccagatattccaactacttcactcactcgcagagcaagctgttttacagaacctcgcctgcaagcgacctactgagttcccaagagttctctttctgcacatagtccctacaccggcaatacaggaaatccgcgagagtacattcccagaaagttttgatatccatcctcagatgattaatatgcgccccctttttgaacccccaagacttgtatctaatattttctttttctttggcttttagccatagactttgatccatgagttagaaattgactctgatccatgagttagaaatagaccttgatccatgggttagaagtctgagattatggtataggacaacaattttttggtggattcagggtaagtgatgtacaagatatgtgccctcagatgtttgagagacagtttgtattacatgacaacatgcattatgttatctacaaactaaaattcacttttaattccttgttaactgctgatgtgtgacctgactgttaaaagctgctgccatgtcaatggatgcttgggtgttgcatagcttgcattgatctatttttgtatgtgtggccatgcttgaatctctcgcctgacattcagacttcagacattacaaggggaaaatgccgggtttagaggagagcaaggcagccattctgttcctcctttctctctcctctcttcgtccctgcgtagagagggagagagagagaaggaaccccttttgcctcctctttcctgccaagaaccacattttcccccaatctttcttcagattttccacacaaatctgtacgccttttcggtctaaagaaaaattcagcatcggtatgttcaatcaccctgttatgtatttcttaaaattccttgaaaaatcattggaacaatctttgtatgaatgtgaaaatgctgtgatgttacatgtaatcaattgcgctgcaagtaatttcttctcaagattattcaggagtttttcccctgttataactggtgaaaattttggatccttgctcatattttcctcctttttttgtctgaacaatcagatattggtgtctttctgcaagaaaggtgggcattggcagcaccaacgctccatccatttaccttctgagcaaacagcttcctgtgaagatcaccttttcttggtgctgcaatctgcattggcaccaaatcaagattcaacatttgctcccatatcatcaaaccaagattcagcagtgtgattttggttgccttgaagctgcattgaggaacctttcatgtgatttttttgatgcacattgatcatccatggctgcgaaaaaccatgcgagatcccaggacttctggaggagattctggtccatgctgtcttatgcttgcagcgagctttgcttgatcatcctgctccatgtggccgcaggagcatcctacctggcgacgaggttggcgcgcatccacaagctcaagatgccatgcatcctgtgcacaaggatggatcatgcccttcatgggaagccatggttctcttcggatttggtctgcgccgcgcataggtcggagatatcatctctggcatactgcagtagccacaacaatcttgcacaatgtgatgatctctgcaaaagatgcactgtagcaacgaatgatgtggttgacacaaggagatcgaaatccaggcagctgtgttcttgctgttcggagccattcaccaaggcgcgcaatgcgcataggatttctgagannnnnnnnnnnnnnnnnnnnnnnnnnngggaacaaatccctgcagatcattcaaaagataagggtaagttcacttgtctgaactactgtacttcagattctcttataactgaatcctttttagaggttcaccgagtgaatccattgtgttttttttttgtagcctttgtggtgggtattgaggaggtgaatgaatctgatagttcaccacgaacatatgaacaatccacaaagaacaatggcgcttctggaaatgctgggactgcaaagctagcacccagtggatctactgtgcctatgcgcgttttcgtcgatcgcaacagcagcgtaaagaacggtttcataagtagggccaatctttcatcacctcggccatcacaaataatctctgccaaggacagcaattcaaccactcagcaagaagtgaaggcattcctttcacagatgtctactgtaaggggcattgacagttcttggagtgatggagctcctagccccggaatcaatgcgcaaaccgatgaaagcaatgccaatggcaggaggccatccctcgagaggaactattctgtgatagaaccatcggatgcgaacctcgctgatgaagttgagggagagagctctcctgagaacctgaagcggcttcttgagctcaacaagaagtcgatgagtgctctctacaaagagcttgaggaagaacgtagcgcttcggcgatcgcggctagccaagcaatggccatgatcaataagttgcatgaggaaaaggctgcaatgcagatggaggcactgcaatacctgaggatgatggaagagcaggccgatcatgaccacgaagcgattcagaatcttcacgacttgcttacggagagggagaaagaattacttgacatggatgctgagcttgagaacttcaggaggctagtccagaatgaacaattcaatggcgggaaacatgatatcgctggcataatgaatgaaacagacatgccgtttgaggtcttgaatgacttgggctacacgaagaacaccatgtcgggtttcgaagacgaaatggcgtatattttggaatcgataagcagattggaggataagctctgcgtctccacaaacagacttgcttctgacgatgccaaaattaatcaagagggattgataggaggggctgattttgggagctcaccaacgcatggtgaatcaacttctgatcagcaagatgatggaaacaaatctgttcagaaccataaggataactgttcttgttctcatccagaggatgggaaaacgagtgatgcaaatcttaaggatgaagtctcactgttgcatacgagattgcaggcacttgaagctgatcaggagtttcttaagcatgtgttaaactccctaaggtgtagccctgatggactgcagtgtgtacaggcgatagccagccatttactagagttgagaagaattgcaactcagagataattttcccccctgatttcacaccttctggtcatgaggtaataattattctagctaccatttcatagcagtgagctattattttaaagtttccttaacattttgaaaaaaaaacggaaggattttatcattttatgaggtagtaattgatttaccaaaaacatgtaacctgataaaacagaagcctatataaagaagattctagaaatatatccatggtaggagctaccaaggaaatgcacattcataattgatgcaaaattaatgcaagtgttttcatacactgataagtgacactaataattctggcccatctgtatgtcaaaagatggatctggattaggttctttctgctccattgctgaataccatcaggttttagctatgtttgcgttattctcagtacattaatccctcttgtcatttctttgatattcaatttctttatataatttaattataggattgcaaatgttgtccatgaatgctctgcttaaccataaatcattgacaactttggcctaaccttttcttgcagctcttctcatgtagtgctacagaccttcatggtgcttcttgttagagcagcattgaagaggtctagaaatcgatgtcggtgaaagatcatctgaaatgaggaaaaggagcatgcactgacaaaaaaaacttccattccttgtactaatcttcaagttttcattgaccaggctggccccctgttgctgtaattctgtcactgcttcagtaaattactgaaacagacaaaggcatctcctctatatcgatgtgattgctgttaggagcaagtttgtaactgtagatgtaactgatgcttgcggttcttgcaaaagaggagtttaactagtagaatatatacagtgttcatatcaaattaatcaatgtctccttgcttcagaaatgcaaggttttctgcctcatccaattaattttctccatacgtttaaatttctttttccattcctgctgattgtgtgatgcctgatgagagaattgcaaatgggattttcttgtgctattttcccaggcatatatgagtggccggttatttccacaggaattcgtcatccgccactagcaaactactattttagattgaacctagtccacttgagcttttattcctttctgtattgttgcccaaaagtcaagatccaaatctgaatttcacggcttgaagtaattacgtccttatcttgcatattgttgcagaccatttagtctcaactcccgagcttttggactgcatatctcagaaatttcaacaattactccctccgttcctatttactactccctgacgccgttgacttttcgatcaacgtttgactgtttgttttattcaaaagttttatgtaaatatgaaaatatttatgtccagcttaaagaatatttgatgacgaatcaagtcacaacgaaataaatgatagttacataaattttttaaataagacgaatggtcaaacgttggataaaaagtcaacggcgtcatacattaaaatatggagatagtactagtcactgttgaccaatatcgttgcaactttgataattaacaagttttttttttgttgaacgaaaattgtggtatggtcatgtttagcatgcaacatgcttggataatatcttatgttttcatatatatacaaatgtgttgcaaaaataagaatggccaaagtttacatatgaccaatgttgatgataattatatgggcatggagagagtaggatactgtataaagtagtaggaaaaaaaacatctccaaatattttctttccagcactgtatccatcctccattttattatcttctcttatttcaacgctgtttccttctctttgtttttttttttttgcggggatgttatgtttatttaattgttccatagagttgactgaaattgcatttttgaagtacaatttgcatcacatctgattaagtgattatctgtcctcttcgtcatatataactctcttgacgaactgaatccaactaatttcacattaaaaattagtatccacttgccaatactgtatttccaggaaaaaaaacaaaagccaataattagaacattttttcaataataataagaaaactagtcaaattcgtactaaaacgtgaacaacctgtattcccgcacacgagctgactttgcatttatttagatttaaaattgcaagcttgcctattttgtcccaaatgcatgctggccttgagtttaaaataaccatcacaaaaatgccacttcatgtaacacatggttgatttctttatccacactatgagatttgctacagtccaacaaaaagtacctcaaggtcccgatacatcacgctgatccaacgatcggaaacggacaatttggtaccatgaagtaccggtaccttgagatactttttattagattggagcaaatctcccacactattactcttaacctcatgtttgcataggaatatagtcttctagcttttgcttgtttaagagtattccatttccaaaattgtgtggtctggcctttctcttctctctcaagacagcgttttggccaattcaggatgtgatatgacatgagctaatcggagtgccttccttcttcttgtgccactctgaaagtctgaatcttctcccatgtataagttggtatagactgataagatatatacaagcagctttgctttccaagaaagccatgaaagggtggtgctagtgagccagtaatagcattaccgtacttccacatgtcgccggcgagaggtggcacgccggaggaggagggcggtggcgccgacgtcgagaaggcggcggcggagacgggaggtagaggcacgtggaggcacgcggcgttccacgtggcgacgacgatcgccacgccggcggcctatgctcccctcccgtttgctcttgcctcccttggctggcctcttggttggtgcttctttactcatcctgtttcatcctctccatggattctctgatatttgagcttctcctgctctgttgcctgaaatgccatgaacagaaagtttctcagttcatatgcatgcatgattttttcttctgtttgatttgagtaatttgtaattagctaactgttgtttgagcacaggtgtttgtagcttggtcacaggaacactagttacatggtgttctagcctggttgttgcctcactgtggcagtggaatggagacaagcacaccagctacaagcttcttgcaaagagcatctttggttagtactcatcaccattttttttgtcacgacaaaattgtacttttgatcttactgtactgtgtcacaagaagatttctgagtagcagcctagcaggaaaagagttgccaaacgatagtaaatgggattacagattcttcaccataaatatttacttttgatgatctacttgtaacagtaatatacttagcagtgcagaaattgttgcaaatttacctcaagtgatggtaaaaatctgtgcttttgtctgaaggtccctggggttactggtatgtgtcgttcttccagcaagtggcatcaattggaaacaacattgcaatccagattgcagctgggagcagcctcaaggctgtgtacaagcactaccacaccactgatgatggcgccatgaccctgcaacagttcatcattctcttcggcgcattcgagctgttactctcccagcttcctgacatccactcactccggtgggtcaatgctgcctgcaccgctagcaccattggatttgcagggacagccattggtgtcaccatttatgatggtaaaatctggtcatatcttcacttttcagactgaagatttctggaaattgaagatgtggaagaatgaacagaatgaatttcctaatgcagggcatcggattgatcggaaggaagttgattacagtctgcaaggaagcgctgcatcaaagatcttcagagccttcaatgcactgggcacaatagcattctcatttggggatgcaatgctgccagaaattcaggtgaatatctgatattatgctgagattcatgctgtcagtgtccactcaactccaaaacttcactgaaattcagagctctgtgcgagaaccggtgaggatgaacatgtacaaaggcgtgtcgacggcgtactcgatcatcgtcatgtcctactggaccctggcattcagtgggtactgggcatttggctcaggagtacagccctacatcctgtcctccctgacttttccaagatggacaattgtgatggcaaatctatttgcagtcattcagatcactggttgctttcaggtaacacaccagtaacctcttttttttttcacaattttcactctgacagactatccagtaactgtaaatcttcaccaagatatactgcaggccgacattcgcgcaatttgaacagcggattcaggcgaaagacgcaggctacagagcaaggatgtggaggctggtgtatacctctgcatacatggtggtgatcaccctcatctctgcagcaatgccattctttggggactttgtgtcagtctgtggagctgttggctttacccctctggactttgtgctacctgcactggcatttctgaaggccgggaagttacctgaaaacccaggattacgccatgctgtgaaggtgatcacctctgctgtcgctgtcttgttctccattgtcggagctctggcatgcatcggcgccgtcagagcgatcgcacttgatgtcaaaacctacaaattcttccatgacatgtgaatgcagttagttagtatcatgttggtgatgaaatgaatgtctctgccatctgtgccagtggtttatacctggtgatctgacatgtgctaagtattaagtatatttatgatttggaatagcggcaacagttgagggaaaatcaaaatttctcagatttcacggttttaacgctcttaagataaacattttaacactgtaagaaaacaaaatagatgctatagacggattacatcttaaacaagagaacttaactattcaggagatcaaattcttaggcctgattctctcagtgatttagtatactagtgccatcgaagttcataatttgaagagagaatgcaagtgctgcccataataacagtcaaaattgacctatacaaaccatgacagctacataaattccatatagagttgccgaactacggaggttacaaggggtaaaagaaacttaaaaaggctaaccaccacttggcagcagtcttttcaagggagcactaacttattttctgatgcaacatggctaagctcagctaaaatccttcagccttctcttcaacacatccaaggacttctttcgagcactttgcactgtacttcggcctgaaaggctcccaaataagctttccggagcatctctaaacttgtcacagatgatagacaccttcttatgatccaaggatccaaaattcttctccctgattacagggttcatgaagttctctggctggttgctgagcagaagatcggtgagctgcctaatttcgaccaggcaatctctgaaagttgtttcttttctcagctctgacaacccagtgctgtggaatttatcatctgcaaattcctctaactttttcaggtcaatgtcaatacctgcggcagcattagcattgaaccttttcacccgatcactaagaaaaactgtcattatcgagtccgagatgtggctgaatgccccacaaaccaccttgtacagggcttcccttggaaaaacattctgtgcagttgacactaacgtgtgaagatagatgacgacctcattcatgtagtcattcacatgttctggagtttcctctggtgtccaattgatgctagtcaaaagcaacataaattcgtcaatcttggaattggccaaggctattaacccattgtacgctgcattttgagaggctttgagcacagctctagcagtcaaaccggaatgaggcttgtcaagaagacgcctaggaacaccacaaagttgggcagcatgaaagaggaacatgtcacaggacttctcaagaatggcaatatttcctgcaatctgcaccatttgtgtaatctccaaacaaccaccatgtatcaaattcagaaggccatcatttagtacctcaatcaagagcttgtctaggtatcttttcaccacatcataggcgtccatcataggatcatatgacaagtagttcacagaatcatcaataaaagagcgcacgataaggcaagcatctggaactgaagaggaaaatggtgcaacatatggaaaatccggaactacaccaatgggttcaagttgaaatgctgaaacattcatgtggtactcattttccttcttaatgatcatctgctcatatgagtccttagtgaagatgccatctatctttttccggcaatcagaaagaagaagttgatagaatttgtccctattcttctcaagaatttcaagcaatgatgtggtttggtatccatacttcttcatggttgcacccagaagagtgacatagtcttttacgagtaggaggtggttggcagcatccatgcgagagaactgttcctctaagatagatgtgaccttagaaatagctgtcccccacattgtctcaacctgactatcagaaagaagcccatctgcagttcgaaggacacggtcctcaacaataaagaacccagctatctgagcaaggaagtgctgatgagactccatgaacggttgtgtcgtgggaatttgcaggtccaaattaagttgcataagcctgttattgtagtagtattctcggaatttttccccaagaccaaggcatgtgtgaatgtagtttgctcggtatactggtgtaagatcgaattccagtacttcctcctcacctatgagatccaaatccaaggcataagcatgctcgtcaaacccaatacggctgcagtcctctgcttccctctgttgggaatgtattccctcatttttctgacgagccaaggatgcctggcttatcgaaaccttaccaatttcctttgctgtccttctgatatacaccagccactcattaaactcattgcaaactttcttctcaatgtacagcttgacaattggtatttgcttctgaacagccttttttagaagctttagaggaatattttgcagaaaatccttctcaatcaactccaaacttttcaaagcagaatgaagcctggcttctgcaatgtccttgttgcacatctggcacagactggtgacttgcaaacagatcttcaacatccctagggcttcctcaacattcttattcactgaatacaactcaagaagctcatcaagcttcaacagcagggagctagcaacctcttgcaggcgcaggttttcgccggacagcatacccttaagctcatcggcgtcaaccaacacgccgcggagctcatcgactgcaaggatgaactcctcgtagtggaccctacagagctcctcaatctcaacctccttcattttcacgatgctcctgaggccttgcaggagggactcgggcttcccggactcgaacgcgtggcggacgatagggcccagatcctcgccgttggcgatgaaggcagcaaggcccaagccagcgccaccgttcccgctctccccgccacccctcttcttggtctgagcagtcattgttcaactgcaaaacacacacacacaaaaaaaaaaatggcatgctgcacacagtaagacatgcgtccaccttaagaaatcgggtaccccctaaatttagagtgctacaaatgattagcatatgaagaacgcagtaataattagtgaaaattaattagcaagccaagaaattagcacaagcgttgaagtgtaaaccaccaaatttgttaaaataaaccgacctaacgtggggcgtgggggttcagcattttttcaaaaaaaaaactactattatactaagaaatacggaagaaactgaatgggttaattggaggcaaagtagtcaatccaggtcgggatggatttccaaatccacgccacgacggctcatgaagcggcggggagggaggaagggagagagtgctacgggagaagaacgagtaccttgggggttcgattcgagccggggatggaggcgagtggaatgaggccggccgcgtcgcgtctccggaccttgctgcgccggccgtgcgcgcgaggaggccgcgcaggggtgggggagaaggggaggaggaggaggccgcacacgccgtgtgcctcaggggcagctcgccggcggcgcgcggcggggagggggaggaggcgaggcggggcttgcgggggagaatgccggcggtgcctctgcctccgccggcggagagagagagagaagagagagggatggagagtggagtggaggcgagtgatgagtgatgggaggagagagaagaaggggcaggggagtcatttctccatttcccctcaatttttcttaaactaaaattccaaagaacgatttttctccgaactaaaattcaaacttcctctatcccttcaatacaagagattttagctatgcaccgtctttcttttggcttatgagccgtagacaaaatttaaaattttaaaagtgattttagagttaatttagagatttattttttcgtagtttttttcgtgtgcttttaaattaaaggaaaaaatatgaatggcctcctgaactatagtggtcgattgaattacacccctaaaccacaaaccagacattcttcacctcccaactatataaatcggacaaataacccccggttcaattcgcggtggttttgatcctctcgcacgccacgtaggatcaaaactaccgcgcacgtaggattaaaaccaccatggattgagccgggggggttatttgtccagtttgcatagttatagatgaagaatgtctagttttgtgatttaagggtataattcgatcgaccgtgatagtttagggatagtaaggatataaatataaaagctcactcattaatctttttcctaattagctgtagtccaatggattaaagtgaatttgaaacataggaattttcgctagaaccggttcggctgttggaggagccgtgagcgatttcctcgttattatgctcctaggttttgacgactttgttgttgttgtcgccacgccacatgttgacgccagatcgacccagaatgaaacggaaacaccgaggtgacgatcccatcccaacgagtgtgcgtacgtatctgccgttggaagcatcgtgcagcaaggtgtcgtgttcaggtcacaaagaaaatcatggagaaatatcaatgcacgaacaaaagcgtcactttttaatcagcttaacaaggcaccttctaagcacctttgctgaccaggtcaccagaataagtccaacttcaaaccgcaccttgttttaggcctatttaagcttgttggtagctaagcttctaagaataaaaaaaactaggttttttagcttgtgacttctagtttatttcctagattctacaactatggcttcttaaaatctaaatcaaaagctagattgtttgaatgagtttctgattttgaaagaagctgcagcaaacatacccttactaatacatccttgaatgcaagctgttgcgaccaggagatcacaaagcagtaaagtagcatcaaaagcaggaacaaaaagcttagtgtgtaggaccacaccacgaatgaatgggttacaacttgcagtcacgatttacattcagaacggcacagtgatattatataatatacctctggatatctggaactggaagcaaaatagatggatgcttgatccacggatcacatgtacataaaccagtcaatagttcaggagaaggtactcaagaaatttgttgtttaatcaaaaaatttcatgcggcaatactatcaacatcctgaagcatttctttcttttttttgaccgggacctgaagcatttctttcagtaacatgttaggccaaaaaaataaaaggaacttgagctggtttctataataatgaacttataaaccatgcaatatacgagatagctagccatttgctgtaactcatctccgttcttcactggctgcaatcgtgggttggatttctctggtactgctcgaaataccgatatctgtctgttgtttccgcggttagaaatcgactggtcagactgcaacacaaactacatcatagttaggtagctcatggcaatagaactcaaactaaattctcagataattttggtggaaatttagaaagatttattttagtggtcctttgtaatgtttcagaagatgatgattgtggaccacaaacatctcaaaagaaaatcgcaaatatcaaaagatatgtctggacagttttgccatttgtctccaggatgtataatccaattcatgacttgtttaggtgctcatacaatgaccaaccgaaaataatcattctagttgcacaactgccaaagatgttaatgaagcagatggtgcaataaacagaaaaaaatcatcgtcaatttagcgattgtttcacaaaatttatcatccaaatttcaaaaagaaaaaacccttactccaaatgattacctcatttatgcagggcaggtgtatctacttctgacttgtggcctcatctttcattttggcctgaagttgaaaaggcaagaataaacataaggaaacaaactttatgaaccaggcagttctacagatgagcctatactttcagtatttctgtacactatgtaatatttatatcaaggagtatgtaactgtaaattatgggttcatcaaacctcatccacagcatctctccggaccttcctagtcgggcttctcattgtgacaagttcttctgcagtggttgggtggacacctatggtggcatcaaagttttgcttcatcaacccagcctttacagcaattgcaataccctgtcatagtaatgtacaccacaaatatattaggcaaacatgaacaaaatgatggctaaatattaaataaagaactcacaaacctgaataatctcgggtgcatcttcaccacacacgtgcactcctagaactttgttagtattagcacacacgataaccttcatgtatacacgatcaggtagaccagaaagagtggccctgagaggtctgaagtttgatgtgtagacatcaacatctccatacttttcgatcgcctacagaagtgtatagtttacttaaatttctcgtgtgtttttgcaagttaacaagtttgtaagtttacaataccttctcttcagtgagtccaacttgtccaattggaggttgggaaaacaccgcagatggcacagcactgtaaaaatgcatatcaaagagtttaatacaacagttatgccaaattacagtgtacatgattctactattgaattataatgttaaatagagaacttgacaaaaaaaaatcagatttgttagtcattttgaattgtgaagaaagaaagggatggggcagcggatgtgtttgaacttatgcactactgccacaagagataattaatgcataatgtgcacaaaatgacaactgtttacaaggtacacaatttagcatttcttgaattcttgttaatgctcaccaagaacaatcagtttgtatacacaaataagggaacatgaagcatcaaaatcgcaaggttcaagatcaatacaaatttatatggatgttatatatatatgtatatacacactaaaaatacatatacatgcatacctgtaatctggttttgtaggttcattgccaaaaatagtccttgctaatgccccaccttccattaatgcaaccggtgtcaagttcaccctgttagtaacatcacccacagcccatatagaatcaactgaggttcgagagaactcatcaacctaggataacatatatagaccaagaatttcagttatcacttaatgatcatctaataattgagaaaatgttagattatgtataatgtatagaatcataatgtatagaatctatgtagaatacacagaaccttgtttaaatacacataccacaatagcaccatgcttgtccattttgaccccaacctcttctagacccaaattctacaaaggtatggattgtatgaagatgtgtatccagaaaataaatgtatgcccccaaaacaaacttggttgagaaaagtggaaatgactggcataatattaacctttgtatttggttttcgtcctgttgcaaacattacatgtgagaacccatttatgcttcctttgtttgtcgtcagagtcagcaagccatcgtctgatttcattactgcttgaggagtctcttcggtatgaaatgtgatacccctcaaagacatctgatcggcaacaaaatccctgacctacaaatccacatggaatgagaaaataactcaaggcatgacgcattgacacacttcagttcaaaaacgaaattattgttctaatggatacttgctcacctcctcatcaaagcctctcagtactttcttctgtcggatgaaaacatgaacaccactttttaagccattgaaaatgccagcaaactccaaagcaatataccctcctcctactatcgcaatcttctcaggtcttgaaggcaggtccaatgctgcatctgaatcaataacatgctctatccctggaatgtctggcatggatggccgaccaccaactgcaatgagtatgttttttgcagtataaagctttccatcaacactgacagtatgtggatcaacaacctgcataatatgaacaggtagtatatcaacactgtcattgctgcattgatcctttcaacaaaactgtatatgcaaacttaacccaatttacaaatttgtcccaacctttccacggccttcaattatagtgaccccagaattctttagcatgtttgtctgaacccccaccaagcgctgcaactctaaattcttgttggtcatcagagtgctccagtcatgctttggctcagtgccatacctccacccaaagccatgactctcttcaaactcatgagagtatttggatgcatacaccagcagtttctttgggacacagccacgaagcacacatctgaagtatggaaaaactgaacatcttacttgcacatttttgcaattggatatgaaatggaagaaagatgctatccgcacattatagatactaagcatttcactctgcagacgctataagcaaattacagatatagaaggaagctggaaacgcgtaaggctaactggttgataacaaccagccatcgtgacagagctctctaacttttttgttacttgcgtatatggagagccattcatgtaagtatgtaaccctaatagtaaatctcatatcatcatctctacacatatattgaacaacattatagtgaataccacaaaagcctctgaaattaagcatgagctccaggaatggtgaataagaatctgttcttatagtcatagagtagactcctagtggtcgttgatcataacagagcactggatcgtgcgtgaaattgttcaatcctctcctcactactaaatcataatcctaaacaaacaatcagaagcaaaccatgcacaccatccgaattccaaacaaacattaccactgaacaatgtgtgcgacttgaactaggaagaagggtggcgaagttcactcacgttccgccgacgccgccgaggctgtcggacgcgacggtggcgaagggcatctcgcagacggcggcgcgggcgccgtagagggaggcggcgacgcgcgacgcccgcatcccgccgctcccggcgccgatggtgaagaggtcgtagtcgtagtcgcacccacccccatcgccgcccgcagcggccccgttatccccggcggaggcggaggcggagaacgggcggcgcgggccgaggcggaggagcgggccccggccccgggtggcggcagccgcagccgcgagggggtggcggcggaggtggaggaagcccccgccgccgcggcgggggaaggagaggacgcgggatatggtctggaccgcggcggcggcggaggaggaggaggaggggagggtcgccgccgtcgccatggctgctgctccgaggcttccgcggcggcgcgggggcgcgtgacgagacgagacgagacgaggcggaaatcaaatgcgttgcttcgaggcggggcgcgtggtgtggccgtgtgtggggctagccaggagacaaaaggcgaggctttgttgcttcggtgaggcatgacgtggcatcggcgggtataggtcataggtggcgctggcgcatagccgcggagccgcctgagccttgggccctcgaggtgccataagatacgctttgtaagttttaaagcgtatttttgtaactccctccgtaccaaattagatgtcattttgactctgtaaattaggtgtcgttttaactttttgctttcaattttcgatcattcgttttatttaaaaaattagtgtaaatataaagaaagtcatacttaaaatattattgataataaagtaagtcacaaataaaataaataataattatataatcttctaaacaagataattggtaataaaaactcaaaaataagtattttgggacggcggtaatgggccggatggcctgcaaacgtctactgtgtaccatcattagcttagtttagctttgtgctaggtgtgtactatgtagcctagaacggcccattcctaatagacgtggacagatggggtatcatcatttggtgacccatttcagtactccaacatgcgggaagagagggataggtggaaccgtggatgttcacttaggccattcacggtgcataactgtatacatgtaccattcaatcctaacattccacgtcatggattccataccacatctgctactcccgtaacaaagtgaagtccggagagccaaagttagccacgagttcctcgtcagatttgttagagtgttggggagggaggggaatagcttgggctatgcatccgggggaggaaccgggggaaagaggggagacaggagtggcaccgtcgtggggctcgtcgccgcccccggctccgcaggtcgccggcactaccgttgttccccgctcttccccgatgccaccatcaccaccacaggggaaagaggggagagaggagcagcgctagagaggggagaggccaccgacggagagagaggtagcgccgccacagctgcccgctaccctccagctccactcgactcgacgcctgagatggctgccgcgcttttcctcgtccttactcgatccaccgccaccagagaggagagggtaaggcaaggggggagggaagaagccgccgccggagatgggagaagccggcatggcgagaggagaggggcagcctcaaccgaggaggggtggatctagtcgcccctctctggcaccgtcgcgccgccaacgccgccgctgcttcgggggaggagaggaagggtggatctagccgccccgccgccgttgtcgccctagtgccggtgccgccccagtgccacctcgcccgccgttttctgcgcgatggggaaaggaggaagctgtgcaatggggaaaggaggaaaggagagagaaagggagataaaaagtgaaaaaaagatactagtggaacccactataggtaacttgcattgtaaagtagtatgtggctaatgcggttcttcatctaggtggcatgtgaagttcgccaaaatcacagggcgcactgctactgcccttactaggatgccacatgtggaccccacatgttttgttttactaggatgtcacgtcagtcaagacaaccatctatactaccataggatcttatttaacctggttgtaaaagatgaaggtttaatattttcagtattacgatttgaggatgtaattcaaactcgatgtcaatataagatgtaaagtgaacttattcctctatgcttggccttaaccccacccaaagaagaaagactgttacccaatttgaatttcttggtgcaaccaaggacatcatttttttttcaattttggtatatatatgttgacaaatattctggagaaaatttgtcaaattttgggacatcaatttttttcgattttgctatatatatgttgacaaatattctagagaaaaattgtcaaattttgagacattagatttactctaagattcgggtaagatggggaaggaaaaaaatcagagtgcacgcagttgagggaccacttcatgcgagcaacatgctaccccttgctaatgtttttttttttttaaaaaagaaacagttacatacacgttacttctttttgttaaaaaaaaagctcaacctaagatatgatatgacatattctatgacaagtaatctagacacactcctatctggacaatctagattggtttttttagatggagggagtatgtagtttacatgtaatttattataatataataatacaattatgttatgattatattgtatttgtgaaatttttatcgatagatatatagtttcatatgtaaacaggataaaaatgatcacggaaattaatatggataccgagcagtttaaataatagatatgatcaattacagatagatcaagctttgtttctagagatgctatcgattacaaccgttttcacccccagtaaaccttactacgttttctactgctaaaattgatccacacgcaagggcagtaggatctaaaccaacatcatcactatacttctaacggatttaagtgcttctccagctaaggacatcatctgatggagcaaccatgccaaactcaccgtgacaaccgacgaggcaccagtcacaactcacaaggtagtatatcatgcaaagcaacagagcaatctgccggtgaaacggcatacaagaaacacgtaggagtccacatatcctgtcaggtgtcaggttacaaaaattccagtgccgtccttttcgccagtggcagagcaagtgaatcagatcttattactactagagcagtgcaggtgacagtatggatggacctttgcagcaaagacaagcagaacagacgcaggcaggaggccgagattgagacgagatccatggcaaaagtgagaaacccaactagtgggaaacaagatgcattgtgtagtacagtggtacttagcctgtaaggctgtaacaactccatggggcaaccctgtggaatatgaaaataatagagactgtaactaccccatgtctccattgtgcaaccctgagtcaaatattactctaaaatataggcaaaataatgcctggaatggatggaacaacacaatggtgccaaatgatgttaggaagggatgaataataaggccactttatccagcaattccagtttataaacagcactatggccaccgaaagaggctatagtgcccccatctcaagggcaatatcaaaaattggcaggcacgaggtgtcacatggggatcagatcagcaaatcaattagcacttcaagtacagttcattcggcaaatactgcaaccttgcaatcacaatgcaatgcaccatccaaaacaaaaggcacagcaaaaccaagccggttaatggaggcgaaaataggatggtcctatgaggtgagaaactatatgctaaatatatatagttaggtatcaccagtgctatcccatgaaggaaaaaaacaccgatgagttcaaccgcgtttggcaggagaacggtttgcaggagtggtcgatgggcacgtgcagaacaaggaacccctcttacgagggtttaccgagctggggcttgggttgggagggcatagatgggcaattcatggtggtgaggcctgggaggctcgcagtgtagttaaggatccaccacatctttgcaacaagagggcctctagtttgcctttcactacaatagccaaccttgattccacccaccaatggcaatgcattgccctgcaataacagaatgcgacaatgtcaaaccttgcagagagattgcaacaaattcaagtaccaaagtgaaaaaaacatttatcatgataaatatgcataatgaagttgactgtgacaagcaaagaaatagtagcatctcttgaagaaaaaataatagtgatctggtgtcatcatctaggcagtaactctaggattatataagcatatccaagatcaatttggataaacatgtagggaccagtagacactattggttggcgtccaagataaacaaactatgacagagatctggaggcctcttctgctggcagaaaggaggaaacagtcaaaaaaggctatgtattaggttggactgcaggacaacctattaggaaaatgtcttgtatccaatgcaaataaccaaatgcactaaaacaactaataacatgtgcaagtgccagccaagtttgacagtacagagaattcctggctactgttgcaatgctctacaatgtctatatatatggcatcaacctcaggctaagtactggggagaaaggtacagccctgctccttctcttttacctttgcctcaacaagctcatcacatgttatcaaaatgttgatatacaagtaccgatctaaggttgtaccatagaagatcagcacgctgtcaatcaggttagtgtatcaaatgcaattgcatattgttgctcacattgcaatggtaagattcatgtatatcatggatccttgctttagatcaatacagattatctgctatttttagttatttccgtgatatcaaaaattgaacaatgttgtctgatcatccgattaatcgtgattaatcatcctgatcgctcccctacctccgatcaggcacaggtaagtcgatcagccgatcagaaagctgatcgtccgattaatcgacgattagtcacgattaatcgtcttatcagggtggaaaacgatcagttcatgggctgcctccctgagaaaaatataattttgggcctgccagcccagcccatgttccattttgggcagatgatgggcagcaaatgatgcttcttcttctttgaccaaatgatgcttgctttttaccgtatactacagactatagagtatttagtacataatatatagcatatatggcctgctgaacactcctatatactaaccgatcagcctcgattaatcgccctgattgtcctgattggtgcctaggcgatagggctgatcgcccaatgagagaacattgaaattgaacaatggaagtggaaatgcaatgcaaggaaaaagatcaccccaggcacggcggtaataactgctcaagagcacatataaattaacaatgaatctactatattagtataaccacaatagttgcatgaaccaatcataaaacaaaatcatgatcagccattgcatccgttctttttgttgtaatagtgatatggctctagtaggaagattggactttaagggttatgtaagatctccaacacatatcaatttatatcagttttagctgtttgcattcttaacagatattggagcttgaagctggaggtcaagatcagacgaaaaacaagggggcaactaatggaggcatgtagattaataaaccctacatttacgtaggatgcatacaattaataaaaattctcagatcatctgcacacaaaattggagtaaatcaaattggtctattgattgtttctatcttttatgttagtgggactagtaaacatatgaaaggaacttaaacacgaaatgtgacagtcaaatctcaaaatgttgactatcatgagtgcactcgattgctttgttagagcttacaattacactgttaagttctgcagtacttctgcagtaaatgagtaaatgtcttggcatttggtaatagaagaacattgacttactaactttatcgtgtctagcatgaaataaccttgaaaatgagcaggcaataagcatactattgcttgtagttgataaagaagtcataaacttatgcataggctaatgccatctattttgcaaagaaataacacagttgcttgctataaagaagttataaacttgtgcctagaatagaacatgtgtagacagattatcatacgaagttctggaaaaggtttactaacttatgattaaagattccgtaaacagatagagctaagatggcgcagaatcttctttcaggaaattggtcaaagcattaacatgagtatacaccatcagtacatgagagaagtgaactgtactactccctccgttccaaaatataaggatttctaggattcaaatcttgtaccacaatacaaggatccctgcactaattcccatcatttcaatgattccaaagcattgccaatcacatgcttggaaagggaatctaagcaattcaaaattcaaaaattgacaactgaaatgactaaaaaggtttcttttgacctaatcttagcatttgccaacccagaaacccttacattttggaacggagggagtaaaattttgatctgacatctttattttcagaagcttatattggtttgcattgcggaatacctatactcatatcagaattaagaatacacatgatagtaatatagtatgcccagtaacatttgagaggcaaaaatcatgaaattaatgccaactgagtgactgaccaagcaagtcctagaattgaagtaaaagctggcctgaccagcaagatggacataagaaatgcaagggaatcacttcaagcttcacctactcatgatgtcctccaaacaaggcagggaggcatcattcctcaaccatttatgcattggaatcctattcagctttacctgctgaaattaacaactagcagcatctgcaatcatggttgctaaatgctagtaggaaaatcatccaaatgtaaagggcaactaagctcactgctagacataaacaggaagcagctttcgtcctgtgaattgccttttcaccagaagaaagaagaaagttgtttctattatccagatagatactcaaaatatcctaattcctaaatttaccataagtattagtgagctgtctgtttcaatagcaagaacactgaacttcagagatagctgccttatttagcatatgttctgccctttttcattcttacgatcagattcaagattattaaattaaaatcagaggtctgcaatgtattttgtagctttaggcttttttggaacttacctgagctgtcagaattacaaacataacactataaaatggaacaaccaaagaaaagaaacatgcatgctaaaacatcatgaaactccactacccaactccaatgtgaaatgtaaaaatgctactatatgcctatatcctaacaattcacagataccactagctaaaacatattttccagaggtggtttgttatgaatacctttgctggtccaagagcagcgatggattcctcccatgacactatatttgatatacatgtggcaaacatagctagaaactgcaaaagtgaatggaaaactctgtaaattatgataagatgtagagaaccgaactcaaaataaattatcttctagcttctgagagaaaaaccaatgttcagagattctgtctgaaagtgaggatagaaacatgaactcactaacaaagatactacggaaaaggatggccaggaaagctaagtgcaagcaatcatactgagttgataataggaatctgatatcaaacaatatctgatacacgagacactacacaaggtactgccactatacacataacttccatgaccatgcagaggtcaagtctcccaaggatctgaaaccaatccttatataggaagacaaccaggcttcatgatctactagtagcttgtacagccccaccactatgaaacaatgacgcaaccgatcttgctagtggagttggttgtcgtatgcatttaatttggacctatacaaagaaatggatcttgcattgcttaacaattaaacaccctgtttttaagtaaaaattactaccaaatggagttagagtgaacttgtcagtcatgatgactaatgcaagactacgatgacgaagaactccgatgagaacacatgcaggtcaatacaaagcaggtgaaagttgttgaggcggtaggtgtgtgttgatcaaatcatatggtaattgaaactgacataatttgcaatttggagcatgttttcaattgttagcatataggagtagaacaactcaaagcaaagaaactataatgaataaaaaaaactaatgatttgatgccatgacataagctgcaacaagcgtagctgtctagcacacactctctgcaaaatatactaactaacaactattgatgaaagagatttgtgtttgaacatctgtatagtattgtgggattcaagacatattacatatgttagttttttttacatgatgatagagatattgtagagatttttttttgtgagcatttgaaatttgaacacagatcaaagaaacaatccaaaatgagtgcacagcttatgtggtctagagaaattagttagaagtgcaatgtgtaaacaaaatttaatgcccatcgatgtttctatgtatgacatgaaggtgtgattgaactaaatttctcatgatttatggtagttggatacaatgtgaaccatctacattcagaattcagtgaacagggaatcatggctgaaaagaaaaaaaaaggcataatacatatagtgtaattagcaaaagattaggacaaatcgagtccatgacattacattacaatacagcataaccagtcaatccatgtgttgcacaaatccaagaaagatgactaagactaccacagttcagggagaatcggaaccttgctcggcaaaggtccaatatatttaatttttcccaatctttcatggaccccaatatcacaactaaagttgattcatttacctaatccccaaagctgggtgacaaatgaaaatcagtgttgatgtgcttttgaataaagcaacacttttatataagaaatttctggataattatgaaatggcaagcatttggtagccatattttcgatgacatgttaggcttttagagagtaaacatattcaagaacaaattcatatttcagtaacacgacctttacaaagtaaatacaagttgatcatttccaggtaataagaccccttgcaaacttgctcatgatcctgatagaagtttcatacagtggttgttttgtaagctatggatttgtgtcaaaatagggggggaaatatagggaatacatccataaattacacttcaataggcatatgtaccgtttatctggctatcctaaaccagatctgttactaaggtgtaacacattttccccaatttgtcatcccaaccaaccacaaatcctgaacgcagactcattgcactgtaacaaggtcctaaaacaaaatctcattgataatgtgaaccacacatgacaaaactccttaattagcaccggaaggcccaagggtttgcttaatccatattgatccatgggctattgctagagaacaaacattgctaccgaagaacgcatcaaaagcacaatcaagaatagacgccatcaacccatttgctatgactcatgagagcaaccacggcccagcctgagtcatccaccacaccacagcaacaattgggtgtgtttggttgcttgcattttcctagcctggctcatctctttcatcctggttgagtctagcccagatgaagagatacacatgcaactgttttggttgtttgcatcggtttagcccggctgagatgagattttgtttggttgagtgcatgagagatgcggtttggaaaatattttgtttggttggttggatagatttgagtctggttacctcttcatttaattgggtgaggttacctctataatatcccatacaaaaatttcaaatctagacaataggtataaacaatttttcacatacaaagaataatattggtattaaaaatcagccagcattctttgcaccaaagcgaaatttgttgagttctcaaaaaaaaaaagtcaccaaaatttccccaccatttgactgcaaagcgctggaaaaaaaaagaaaagaaagatagaagcgtttgtcctcctcattgtcgtcgaggagaggagttcttgcctcatcgctgccagccgttcccggctcctctgccgccggccggccagtaccacgctcctccgtcgctggcctctcatacggatctgccacgcgcgctcctccgctcttctctcaattgaaaatagaaaagagaaaacaaaaaaaaatcccctcaatctcatcgttgacttgcttcaccggcgctcccagctgctcctagctgctcaacgccaccatggtcgccggatctggtggcctggcggtcggagaaggcgattgtggcgacagaaaagagaggcggcgccggcaatggcgaggaagccggcgatggagatggcaagggatgtaatagcggctgcagcttctccaccggggtcggccgagggagctcgaggtcggccgccagtccaccatcggagaagacgccgaacgagtggtggtgaccgtaggggatttggtggaggcggcggcggcaagggagagagggaagaggagagcagttgagaatgggaagatgaaaatgagagggaggaggtgagcggacgccagacccctgccacgcgcgtgcacccactgatgcaacgcttgcatccaccttgcatcgagtgagccaggctgaggagcgaagaaagccatccggccttccattcaacccagacgccatagggccaatgcatccagcaaaacgttgcctcgatccccagaaactaggccccaagacggaggaacaccccccaacatacatacatacatcgaaattcctaaatccatctctcctaaactttatagccacaccttccgagcaggcggggaggggaaacctagccccaccacgcccctcggcttgcggtatacggggggaggaagagagagaggcgcgcgcgagggaggggaaggggaagggaaaccgtgggtgcgcgggctctgctgctccgggtttcccgcgcgaaatcggcggcgcgagtttactcttttgcccctgactcactacccccaacccgaaacgggacgaaacggacactgctctcctcactcaccttggggggcgcggacggcggagagcggcgcctcctcctccgatccgtcgccggcggagtgagaggcggcgggattggagattttggcgaggagaggcgatttgtggggagaagcgggggtggcgactggcgaggtgatgacgggggcagtgtcgcagtgaggagcagaagcaagcaatgtaggttagtcagctcgacgtgccacgtggggtctcctattcgttaagaggagtatactagtaccgatttgcaatacgctagaaaattacctatattatacaatactacctccgtcccaaaatgtaacaacttttgctatgaatatggatatatagttgttcaaattcatagctaaaaatgcttatattttaggacagagagagtatatattaaggatggaaaacgaaaccgctttgccatatttggtttttattttctactaatatttttttataggattagtttcagaaaagaagcacaggatagagtggaggacgactcgtattttaaagcgagattgctaatatgcactcagacgtgtgatgacaaaggcgtgcgtcgtgtgtggctgatgccacgtggtgtgcaggagaggccaagggtgaggacacgtcatagcttttttatatatgtacgtatttttatccgttaaaagtgtatgtgtatacatatgtataaattttatatacgtgtatacaaagtttttattacttatataggataagtagtagactagagggggtgtgcatcgctagggggaggcacgcgcacaggcaccaattagggctcccttttaaagtactccctctataaaaaaaatctagttttaggtttaaatctgaatacacatatccaaatttaaatctagagttagtttttttaagagaggggtagcagagagaacacatcgacactgttaggctagtttaatgcatgcgttagatgtagcgtaacataagttataagttgtttgatttattggtattttaatattttgataatactaaaattactatgaaaaaattggcgagatgtggttgtttgatttggttacaaatctttgtaggtatttgggactttttttttagactcctttgaatcactggaatgaaaaaacggagaaataaaaaaaacataggattctgattagaacgtaagtgtaaaacagatgattgcaaaacataggaaaatatataggaatgactgtttaattgggccgcataaaaaacacataaatttaaggagagataaagattcaaaggattcttttcatgagattctatcccaacctcatgttaaattttcttcaaaacttgtatgagaagagtcatttcataggaatttcataaaattcattccttcgattcaaaagaccatataggaaaaatttctataggaatgaaatcctctaaaatttctatgaatttcttttgattcaaagagagccttaaaaaaatggcaatgacatttttttgttagcaaaacaaatgctatccaactctattagcattatgtttttctttcctgcaagttttggcatcaaacatgcttatagacctgctcttaatttggacaaggaattagactaactttcttttagaatcggatggtttaattttgaaagaaaagcgaggttaattggaacaatgctaaattgagccaaccagaatgagctttccttcgaagtttgaaatcatgagcgttgcactactggtagttccaagttctgtagataaatttagataaaccgagatttaattcttagagcatcgatctgcaatctacccatacaaaaggaatcaaatgctttatacgcacgtgtgatcaagattgtcagtgtcacgaacatatcatatgctccctccgttttaaaatgtttgacaccgttgatctttttaatacatgtttgaccattcgtcttattcaaaaaatttaagtaattatttattcttttcatatcatttaatttattgttaaatatactttcatgtacacatatagttttacatatttcacaattttttttaataagacgaacggtcgaacatgtgctaaaaagtcaacggtgtcaaacattttgaaacggagggagtagtattgtatgatcatagtatcatagcaatcctggctaaatgatatgcgttgaactacaaatcatttttaggcaggattgccgctgtcgatgtttgatgtcgcaattctggtatttgtatagtatagggatcgtcggtgctaggatatacgcgagactgaggtaaaagagatggagacagggatttttatacaggtttgggcccctgagttgtcaggtaataaccctacatcctgttggccggagccggagttgcttttattcaccataatcacaccagtacaatatgtggggtagcctatctaactatcgtcgacatggcggtctgaaggtctgactcgtagtcgacgtcgacgacaaggtagtcttcctcctcgaatccgtgcccagcgagatcagagatagcgctttcgtctctcctgacagtatccggagacaccgtaggggactagccgtgcctatccctgaagtcgatatccggcgtcttgtcttggcgtatgttggcttgtatgttgtcccgtgtattgtgtctcctctcctcctatgggccttgtatttatacccataggtgtccccttgtccaagtagaactagggaaaccaatatggatacaatccgagtagttcttgtcatttctatatagaactctggttgtctttccttatccggaactccctccatatctgaagtcagtttccgtataagacatggtatgtggtgggtcctgccgagatgtagtcgactactattaggtatgtggtatccataaccctaacagtagcccccgacttcaatgcaaatgaacgaattcatattctcaaccgtagaccctggagtaactgttgtcgtgctcatgtgaccgttctcggcgagttcagagataacgttagacttcccttatcagcctcgtgcgggcacctatagggtttgtctgagtcaatctccgatgtcaaccaaggaagtacggagtagacgactaagtctcccgtcttgccgtaatcgagaatttggattgaaatcaagaaattctatctcggctggtacaccatctctttatttcgtattccttgtcgagatccagcaaccattctcgagcgatcgagaaggtgtagagtctgcgacggagccttgtcgacatttgtcgtactcgccttagtcgatcttggtgtagaaccatagagacatggagtcttcgtcaatgtcgaatagaattttcctgaaatcaatactcagaagagaatatcaaatagaaatagcccccgagcgaacgctcaaagagtgacatgttataatatatatggaaaactaaaaatgaattaaatttaccgaccaatgttttgtgtatgagcttcttctctcttaccgactttgatcagtcagtttgtagagtcatacactctccctagaccctagccttgtcgttggagaatcgttctcggaggagaaggctcttggacccttgacctgccttggttgaacaagcactgatcctagcccccagccgtgaagttggaaaactcaatttccgattacatgacttggttaatacgcacggcgagaactcttacatgaccagatcttacatggtcttttgtctctacaggatccgacaaggccttatcggctctgggcgtccccagccgaagttcccttaggttcctcggaggccttgtcaagatggcgtaaagggacagtaggataggtttcaacgctaggtgtcgtcgtggtaaggaatctctgggtaaaacacttggcgatagtgtgtacctgataccaactttgttggagtagaggtagtaggagaatcgctacaccgctggtcgaggaccaggtagtagtcgtaactcgaccacttgaagtaaaggtagtgggagaatcgctacaccactggtcgaggaccaggtagtagtcgtaactcgaccactggaagcaaatgtacgagagatcactacgatcaactggttgagaaccagtgagtaggtgtctctcgatcatttggagtcgtggtacgaggaccgctacgctgccggtcgaagactagttgtagctgttcctcaaccatctaaagtcatggtgcgaggaccgctacgctgccgtagtcatacctcgaccatctgaagttaaggtgcgagagattactacgtactggttcgagaaccagcgagcgagtagaattatctctcgaacaccaatggaagttgcggtgcgagagattgctatgtactggtgcgagaaccagcgagcgagtagaattatctctcgagcaccaatggaagttgcagtgtgagagattgctacgtactggtgtgagaaccagcgaacgtgtagaattatctctcgaacaccaatggaagtcgtggtgtgagagattgctacgtactggtgtgagaaccagcgaacgtgtagaattatctctcgaacaccaatagaagttgtggtgtgagagattgctacatactggtgtgagaaccagcgaacgtgtagaattatctctcgaacaccaatgaaagtgctagagttggtttattacatgtgtatctcatgtggccagcatgactcacatacccaacttatagcatatccggatatccgttcgcaatcatgtcgggtgatcaagccgacggcgttcgtgaggaattatccgttaacaaccttttcttgagtagtccagcgatggccggtgctatgagatagatcgtcggtcttcgttggtaggttgggtgcgataactccgcatttgtcgataatgttctcgataatagagtgtactcgaccataacctactcgagtgctcaattgttcctaaaaaatattttctagaaggcaagatatatagcagataatatcgagtatgtacttaaaaaaactgcatggatcttctagcattatcaggatataacatgcagatgtaaatatcatgcattatgtaaaccgtaaacaagcatgatttatacagaagaaaacagagcgagcccccagcgttaggccgtagttggcctaacatcggggacgcttgcacaatagatattgtataaaaaatatgctctaggtaaacataataaattatagatctgataatgctgtatgatctgaataggtacgataaattacatataaaatattacgtacttttgtagatacatgccggatatatctacgaaattagtagattaatttaaaaattcaatctgctaattacctctgttgatgtagttggataatctgcacatgtacaagtgaagcaaccgtggatgagtactgtggtggttactcctgtatacacgtggctctttggctttgtgcccacgcatgtagacaaattgacagcaagaccaaaatatacacgctgtaacagcgtgacgttaggtcctctgccatggtttgtattccgagtagaaatcaaggagattaatggatgcccgctagttagcctggtgcatgcgagtggagcggcatacagggcagtttcgctgtccttttcgtcatgtgcttgtgtgtcatcgagaatcaacacgaagccgacgaggacagggctcaagcgggagcactctcctgattagatttttggcggcgacgtggtctcaaagtaatcaatcgggccgaggcctcacgatcgacaacattgaaccgttgttctccgcagcggcgacatcttgaagcttggtcgatctcgccggatcgaatagttaatgatgatggttccgatcttgtcggggcacgtactctggtcagattagatctccctctcaaccgaagtcgtcgagtaggttgttgttggagaatccatctcttaaactcatctcgtcgaaaccctgaagcaccaaaatccccctacctggcgcgctactgtcgacgtttgatgtcgcaattctggtatttacatagtatggggatcgtcggtgctaggatatacgcgagactgaggtaaaagagacggagacagggatttttatacaggttcgggtccctgagttgtcaggtaataaccctacatcctgttggccggagccggagttgcttttattcaccataatcacaccagtacaatatgtggggtagcctatctaaccgtcgtcgacatggcggtttgaatgtctgactcgtagtcgatgacagggtagtcttcctcctcgaatccgtgcccggcgagatcagagatagcgctttcgtctctcctgacagtatctggagacaccgtatgggactagccgtgcctttctctgaagtcgatatccggcgtcttgtcttggcgtatgttggcttgtatgttgtcccgtgtattgtgtcccctcttcttctaggggccttgtatttatacccatataggtgtccccttgtctaagtagaactagggaaaccaatatggatacaatccgagtagcccttgtcgtttccatgtagaactctggttgtctttccttatccggaactccctccatatctgaagttagtttccgtataagacatggtacgtggtgcgtcctgccgagatgtagtcgactactattaggtatgtggtatccataaccttgacagccgcggtatcgagatactagatattgtaatcagacaatgtttgaatctagaaattagaaccatctgaattggtttatgttcatctatgaaattatgtagtagtgaataataataataataataataataataataataataataataataataataataataataataataacaacaacaacaataataataatagcagcagcagcaggagactgttcgatacgtgaccttaaatacattcttgaattgtttttggggaggaggacagataaatatcactgagggttgatggataggatcttctagggtaaggaagagagagggtgaatcctatctccatcatcatggctttggacagatgtccgcttcagactgaaggaagctgctctatttaagccgtacgtgatcctacagctcttgtctcatgagtagtacttttccctgcgctggctgtggcaaggtccatgagttgagtgattagagctagtagaagccttcccggtaattaatgtatggaacattgtcctttggtttttgtgagtacatggctagaataaacacctgatgtctagctatagaatagatagattagtgtaaaaaatatactaatatattagtgaaaagactaatactctggctaacagcagctacatgcatgcatggaagcacctactagtacttgttggttctgtccctttagcatagtcacatcaactagctatcttctattagtagctgtcatgcatgaaaatttatatattgaggctgtgtttagttcgtgtgctaattttttttttaaatttacgaacacacatttgaagtattaaacatagactaataacaaaacaaattacagattccgcctgtaaactgcgagacgaatttattaagcctaattaatccatcattagcaaatgtttactgtagcatcacattgtcaaatcatggcgtaattaggctcaaaagatatcgcaatttacagtcggactgtgcaattgatttttttcgtccacatttgatgttccatacatgtgtccaaatatttgatgtgacagaaaagttagaagtttgaagaaaaaagttggaatctaaacacggcctaattaatatcaaagatttgcatatttggctaggcgaaacgcacgggtagaacgatagaaaactaggcaagactacgcccatcaactattttacttaatcatctctaactaaatttgcttaccattattacattgagatggtgatactaacaatctaacagtaaatattattaatacacgaataatggattgatgattttatcagtgagaataataacgtgatagtgatacttagcctgagacggccgatacctgaaacaacgatatcgagtcggctgatatcagtgtgagatgaggaatgcctcacacaactagggaattcagcggcgtgattctcagattagggtatcactaattgggggagaaaatggattgaaggaacgatattatgacgattattttaatacctctgcagtgtatttttaactcatttactatgttaaatgtcttctattatttatcggttgttaatatctaagggtagtagtattttctgtctttaaaaacatctatatagctatatgtactaatcttgctgagtatgtgtaatatactcatatatttactatttgatgtgcgcagaaactagtcaagacgagatgtccgagggaaatgatgacatgcaaacctaatggggagcgtggtctacttagtctttagaagcatacaagaggacataccatcatgctaggtatagggtatcgtcttggtaataataagttggtaagcgaatcaaccgatgtattatgcaatgtagctggtgaaaaataaatggaaccattgttgaaagtgtccaagctctagttgtgatagttagatattacatcttgccttatatccttatggacttatatatatatatatatatatatatatatatatatatatatatatatatatatatatatatatatatatatataaggatacgacagactgtcaaaaaaaatatttgggtcgtgacaaattatgaatacaaactcggtagtttattgtcaggacctaagttaaatgaaacattatctctagtgtgtagttttctcttgataaatatttgtatgccacatattattattactctattcttgttctgaacggttacatataattgatacaaatacggattaatggtgtagggggtgatcgcaaacgcgcgccccaagcggcaatgaggaagaattgcatttgcgtgcgatagcgggtcacagttaaggtacgaatttccccactagcatgaactctgtggggtcttcaaatataagaggcaaccatttcttcttgatacacaagcacaagcccttttgagaaacccttgtagattgctcgatggggagggaggcagtgctgctaggatataaattaatagccgaccaattcggcttcgtcattccatctctcctgtagaagtaaatagtgcggtttcttgcaaaaacctctctctcggccagttatctttcggaaatgctaatgggcgggtgatcnctcccccacccgcctagcgatcacccgcccaccctctcccctatactactagatgtactcctccctcttctcccccttcctccttcccttctcctctttctactacagtaaaccatacaattttttttaaaaaacaaaagttagaaaaatttatgtatagaaataccatatataaaaaaaatttgaattcaaatttaaatttgaatcgggtatgtaaacttttgacttataaactttgggtctataaactttaggtgtataaattttagatgtatagaaatactacatagagaaaatatttgaattcagattcaaatttgaatcagatataatttaaattcaaatttgaatcgggtatataaactttaggtatataaactttaggtgtatagaaatacttatatatgaaaaatatttgaatttaaattcaaatttgaaatgggtatataaacttttgacttataaattttaggtctataaacttgaggtgtataaactttagatgtatagaaatactatatataaaaaaatatttgaattcaaattcaaatttgaatcggatatataaacttttgacttataaacttttagtctctaaactttagatgtgtaaactttaggtgtataaactttagctgtataaatttactaaaatatgaaagtaatgcggtgccaaaaaagaaaaccagaggagggaggaaggggggaggtggggagcgaatctgatcgctatcccatccccacggtgatcgattgcccattaggcgtacccgttatctttcacgacagagctatcctttgttgacgggtcgtgccactagattactatcgtctatggcccgcaaactgacccaaatataatttgttttctctatgaaatccgagatattagagcccatcgtgtctgtcctgggatcataatagccaatttcaatctaatctatcgagaccaagaaaaacaacaccaaccttaaccggcgaatgatgggccgcttccgtctcattcttaatgatctagctctgcaggagctagtacatcttaacggtcgttccatacttccatcatgtggtcgaatgcccgggattcccgagcgcctagatagactgttcgtctatgtggatggggaagagtttgtttccctcgttaccttttgaaaccctcttctctccatgttgccggccctgccagagaaaaggagattctaattcgaatccttctggtgtcgtctccctgctccatccatgacctgatcaaattgatgcaaggagaacgctcctgaggaagcatcgaaggcaaaacagtgaggtattttcccaaaccattagatttacaaaatgatctttccgtttgcttattatgtatcaatcttccataggataatcagatggataatttgcatgtttattatgtaaagaaacctagaaccaccgtccaccactaggccgtcgtctcccacggttatccccctaagcccagcgatttctcctctcttccatctatcccaaccctcctcctatccccacccaacccgggaccctaaaggcttaaaccctaactcatcgagtcaccgccggtcgccagagttagagtagaaggagtgcatcacgaatcgggacataatagaaggttagcaattccgatatttaaaacatactacctccatctcataatacaactattctagcatttaaattttatccataatagagctgctgctctatctatttcctcatcataatcaatggcaactcccttttatttagtctcatcctattctttgattattatttttaaaaaaaagtgtatcagtaaaacggagggagtacttagtgtctatgtgatgagtttaaaattttgagaaacaactggttagtaactagcttatgagagtctggaaaacccagcttctagcttatagttcattttctagattttataactacatcttcttataatttggatgagaaactggactatttaaaaaagttttaaattttataagaagttgtagctgttagaagctttctaaacatgtaagaaagcaagaggaatgtgttactccctccatctcataatactgtaatatagcaatttagtaccggttgaaatatattctagtattatgatgaatctaaacaagttactaggttactatattatggacggagagagtatatgtgattttcctaatagtgtatttcctccgtccattaaaaaaacaaacctagcacatattaagacacatcctctccatctcatagtactgtaatatagcaatttagtaccggttgaaatatatcataatagtatgatgaatctaaataagttactaggttactatattatggacggagatagtatatgtgattttcctaatagtgtatttcctccgtccattaaaaaaacaaacctagtacatattaagacacatcctgatactacgaatctagatattgtgttatattccgtactactccttccgtctcgtaaaaattaacctagtattaaatatgacacattctattactatgaatctggatatacatatgtccagatttattgtcctggtatgtatcgcattcaattttgtttttttatagagagagtagatttgtattttatttgaccgagagaatgcatggcttaatctttgagacaagcatatgaaaaggataagaatctgcacccccataaaaaagtagaggcccgaaaagagcccaatacccaaaggaatccacccaagccgatggtggttttagccacgggtctcagtctcactcccagattctactcccgctcctccatcgtcgtcgccgcgagtttgctcctctcggcggcgccctcctcgtcgtccccgcgcgctcgtgccgctgctccggccagcgggtactccccgtggcgaggcaggtgagcggggctcttcgagttcacgaggtgtcgtttttttttttcggggggatttctccaggaggattagtagagatcaggtgtgtcctcctttggatcgcttttatctgttcgagcgattgcttggtccggtagcgattcgggtgtgagactgagccatctgcgcctctgttactgtttctgttttttcctttaatggggatggttttctgaaaattaggatggcacccagcggtatgagattgttgtggattgtttgatttcctggtggttggtgaagtcagaaattgagcagtactctctgtcataagacgttttaactttggtcaaagttaaactactctgaatttgactaactctgtagaaaaaaaagtagtaatatttacaacacaagcatagtttcattaaatttatatgatgctatcaactgtgaagaggcttcgaggcaagatctacaaacgtctgcctcggctcgctaccaaactcgtaagcaaacagcgggacgtgaagcaagccagctacaggtgctagacggctttctcgtcaaagcaataccaaagtgtttcaaagaaggattaccttgacttaggtctgcctccggcctaaattaaatcaacctaagttaaatggagtctctatcgttctgctgcaccccttctcaaacaacgcgtttgatttccttccttataccaaaggaattccttctttctcttgccgatcacatccaagggtcgaatacatcctgtctttgaacctttgtagtcctatgcatagtcagtactatagcctcactgtcctcgtcgaggatagttattcattaaggttaatttgattcaatgaccagaattctgcgaggatatatagctcggagacgacgggcaaaaatgcgttcatttgcctcaaacttttcggggtagaagaactcgttagttgtagttgttccgaagggacaagtcgctcccctctgctgaccggaggaagcactttggaaaataaaaactcgatctatacctccgggcagcagagcagagggaacggagccctcgtcccgaggcctttctatgaaggcgagcagcccagcccccttgttgaaattttgatattaaggaagccgtatttcgcaatagcagctccgagaagctgggcttagggtgcgcctcctgcggtcgtttcagtgattcaattggctggcttcccccagctcagactgatgccgccacctctcccaggaccggaatgattatccctgcccgatgggtctacattcatcctagaatgtcgtcggcatccaagctttgaacaatactaaaagctgcaactcgtctgctattccgatcttcctctgatccaagtgctaccagttccttcttcaactccaggccaggcaagagccgagaagggcttcccaaatttttcccgcggaggaaggagaatccgcgagtccacgacctcctactcccgagcggcctctgactgaaaaggatcgaatttatttgagtttggttttacatgcggatctggaaatgcaagaggacctagaagaacgttgctccttagatgtatgcagctgaggcatcctaacgaatgaacgatttgaaccagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctacgattattccaaaattgccccttcgctttatcaacttccagttataagttgtaacttacttcaaacgatttgagacctcttgatatccaacattgttcttaccagaaccaaaggccacaggttattgctaatgccttccactatactcaacctgcatggcaattacttaatcaaagtcaagatgcctatccacataggaaaaacccaaagtcaaaagagcaattggcctgcaaaaataaaggatttgttctcttttgtaattagaacaaacataaacaaattggatagaaaaggagcggaaaccgattgattgtacacttgctgttctcaactgggcctctgaatctcctctggtttcacctttgcgagtcgaagtaatttccggaaagacacagaggagctctcatgcgtggaccaacagtagccctgtcctctcctctttgttggaagatgagtacacatcgggtaatccgcccacgagagcccaatcacaagaggctcatatagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgcccaaaatgcctctagaaagatcagacagaagtaagacgagctgtaattgtacgtacatgtaaagaactcaaacgaatgtcaaaacaaaggaaagatgattatcttataggaagactgccaacactgactggggttgttcaatcttaagtggagtgagttaaatgacttggcttgctcaattccttcccggtgtaatttcataaaaggaatagcactcaaagcttgaagataagttttgtactcaattaatttctcagtccctctaatcgggtgggcaccggccggccggatccccctgaaaaccgtacgtgcgggtctcctttttgggtataaagataaaggagtcgagtttacaattgaataaattttcataatacatttgtcttgggttaaaaatattactattttttctataaaattagtcaaacttagagtagtttgactttgaccaaagtctaaacgtcttataacctgaaacggagggagtaatatgaatcactagctagctggggatgtaatttactaatttacataacatgtgattgaccattgctgcagataatatgtcttgtccacttcggctagttcttagtttgctgtattaatgtaaaatcagttttattcagtggacagtgatctattagcctcagtgccgtggttgctttattgggttcaaaagaattaattgaattgttgcaaagaggcaatagttttgatagtgctaagacaatgacttgtattgtaaaaaaaaaaagtgccacatgatggggacagcgcgatgaaaagaaatcagttgtaatgacgcacaattgttttgttcttagaatatgtattgttttatttttatttttatgttgaggacctagtagcaagtcttatgctcgaaattcttggtctgctttatgtagtgatcacttgacccatcttttctggcaatgctgatttaacctcattgactccatctggcagcattagtagaatatcatcgcacccaacagctatggctaccacacaagcctcagaagcagccactgagaaaggattgcctttggggatggatgtctccatggtggatgaatatgcttcccagtccaagctgctgcaggaattcgttaaaattcccactattggcaacgcttggatcttcaattccaagactggtatgtgctgttattgctatctggttttactgaacttaggtttcttactcttcttctcgtgttgtgcagaaaacacatctagggcgatagtttctgttggccaaacagatctgttggcaaacaaaaagaggagcttcctattaaattcccacatctcaaaaaattcctcaaattctgtggatttccagtggtctcccttcccaatcgaaatgagtggagtttcagcagtaattccatcgccatctgggagaaaacttttactaatacggaattctgaggatgattcccctacaaaactagaagtttggggcccctgtcagttggagaacgagattcacattgcacaatctgttcatggatcactctatgtcgacgaatggtaaactatcctgcctcttttagaacaactttcttagttttttgtgtggtagtgggtttttttttggaagaaagacagaggtaattagggacgagagattgctccattcgccactttttgtacttcatgtttcttaaatgcaggtttgaagggatatcgtggaatcaagaagagactttagtagcttacgttgctgaggagcctcctcaaccgaagccagaattcaatgattcaggatacaagaaggctggctcgtctgaaaaagactgcaagagctggaagggaaaaggggattgggaagaaacttggggagaaacgtattccaagaaaaggatacctgcattgttcgtggtcaacatttcaaggtgtgtttctggttgttctgaaggttgaatccaaaatagctttaaaagtactgcaattttgtgaggaatagtttcattgcagcggtgaagtgcgagctgtgaagggcataccgagaacattaagtgttggccaagtgatttgggctccatcatcatcacatagcctggtttttgtggcgtggtcatctgataatggttaccaaaagacaccaaggaaacttggaattaaatactgctttaacagaccttgtgctctgtatgctgttcctgatcctttcatggaagaagctgataagccatcacttaagtgagaacacctgtccttgatgacaatatttattcagttctatttcaactatgcaccattgtaggcttcctgttctaacatattaaggtattaattgtcacattttagttattttctagtgatcgtgtgacactgtaaattcttctctcagaataattgtagcagcatatttttttcaaggaaaaaaaatcttccatatatattttcactcttttttcctcattaatcctagtcctgagcagacaaatgctaaatggattgtatgcatcatgtctcaaaaaatagaaagtttatttctgatgtcatttctgtttattgtacagtgtcagtaagggtgaaactgcacctacaaccaagttaacatcagagttgagcagtgcttttttcccacgattcaggtaggactgcattcagttttctttgctcagtactgttattcagtttaggccatatgtctcaactattatattggaagaagtacaagctacacatcctagccgtatttctttaattatgcattataattgttaggcgtaatttttcttctatggtttaaaatattttaatcaaattcccttaaagcatgtcaattgattgttcatgcttgttatcatgtattttaacctaaatatttgaacaatcataattcaaatgggagtgaatttggaaagtggagcattttgggctgatgagtaggtgtctttattatttccttgttcctgtaatcctgtggattgactcagtagatattaatttactgcaacaccaatacattttatttgcacatctacaattgaagttttcatgtctagattataacttagtactggtagctgatgcatgtagatgaatgttaacaatgcgtcgcaaaaatgatatggaatctttattgtacagtccagatggaaagtatcttgtgtttatctcagcaaagagtgctatagatagtggaacacacaatgcgacaaattcaatgcataagattgactggcctgcagatgggaaattggagggcctcagtgttgctgatgtggtacaacaatgcctttcctttacttgttaattttttaatcgatcattttgtttagatggcttccttttatatatagcttcaaagtcatggcttggaaaaatacataaatctaaccagtgtttatttgagcacattgtttgcctgttggctatacttgattaaagatatgtatttctggactttgtgaagtggaacttcaattatttttttaattattgaagtatctaaattcaatttcagttaaaagaacgaagttcagagggtaaaatttataatggtgtgtttctttttataggtgctctgcatatccgatatcaagttcttaatgtcttagctgttatgtaggtacctattgtgatgtgccctcaggatggttgttttcctggtctgtactgctctggcatacttaggaatccatggcttactgatggacaaactatgattttatcttctatttggggaagtaaggaagtaatactttctgtaaatgttgtgaggtgattacaagcatttttatccatcagttagaatgatatggctataaagtttatttatttatgaaattacctattttcttcacagccgtgaagtttcaagagttagtcctcaggattcggattattcatggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatctaaccatgttgcatttactcaaggcaacactaaaatgcatttgtaagaaagttctcaaagctcatggtagaatactcttcttggttgtttgcatccttaaggatgcatgctaagcttcatttgcattttaatgtttgaaaatgtactttagtagaatactcacatcctctccccttcctaaatttttatattttataaaattgattcaggtgctaagctgccctttgaggctatttttgtgtcctggaaggattctgcaacaagaccaacaattgttgttcttcatggtggaccacacactgtttacccatcaagctattcaaaatcgttagcatttctttattcacagggatataaccttcttgttgtgaactataggtgagctttatttttttttcttccagtagttcttctgttgaactaggttaaaataccctgtcctttctgaattctgctttggaaatatatcatattaaacactaacattaatgtccacgtacacaccattctgttgcctagaggttcactaggctttggtgaagaagcactacaatctcttcctggaaatattggttctcaggtgcactgttgttgatttatttccatgttttaagattattttcttaagttgccagaaattttatatgaactgtcattacgtacaattgtttaatactcatgaacaggatgtgaatgatgtattgacggctttggactttgttataaagaaaggattaatagatgcatctaaagtagctgttgttggaggttcacacggtggtttcctgacaactcatttgattggccaggttcttagcatgcctttgttattctgaattctttatctatgcaattattcattacatttgcagtttatatttcctttagggattcaattatttgtgcctaatcgtttgcacaaataatctagcacaattcttgttgtaaactgtatatactcatttggacataattgggaacagtgtcttttgataatgtgtattggtctatatgaaactcttatatttgagaaatgtgctgtaaacttataattttgggagggaggttgtaatttgtaaaagagagtagtaagtttaatataagtacccaagcacactaagttatggtcagtgaacttaaaggctcaaagctaaacttggatatttcaggagctctgtagcagtgcacagctaaaaattcttttaaaaaaatgatgacaccaatttatattagctattaaattatatattacattgcaacgcttaagtccagaataatatcctagaaaaacattcttacaagagttaggatcagcatttgtttccttttcttggaagtaaagcttcactgcagtgtaagccgagctgtttttaccttttcatgattaagaagttcacatgtgatattctcaagaatatttcctgattttagaatataattatttccttgacaaaaatagtgagaaactactgctgcatgtgggaactaggtctatacagtttctttatgactatacatgcaagacaataagagttcatgataggtctatacagtttctttatgactatacatacaagacaataagagttcatgatgcacaggcaatagcacatggattcttctatttatcaggtcttcttggattctgttgaccttatgtttcatggactgcaggctccaggcacttttgttgcagcagctgctcgaaacccagtatgtaatttatcattgatggtaggaacaactgacatacctgagtggtgttttgtggagatttatgggaaagaagggaaaaactgcttctcagagtatccttcatttgatgatctttgtcaatttcaccagaaatcaccaatatcacatatatcaaaggtatgtagattctgcatacttaaccttttacaaaatctatgcttgaggaagaaagtgtagttccctcatgcaaatttgctccttgaggactttgagtaatcttttcttgacagtttaagaaaatctgcaggtgagcacgccaacactttttctccttggagcacaagatctcagagttcctgtttctaatggcttacaggtaatttcttatgcacttctgtttcatttttatatgatgaaagggttgtgaaatgattactagtagcaatgttgcattcatgttattgtttgcgtagacaagttcagtcaattttcctgaaaaccattagtgaaagcatatgattcatattgttccactatatactgcttgtatctatttatttattttcacttttacaaatgctggtttatgcctaatcataatcgcaacatatgcagtatgcaaggaccttgaaggagatgggagttgaaaccaaaattattgtctttccagaagatatgcatggccttgacaagttagttgtactttttaatcattttacctttgttaccccgatcagtgtcttctgtgttgcaacatttgactaagtcaaccttgcgtcccctgtgcaggccacagtctgattttgaaagcttcctcaatataggtgtttggttcaagaagcacatgagcaaataaacaacatgcctctgttaccacactctcaccttgcttaataaatgcttgtaatttgggtcaaagcagcccaaggaaacgtggttctgttggcattctaataaattaagcctgctgtaacatttctgtactgggataattcttgaaaatgtaaatgcatttggttataaaattttaccctcgtggtacggaactatggattacaaatatgtgatgttagattatgctttactttgaactttgaagtacttctagttcacgggatgctgtcctgtagcctgttgggcttgggcattccttttatttttatctttttttaggaaacaatgggatcataatttcttttgaatttcagtgagaaaaaaatacatgaaagttcagttcaagttaggcacatggaaatgctgattgagaccactgtaacttctgcttctttgcatcaagatcccttgaagttgccttctggataatctcattttcatcagatggtacaaagagctttgttgtttcatacgattttaaaaaggacaacaatataagttattgcaaaggcttcttgtgctgttcgatgctttcttcgtggatgcggacctgacgcaaccttttgtccttattgctgggttcctcttgtctcattgtctatggtggtatgtacgatcattagtaactttttaagattccttttgttattttgggcccattctttgagacctgacacaaaaagaaaaccaaaatttgatgccatctgatcctcaccaattgtttgttgttaggtttgttgggatcgttgctaaggactgatgatgttttaaagctcaactgcagtcttggatcaaccactctgccactagactccatttgcacttcactgcaaaagcagaaaaatatatgtaagtattctcctttccttcgtctcctgaaaggctaatacgatttataatctgattttattgttttgaggcttctaacttgctgaattttgttggtcctaagttgtttcctcctgcactcagtctggtcctcttgattattgctgtagttccagaagaatctgattttgttagtagaactagtcccagacttaacatccaggatttaatattttttagtgttcatcgtattttttagttatgtttatacttttgtactacatgaaaatcaaagcatttagtgtcagagttctccagaaaaggattttggtgggaaggaagaatgaaagatacttcattttattaatcttaggtagccattatagaagtttccatgttttgtttgtctaagtgattcaatattttttcttgaattggtgcattgacaacgtcaaatctgtccatggattgcaagatgaacaattgggactgttgttcttgagttgttaatggaatttatgaagtataaattaaaaaatagtttgtgtctgaactacattaaagtgtatgaaatctgagtcttagtacggtagtacctgaaatttttcacgggtaactgcaatttgaattatgaaagagttaaggtgatataggttgagtggtgtgctctaacctctaggctcttttggcattgaaatgtatacccatacatcatgaagttgaagtcaggaattcaggtttctcagttttcatcttatcagtggaattgacaacaaaatatacttgagcttccctgcagcttgtttaacatactatattcttgagtttcccttcagcttcctcagcatattaacctttgtgacaatgcagatttagcttaacccagtagattgtgtctttccaaccgaccttacaagtgatttgaatcttctttgagaaagacaatccattgggaatggatgcactggcatctgaagaatacgcttcacagtcgaaactacttcaagagttcaccaatgctcccagcattgacggtgcttgggttttccagaccaacaatggtagggatgattttcgattatacctcattagtaatcatcattttactattttccagaagtggcgtaaagcaactcttgtgtcatgtttgcagaagacagatccacagcaatgtattcgattagccaaacaaacctactggcaaacaacaagagaaaatatattttgttttctcatattatgagaaatggtactaaccttctggactttcaatggtctcctttccctattcaaatggatggagtgtcggctgtcgtaccatctccatcgggatcaaagcttcttgtggtgcggaatggagagaaaggttcccctacaaagcttgaaattgttgatcaatcacatgtggagaaagagatacatgtagctcagtctgtccatggtccactttatactgatgagtggtaaaagtacagcataatacctgcacttttcagtccattcaacctatctgtacaatattctggatcatgatactatttttgttggcacaggtttcatgggatttcctggaaccaagaagagaccttaatagcatatattgctgaagattcacctgaaccaaaaccagtttttgatgatactggatatagaaaagaaggttcttctgagaaagactgcaataactggaaagggcaaggggattgggaagaggattggggtgaaacttactccaaaaaagggagaccttcattgtttgtccttgacattaataggtctctcagcaccttctaattaatacataatgttgacctgaccatagatctgacaatacgacttactgaaaccgtttatttgttgtattcagtggagaagtacgagctgcaaaaggcatttcaagatcattgagcgttggccaagttgtgtgggctccaccatcttcatgtggaaggcagaagtatctgatttttgttggatggttagagcacaatgggtttcagaatactcctagaaaactaggcatcaagtactgttctaataggccatgttctctatactcaactctttgccctttcgaagaatcagatgttgataatgcaccagctaggtaagtaactgagcacccatcttcagatcatgctgtaactttgtaaagtttacaaatttactttatttatcactagtttgttgaaataagaaaatgtaaagctctgaataactatgcttatggggcagttgtaagttgatatttccatgacatttttccagtgattctaaattagagcctgcttcagtagcaatcaacttaactccaagcataagcagtgctttctttccgcggttcaggtatgcccgcattagtatttgcgtattttcttgaaggaccttaaaccatgctagaaaaattcttcacggaaaatctctaattattttcaacagcaaggatggaaaacttctggtgtttctatctgcaaatcgtgctgtagacagtggagcgcacaatgcaacagattcactgcataagatcaactggccttctgactggaaaatggatcaatacctcgaaatcactgatgtggtatgtcctcagatttgtcttgaccggtacttatctgctgtctgcagtcaatttatttaacttctgaactgtgccagattccaattgtaatgtgtcctcaagatggttgttttcctggtttgtattgttcttccatgctatcgaatccttggctttctgatcgatgtacaatgattctgacatctgcttggagaagcactgaagtgatattatcaatcgatgtgttgaggtaaacaaggttgctcacatatgcctttctactgcttcaaaaatcattgcaatatcccatgctatttccttaattcctcctgcagtggaaaagcaacaagaataagcccagaaaattcagagtactcatggagtgctcttgcagtagatggccacaatgttcttgctggtaattctaggtgcacataatcagttaacttatgcatcaaattttattattttgggtgtaataattttattttatttttgtttgttttctagtgtcaagcagtcccatcgacccacctcaaattaagtatggccatcaagtgtcattgaaggatcagacatgtacatgggtctgggacgaagttaataataatccattgatggcagctaacaataaggttagatggtgtacaatttgaagtatacttaggtgttctttgatgctttgaacaatgtaatttactaaatcaggcttttttttttcattctcacattaccatctgctgcaggtaaaggctttgttgtcacatcaccaattcagcatactaaaaattccagtcactaacccctctgatgacctctctgatggtatagtcatggacacaaatattttagactatcatatgtggcttatcatcattcaccaagcaaatgttttttatatcctgcaggcagtaagcttccatttgaagctatctttgtgtcctgcaaggacagttcgcacaaaccaactattctagtccttcatggtggcccacactcagtatctgtatcaagctattcgaaaacatcggcgttcctcgcatcacttggatttaacctacttattgtaaattatcggtaagtttgctgaaacatttctacagttctgatcaattaagcttatggcatcatctcactatcatctgaaaaaaaaagagggacaccgggttttggagaggaggctttgcagtcacttcctggaaaggttggatctcaggtatgtaatccagctaaactctgagtctttgtttctcatgaaccaacctaatttctgatgtgtgtcaaactgtcaagcaggatgtccaagactgccttacagctctagactatgtcattgagggaggacttatagacgcatctaaagtagctgtcatcggaatttcgcacggtggattcttgactacacatctgattggtcaggttagcatcctaacagattttagcctctcaaaggaaaagaagaagaagaacaaaatcctaatagaagttagtatatgtttcttgttcagcttgtaatttgttgttattttgtttcaggctccagatagatttatggtggcagctgctcgtaatccagtctgcaacctatcactgatgattggcaccactgacattccagattggtgttatgcagtggcctgtgggagtgaagggaggcaacatgcctctgaatctccttcacctgatcatcttcgcctcttctatcagaaatcaccaattgcccatatttcgaaggtgcatttctgttctcgccttcattcaaagagcaaaaaagaaatgttcttactgatcaagtcattgttcttaaaaacaaatgaaccagagaaatcaagtgattagctactcaaaaaggctcactgaactttgctgattttttttttctaaaaaaaaaaactttgctgatttcaacaggtgaaagcgcccctgcttatgcttcttggaggagcagatcttcgagtccccatttctaatggcctacaggtacatcaatagccgtttaaatttgcctcagtagtttccactttcaattcgttgtagaaatagtccataacaaaaaggctagatcctgaaacaacctaacaatcccgtgaaaagaaaatcaatcgacgggctacatcaaacagacattctttaaattcatctacactcgattaataacctaacaatcctgcatttgcttcactcatttgtcggatttggttaaactattcctgctcggatgatttcagtacgcaagagctctgagagaaagaggcggcgagatcaggatcatgatgttcccagacgacatacatgaaatccacatgtaagcaagtactgatccgaatttcagctcatctgctttatataaaatgtcggcagcagccgttcgaaaaaaaaaaagacattcagatgccattgtactattgcttttgtgcctaattttctccctcatactggaatccatgcttttgttcagaccacaatcggattttgagagcttcctcaacattggtgtctggttcaagaagcatcttagcatatcagcatcagatgcatctgcatgaagtcaacttgaagaaggggaggaagaaattacgtggtttaatctagtccaacaggtagatgccattgtaagccttgttcatggagctcgtccgtagacgagtgctccaaaatattagagacttccctattgaaaaaagtaaatggagactttaattggtttgagttctttccttttcccttcaattcacatgcttgatgattggatgcaaattcagtcggatttactaattactactagctactgctctgaccgtgattgatgatcagtccaacaacaatacttgcaaaatagtgcaatccaggagggtgttgttctttatgcacgttggcccatgatttttttttttcaaacaaagtcaacagccgcgcgagcaagtacaaacctgattcattaagtaaagtgtggttttgtgaattttactcttgcccggcgaaaaatttactgccccctgtgaattttcctcttcattctgaaatactttgcacaagccaactcacccatcaacatgccaacttaatgtaagcaattaaattggtgaaaaattaaacacgccatcagattgctacgttaaaactacaaagctggaaagcacaacaaggggggcgagagctataacaattttacaacaacaattgactatatcagatgtaccaaagaccatgtcagttcttcgttgaggcttgggcaagctgagatgctactttgtttgagaagaagctctcgagcctgcacaaaaagaaggaataaaaccaaatcaattagacaaccaggtgactgagatgctactttctttgaactctcgagtatgcaaaaaaggaacaaaaccaatcacttagttagacaaccaagtgactatggccttgtttagtacgcgaaaaaaaaatttttgggtgtcacatcggacgtttgaccggatgtcggaaggggtttccggacacgaatgaaaaaagctaatttcataactcgataggaaacagcgagacgaatttattaagcctaattaatccatcattagcacatgtgggttactgtagcacttatggctaatcatggactaattaggctcaaaagattcgtctcgcaatttccatgcaaactgtgcaattagtttttttgtttatctatatttaatgctccatgcatgtatccaaagatttgatgtgatgtttttgggaaaaaaaattgggaactaaataaggcctacgtttcaaacacggacgataaataattaatgccagatttcccccaaggtgaatcttctactggttatgatagaaagacattattgagtgcacataaatccaacatgagatgtaaccacccacgtttctattaatggttaggctaaatattttcaaagaaacattgacagatgcctgacttacaggtagatgaatatgcaaacacaagattga

SEQ ID NO: 81940 - DNA, 15103 bp, Oryza sativa
gtagctcacgtgcctcggcgccgccgccgcgccgtcgccgccggcgacggcgaggtctgccagcggcacggacaccttgccgacgagcttgctcccgagcagcggcacctgcgccttcacctcgaactgcagcataccatccgcggcggcggggaggtcgaaggcgaagacggcggcgtcccagtccgggttctccccgccgtcggggtcgccgctcgtcttctcccggcggccggcgagcgacacggcggcgtagagcggcggcttctggaaggggacgaacgccttgacgcccctgcaggagatggacctgatggtgacccgccggccgccgccgccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaattatataaaaaagcactcaaaatgctgcagtctctctcaaagaaatcaagttcgttcagtactattttagaccccacaaagcaagaaaaattgtctgataatgcagttggttgtctaattttcttcttgctttagtcattgcaccacctgtctctttcttcttttccccaattccacactcatttgatatttggtagccgtactatgttgtgactgtgagaggccaccatacatacactatattaaagcaacatttgccaataagagtagaagctgttttaccaggaaattggataagctgaaacccatctaaccatttgtgatagcacaaagccataaactgatgtgtacaggcccatagatcacaaaacccaatgtagcacaaacccaatccaacacaagaaaaaaaaaacaacgaaaaatttcgtaccaatgcttaacgctttggagcacatggacaaaatattcataatcaagagatgaacacgtccaaccatgctgttgcatcctatgaattagtacaatggcaaactaagtgaaagacattacactacttgattatgagagcactgaagggatatcttcaaggacaaggttatttcatctatcttaccaaactttatatatatatatatatatatatatatatatatatatatatatatatatatatatatatatatatgaaaatggttctatacacctggaagtatacacctggaagtatgtacacctgctcttatccaccgtcgatctgtgattagcttcgatggatcctgatatcggattaacgagcggacccgtttaactttttaactagaaaaaaaattacgtaccccttaatcacagaaaccggaatgacatgagctcgcataattcctcggtcccaccagtgcatcggatacgaaaatcaggtcactgggagagaccgcgatataccagaactcggagaaggcggcggcgattcatcgtcgattccgcgacagcagcgagattcatcgtcgatccatggctgcgttgcaggtgacggcgtgatccatcggcgtggcgacctgcacgcgcggcgcggcggcggtgtcgaccgatcggcaacatcgtgcggcggaattgcaggtcatcgtcctccaaggcaacggcgcgacgggacgggactagtcgacggtgcgatgcagcaatagttgaactaacccaggcggcatcaatcactcgtcgatctcccgcaaagccttttcgaaagcgacaatgcatgtggttagtactacttaattatttcttatgtcgtgtatatcatatcaatcttatcttctttgcccaggcagtcgtatggtgcatatgcacacctcggagaggctagtgacgctagtcgtcgctagagtccgcaatatggtgtgcttgcacttgctccgatcgaacaatcgggatcccagacgatggctgtgccgatctcctgaaatccatgacgattggttcttgctttttagtacatatatatgtttttgatgcgaacggccgactgaggaaatgatgctgaaatcctgacagtaatgaaaccatcttcgttttctttcgtttttgaaacattcagttcatcctctttattggcagaatagatcgatcgaggatatttgcagtatatgcaatgcaatgaccatatcgtgcatgtatgtagctccataataattaattatgcacccacgcatttcaggtttagatatatactactggtctatttcagtatatagcttatgaaaaaaaaagaatcggtattcggaagatcagtgcctactaattatagttcaatgtgatatgtgtgtttttctgccatgacaagtacatactgctagtaaataaaaaaaagacactcactagaacggataccctcatctcaatcgggcacagcgtccgtcacaggctagaagtcactgatgtgaagagttatctcaatcgggcaaacagccgtcacgaatgaatatatctcaatcgggccctaagtaaagcccgtcaccgatagctttgacccagacgaccagtcaaactatagcccgttacagatgacctatctctatcaggccacaactagcgcccgtcacagatgactactaacctttatcgggcctaaactagagcccatcacagatgatactcatctcaatcgagcctaaactatagcccgtcatagatgactgatgacctcaatcgggcctaaattagagcccgtcacagatgactgctgacctcaatcgggcctaaactagagcccgtcacagatgactagtgacctcaatcgggcctaaactagagcccgtcacagatgatctcatctcaatcgggcatttagttatggcccgtcacagatgactataatccacaaaaaaaataaattttgttttttggctagcctcaggcctttgctagccatgcccgctgcaaagatgacagaaacaaacgcagatatccaatatccccaactccccagcatcacccattcatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattattcatcattttagtttaagcctaaacattcctttgggattaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatattgtggcacacatggaatccgcactggtcacctatttgttgcttcaccgagaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaatgatccaatgggcactgcggcattaatatagtgaaagttaattaagtactcaaggaatgtgtcatgctgttgtgtatatttagttaacacacttactattgattataggcacacataatgtacttcttgtctcggcgggaccacaaggtgtcgtagatgtagttgaccattccttgacggttattctggagatttgtgatagtgaccacttgtggatcaaggaaggcaacttccggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccactcagagcctgtagaggtcgaaaagatccttgaagtcgaccacgatataatttgttggaccaaggaaaggctttccatcgtgctgtccaaggatattggtagctttacttggcttcctggcgttagatttctccatgtagtataagtgaaggtccttgcaagcggtgcccattgcggcaagcacgtcatctccaaccaatggcatgcctagttggaactcctgtggagtgacgtatttcttcttgacctctttgcccttagtctcttcctggcccttgcccagatctagctttcttggagctagaagcgaggcctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccgaaatccgtgtcgtactgcaactgcacatcgtaagattgtgcatgacgatcttgagcaggaggggctgaaggagcagaggcgggtctctttggtggacgaccgcctggtgcagtggttggcctcgctgtaaccctgatctcaatgaggtccttaggccattggatgaaggtaccacgggcatttcctagtgagaggacctcgtcgttcggtggatacttcagagggaacagctcgtattcaggcttcaccgagtcgacttgaacttttgcacagtcggccctgagttgcgctccatgcactcttgtctctggggtcggcttgtacgcaagtccctcggctgctggaacagtgaagatcggcatcaccctaactgtgagggtgcagctcgttggttcctgcgatagattaatcaatttttttagaatattatatatcatatggattcgttacgtctttcatgtattgagtaagttcacggttaccgttatgtggtcgatggcgctgtcgaccgatgttggattttccgccaactcagttgatgcgcaactgctgcgtttttcggtgggacttcctaactctttgtgcgcagcagtagcggcagcctgggggatctgttgctcttctcggatctcttacctaatcttggccctcatcgactcgagcttttcgtcgaattcagatgtcagctcagctcgtatcgactcccggatcttggcttcaaggcgtgcatctttcttcgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgattagacacttactatagcttcgtatactcgttgatcttctacatttggcatgaagattgtgccatcatcatgtttctggtacctagccctggcccagttcctagcccgagggtgtgggatatcgccaaacacgagcggtgtaccacgattccttcgcttcttcatcctcacgctgccattcctcttccttaccggcatatccggcggtaccaagccggtgcggatgctggttcctagtctggagcaagcgatatgcctcgcttctagctctggactcgggggtcgacttcttcgcatggaattccgaccagacctgttccgtgatccaaggaaatttctctcttggatctggatttgccgggttgtagacgaactcgccgactagcttagtcttgaagttcttccaagcagtgcccataaccttgaaagcagcccgcctgagacggtcctcatgctccgcaggataatcaaagctctccttgaacgttagccaagcaatgtccttctctacggccggcacgagcttgaagtcgtcttgcagaataatgaatttctgcctccctatgaccccgcagatagacctaaatcggctcaatattttccttggagatgtcggcaaccctacggcgtctaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaaacacaattgagtgctacaatctattacaatgaattgaatgtcacttataaaaataaatgaaatatataaataaactaaattgcgcatatcacaacgatagaatgaattgaatggcacatataaataaattaaacatatcatcaaatcctaaaatcataaattcacctcataccatctattcatccacatatcatgcatctatcactaaattgattaatgcaccacattccatctattcatcatcatgtcatcaatcaaaaaatcatccgtttaccatatatcatcaatccctaaaatcatctatcactaaaatcatctatcactaaattcattaatgaaccacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctatcactaaattcatcccaacatccacatttcatcccaacatccacattttcattatcaaacacatgcaggtagcagagggaggcgcgatggaggactcacatgaggtcggccggggggggggggctcggtggtggcggcggcgggctcggtggagggcgtcgccggtcggtggaggtggcggcgggctcggtgcaggcggcgggctcggtgaaggaggagttcacggcggcggcgccggtcggtgtagacgccgatcggggaggtcggcgtcgggcgggcggcgtcgggcgtcggtgaggagtaggtgacgacgatgaggaaggacgtcgccggcctcggtgggggctgctgttcgtgtcggtgaagaggcaagcggcgacgacgaggaaggccgacgtcggtcggtgtagaggctcggtggcggtggcggcgggctcggtggaggcagcgggctcggtggcggtggtggcgggctcggtggaggcggcgggctcggtggcggtggcggcgggctcggcggcggtggcggcgggctcggtggcggtggcggcggtctcggtggtggtggcggcgagggaggacgacggcggtgaaggaggagttggcggcggcgctagggttctaaggaggcgggaaactgtagcgggacttagaaaaattttcgatccgatctgagaaaccctagttatattagagtgatgagtcatctcaatcgggctttagtatggagcccgtcaccgatgactcattttccatctttcatttgttgtgagtgtaaaatatatagcaactgtgtaataattcattttattagtcataatacattttcggatagtaaaagatttcaaatggaaatatggtcaacaacaaagttgtagagcctttcaagatctaataattttattttggtcattattctatataatttttttcccaacagcttgaaattgatttcgacaatatgacaaatctaattaatagcatttgtaaatactaaatgatttcaaattgaaatatggttaacaacaaagttgatcctctcatcacgatctacaacttttattttggtcatttgtaataaaacaaaattagccatattaatgactacacatatcaagtctttgcaataaaacaaaatacttcattcattacaatagataagtacaaatgcatcagtcacaaggttatgccttcggtatgatctgaacgagcatatgccacaggctcttggggatcatcgtcaaggtcaatgtgaggtcttacatgaagattatggttgtattcttcttcatcgacggcgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgtcggctttgacaccagtgcgtagattcacctaacggcagcggaacaaaggaaccgtgaacttgacgtagtttagctcccagatctcctcaatgcggccgtagtatgtgtttgacccaacttgatcctggaatgcatctatacggacgccgctgttttgcactgtgcttttgtcatcttgtttgacggtataaaatgtgtatccatttatatcgtatccttgccatgtgtctatggtccaagacggtcccatccccaacaactgtactatctcatttgggacatccgtggacattgtcacacgattcttgaatcattcgttgaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgctggaactccgataggatcggcatcgaacatgtaattgacacagaactcaatagcctccttggtcgtgtaaccttcaatgatgctcccctcgggtttagctctgttacgaacgtacgactttagaactcccatgtacctttcaaacggccacatttcccttagaaaagccgggccacatagttttgtttgcttcaccagatgaacagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacattggatcgtgtgacgcactttcggtggtagagtgcctctgatagcaactggcaagatttgtgtgattagcatgtggcaatcgtgagacttcattccaacaagttttagatcgttcaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctacgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccattaaaaattttcttctttcttctaaatgtgtgacgtagcgggagccacctccggtgactcatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcaccgcccaatggagaaggtataaacatgtcatgctcattttcatcttcctaattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagttatctctatcgggccttaataaaagaccgtcaaaaaagagtgtcatctgtgacgggcaataaacttatctcaatcgggcctctagttggagcccgtcacagatgaccctcatctgtgacgggcttcttttagggcccgattgagatatggaaccctcatctcaatcgggcctcaactatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgctactatactaaacagtatatacctattgactaaataaaaaacggtatatactccctagccgatcaatttattatatattggatacttggaaaaacagttcataatccttaaccgatcgatttaatacaataatagatacttgaaaaatatagtatatactggataaaaaaatcagtatatacagataaaaacagtacatactgctagtaaattaaaaaacagttcatacctagtaaataaaaagaggtatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtgtaagcttggaaaaaaattggcctttgcaaaaccacctagtggaggccacataagctagaaatcatgaaacatgagaattatttggacatttatccaaccaatactttggaatatctaaacaaagatagttttgccaatgctttggtgcatggaaagaaaatatgttgataaggctgtgccagattgctttggcattttgcaaagttaagttagcagttttgtaaattatgagctaggtaaagaatcttttagaactgaatttgtatgggacttgtagaatgtgttacacaagtcacaacttacacagataacaattaagagtatgagtcattgccatatgtgaatgattgagaaggtaaacttggatatttgtaaatgtactttaatagcatacatacatatgcagtttggcatgtatttggagttttgttaacaagaattggaagtaacgaacattgctataaagggaaagaagtaaaggagaaacaaattttgggtccatcccaaaaaataaagcaatgattagagtttggccatactctttgctatcctactttccatgtatctagtcctttatcttacaaataaagagaaatgaggaagtaaacatatttcatgtattcatattatgacgagacacatttcttaggcagacactactgacactatgcaagtattaagttgcattattttcaaatttaactatgtcataattatccagttcagaatcttcatgcttttagttgcattataaattgggatggagaactatacaatgtccatgttcataatcttcatgcttttagtgctatagtaatagagttgttccaaatatgatgtatagatcccgaaatttccatcctggattgaagaaacactactaaaaaacgaatttcctgtacgagcccctcgttagattccagacggtccataaatgaccgcgtctggaaaaatcatcctcccatttttgcgtgcggacccttaagaggaccgcacgtgaaaatcgattttcgcgtgcggtcctcttatcatcctcccatttttgcgtgcggacccttaagagga

SEQ ID NO: 81941 - DNA, 1172 bp, Oryza sativa
tttttttcaaacttccaacttttccatcacatcaaacctttcctacacatataaacttcaaacttttccatcacatcgccaatttcaaccaaacttccaatttttgcgtgaactaaacacaccctaacctcaatagcatatgtatgcaacttttgtagtactaacaggcaagcaagatgccaaagcaaatggaccatcaccagcggatggaaaggcaagcatcagattggctaacaggcaaatggaccaccagtatttcccccaatacactgctagctagtactaccagcctaccactatcacaatcccagcaaagaaaaatggcagccgtttcactggaaatagctgttggcacatcagtgcctggccagccagcagcctgctctgccctgcctgcctctactcatgaatgatactagtagctcccccaattcatacgaacaaacaaacatccatccaaccaggcaaaagaagcagcagagaagcaaaccaataaagaaagaaacggcagctgggagggcattgaagagggcccctggcagcagttggggtagctttaagacccccccttttaacaaccttatttgagaagagaaaggcagctggtgatagctaagctactccttagatagaaaaagcagcagaggacatttcatatctcatctcacctattgccagtacatgcaccagtcccaaaacgacattgagccaaaagatggcacacagaaatcacccaaaggccaacccccatctccactctcgaagtggcagccatgcatggcaacagtgcagggcgccactctagtggccagaggcagcacaagtgagggaggaggtgaaagagacaaggcacaataggggtgatcagaaactatgacagagtacagtggaacagtgaccactgggaagctatctccactgtcagcaatggaggcaggcggaggaatagttgctggatagcaagaaaagggcaaagcttcgctccactagacactggtgcgagtgggccccagctttagtgcccactgttcaaattacaactctgtaaaaatacagtagggagggccaatcacttttagccagaatatcttacattaattttattgtagagtcaaagaggtacaagggtgtttacctggtagcacggtcacgattcgtggtttcgcactcaa

SEQ ID NO: 81942 - DNA, 1570 bp, Oryza sativa
taaattatatagtaagtctaatttatcactatttgagttttagtataagattaggtcggccgtcttcgtccacttctgttatgatgtgccgaccctcaagcttcttcgcggcacctcgttgcccgcgtgccctcttctgtccaacggagggttgacttccactggcctcctcctcctggttcccctccacatccctttccacgtgcccctcccggttcccctccgcatccctctccacgttcccttcctcgttcaaatactggtttggatcctcgttcccctcttcttcgttccagtactggctacttccctccgcgattgtatcatacaatatctgttcctcattacgatcagccatctgttcatacaggaaacatctgctaagtcatgagacatttatgttttaacaatcttatatgctaacaatcatatgctaagtctaggtgacgtatattataggaccctagctaatcaataaattatatagtaagtctaattacaaatctaataatcttatactaaaactcaaatagtgataaatgctaagtctaggtgacgtatattataggaccctagctagtcaataattatatactaagtctaattacaaatattataatcttatattaaaactcaaataatcttatactaaaactcaaatagtcatgtatgctaagtgtaactgtcgtatattagaaccctacacaatcttatatgctaagtctaattacaaatctaataatcttatactaaaactcaaatagtgatatatgctaagtctaagtgtcgtttattaaatctaatagtcttaattgcattacaaatataacaatcatatatataattacgtcacttgcctgcgcgaatgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactcgggtgtaagccaagactctacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctagagctacacagtattattaatcaaggtcgtgaacccgcatgaacctgccttaacccaaggcctacatgattcagaccgaactggcaacccgaccctgggtcccagctcgtcccaagccaacccaggccaaccattccacattttagttgttgagcaaattttaagaattaaaacactaacttgggtacattgcttggcttgcccataaccgagggcgcggctattcgaatagattatactctgatcagaggtgta

SEQ ID NO: 81943 - DNA, 15529 bp, Oryza sativa
gcttccagccaccattatctgctccatcacccacatttttttaattttaattaattaattaattaagtgtaggttatagtgtactcctactaacgtcagaggagagtatcaacttgtgcaatatacaacagctagcacatcgtctaattagctgtactatccgcatagtcaatcagtagaaaggccatgctggagtattatatacagatctgtgatattatcttggtagccagtatgtaattatatgagatctctatgtatatatagactaaagagacactcatatgcatgatttcttacatgatgtgcaaacaaaaaaccaggtgaagcttatatgattaagctagctaggtagatctactttgcttggattttttatttaggagtattgcttgttgagttgtggagtataaaactacaccaattttgaaatttaatatataacttcaaaattactaacttggttttctttccttaatttataatcactcaggtttgctttggagtttggaccactaattaaaggtagaaatgtaaagaccttatcctgaaattatttttcgttgcattggttacgtatactccctccttttctttctataaggtgtattataaaatcgaaatatcattaaaaatataattctattggaacaatttttacataccaaatatatatattcatagtttgagtaattagttttgaatttgtaactttataatattccttatataaaaatagttggagtatataacttgtacttacagtaattaatgccagcggaatagtaagaaaaatatgctcctacagtgtatgctagtcatcatatcagaacaggataagataaaatgccagctgacaagattttgctggtatatccatccttcacaggagtattttactacacacgtactgtgatgttactctcaggttaaggtaattaatccagtgccagggtaattaaccaaggatgaaggggacaatgcaaggtgtggattgcttgccacgtgtaccgcattcatggtcaatggtgggaaagggtttaactggggacaaggtagcggtcagaacggggtttgtcccagagaggataggcgaccaatcagcgagcaacacgtatacgtttatctctctacctttcccttcttggtttcgggctaattaacggaagaggaatgcaggatttaacatgtgcacgttcagatagtcaaagtcaattactcccttcattctaaaggcacgactgctttttctttttaggttgttttataatacaagatgtatagatacatgtaattaactaacgcatctctctcctaaattcgttatttagagtcttgatccttaagatctataatcagggccgttggtaagtgtgtccaccgaatatagcccctacaaattaagaccttatttttattctttttaatatattgtaatgtgttccaaagagatatcccgtattatagtagtcattaattcattcattcgtaccacccttgagaaaattatgataaactatttggttcatttctgcacccttgagaaacttatgataaaccatttggttcatttctgcaccagagaaaccatcctgatttggtttagactcgtgacgacgatgtttaaaatgccccctgtgaggttgaaagttgaaactctggtctctgcctctctggagaagagacaaccagcggtaagccggaggagcgcactgctgatgctgcgagattagacaacagattgatggatatgcatccatccattcatccatcggtggagtttgtgcgcgtgcgcttacacgaatagactggatattagtacgacacgacacatggaccgtgccattgttttgcactccatggataggtacgatacttctcgattactgccccgtcataaaatagttgtttgaatttttttagtcaaaattcttttaagtttgatctaatttatagagaaaattatacgacaccgtcaaactagttttattaaatttaatattaaatatattttgatataatgtttgttttgtatttaaagtattactatagctataaacttgctcaaacttataaaaaatttaacaaagaaaaaaaaatcaaacaacttaggacataaaacaaaaaacaaagaaagtagcaataaaagatcatatatgatatattttagtcatggaaatctgaacaggaatcgctcgcgcgcgtgtgcgtacaatgctatgatagtgataggcgtgcgtgctctccttcagctcctgctccccacatggccatggtggtggatgatgctccttcagctccagcaaccactactcaccaccagtggcctagatgcagctacaaactgcgcccgtgctgtgccatcgtttgaccgagaccgaccaaattttttgtcaactagtaaaaagcataaccacgagctccagttaattaactggtctactcctcctgcacttcctaccgatcgagtaattgtcgattactagtgctgtcatcccttaactgatgactaactaagcaagatgattaaacaacgtgtacgtggtgacttcgttaatatcaagatatgtcggtctaatcttctggagatgtttataggggtaggatttacgtgtttgtgttcacaaggacgatgagtgtgaccgtgttattagcgtctacatttacactgtgtttttttttttaaaaaagtcaatgtgtctgttgctcacgccattgcaccgttttgggctgctccatggcctcggttggattctacattgaaggaggaggaggaggccttcaagtgttgagcccaaaggcagcaagggccagaaattttgggcctatattgggcctaatttaccagataaggtcgtcactcccttagttgataaagtccgcttgagatacctcgctgtgggtcaactttcattagcatcaatcgtaaaatatggtacaaagccacccactactctcaaaaccagtgttaatcatgtccctcgataatttggacagtgattttgttctttatcctacgtgacatactccatccgtctttaaaatatttgacgccgttaacttttttaaacatgttataccattcgttttattcaaaaacttttgtgaaatatgtaaaactgtatgtacagaaaaaagtcaacgagtattaactaggggtgtgtttggttcacggtcatgtatggataggatatggccatccatattttgttggatatagcgatccaattttttgtttggtttgtatggatatgacaatccaattttttgtttggtttgtatggatatgacgatccaatttcttatttgattggagggatatagcatggatgggaaaagccaaaagttaatgggacccatttgtcatatatatattttttaacaaaatataatcatccgagatcttattttaaagatttaattataaaaaatataatggtgtaatcaaatcataaattagataaacggtttaggagaaaaaattatttggagcttgcttaacaggaaatcaaaccaaccacagccaatcggaatagaacacatcacccaatccaaaactggatggcttcatccagccaaatcagccggatgcactcatccagcatattgagagaatattccctattccaggctaccccatctacccggccctccaaccaaacactacaaaaactcgagcggccatctcccatccacatccaggctcatctatccaaccaaacacaccctaggtctttgtggctacctggtgcttacagagctactgtcaaggaaaaaaaagggtgggacctatgtagggccttgaccaattcaacccagggcagcaaggccaggagttttgggcctctaatgggccacttggttccatcctctgccgaggttcacctagtcagacatagcggcctaatatagaggagtaattttcaggttcctctgctggttagggtgtgttcggagagaagattgtagaaataagttcaccggaggtcccttgacttaagggcgagatttttctaaaaggccttgtttggttacacccggatttaatccgggctagtaatgataagtgtagtaagaaatttatgatagatacaatgatagaccgggatttattccgagctgggaaccaatttactcatgatagggacaataagagaccaggaatcaacccactagtcaagagttgtggaactaattcggatgttttgttgtatctatcatgagtaaattggttcccggtctggaataaatcctagtctcttattgtatctatcataaatttcttactatacttgtcattcccggcccggattgaatctgggcgtaaccgaacaaagccgaaatatgtacccctaaactcatacaaactgtgtacttaaggtcctaaggcagtatatatgggtggtttcgctcacgtggcatcctagtcagaaaaaaaaaagtacgtgggggcccacatgtcagctgcacatcttttttcttcttctccttcttttctctcttctctcttctcttttctctcttctctcttctcttcttcagtgagggaggccagcggccgacgggcggagcagtgatgggcgggcggcgggagagcgcggcggcgggcctgcgaggaagcggagcggcggcgggcaagcgcggtgggggagtggggagagacaaagcgagaccggaggagggagagagagagagaggaggccgactggcaccggcgttatcgcccggttgcgcgacgacgatcctggccaggtcgaggtgcgggtagcggtggagcacggcgcactgtgcacctcatgtcctccctgtcacgctcgtacgcatctcgcgccttctccgccagcgcgcccgccgccaccgccttcgtctcggcgagctcgagcttggccttcacgttccacagctcctctagcaacgcgtccgcctctgcgccggcgtcgcgctcccacgctctcatgtagtaggttgaggcgatgacgtcgcctgttttggcaatgacgagctcgctctcctgcgatggtgtcacgatgccctgcacagctgcgtcaccaccttccactcgccttccgccgtggcggcactatctggcagcaaaccaccagttcgccgcctgcggccgtgctcgccttttgccagccgccccgctatcgcgctcgcccgtcgctgctctgccgctgtcgcctacctgcttcgccttccgctcgcttccgacgaagggaagaagcacgacaaggacgggggttgctctgaccgccgcctcgtagtggtagacagtgtgggtggcggagacgcaggagccggcgggaggcacgacggcgaactcatccgccgcgctccgctcgccgcccgccgccgctccgctgccacacaggcccgccgccgtgctcgcccgccagccgtcggcctccctcgctgaagaagagaagagagaaaagagaagaggagaagaaaaaaaaattacagctgacatatgggtcccacgtacttttttaatttttttgttgattaggatgccacgtcagcgaaaccactcatatatattgccacatgaccttgagtgcacggtttgtataagtttaggggtatacatttctcgctatcaagttgagagtcctccgttgaacttattccaagatcatgtagtaagcaacacaactggttagggaataaacacacgtgaaaaaagagagagtagaagttaggtcatctaattgtcttaaacagtttagcaacgaggacgcacagtctagtagtttgaatagaaattaagactataaccttaaaaactagatttatttggcttttttacagaaaattttatataataatcttgtttttgaaaaaaaaaaatcatctacccatacacagcattacaataagcccatatgcagcagctccgtcgaaaggatgatgacttttcctttacacaagaagagatttttacagcttaacatggagaagaagaaaaaaatccagaaacaaactaaacattcacaattgatcttgctcaaaacaacccgacatgctcacaaatccacaagatcaattcattgttcccgtcctggcgattaaagcattcacagttaatttacagatcgaatccaactctttccttttcttttgatgaaaagcagaattcaattcaacttgtgaatttgtgatatacgcaaagctcaaatcaatttagcagaattcatcatctacaagtagcgagtcccgggttgggggtacaagctgtacggcgctcccgccgcttcttgatccggcaaccacgccgccggcggggggtagcacggcgcgccgggcggcggcggacgcggcgacatgtacgacggcagcgcacggtccaccgagcgatcgcagcatggcgccgatcttggcagtggtggtggatactgcgatgaggctgactccggcggcggcggtggcgggtaggtgctcgtcggagaggggaaactgggcgccgggtagcctgccggcggtggcgggtagaagttgctcggtggtggcggcgggtagccggcgatgtactgcgacggaggaggcggcggcgggtagctgctgtttggtgcgaagctttgcgtcacgtgaggcggcggcggcggcggcggtggaggaggagggtagctgctcggcggcggcggtgggtacagtgaagctgacggtgtcgcggacagcgatggcagcggcgggtagcttgccatcgccggaggcggatacggcgcacccgacgtcgtcgtcgtcgtcgacgtcggcggtggcgcgcagcaagaggaggagattggagttggatgatccacctgcggctgctggtacgcgccgccgccggtgacggcgaaggtgaagctgagcttgccgttcgccttgccgtcgggggcgcacacctggtagctcacgtgcctcggcgccgccgccgcgccgtcgccgcggcgacggcgaggtctgccagcggcacggacaccttgccgacgagcttgctcccgagcagcggcacctgcgccttcacctcgaactgcagcataccatccgcggcggcggggaggtcgaaggcgaagacggcggcgtcccagtccgggttctccccgccgtcggggtcgccgctcgtcttctcccggcggccggcgagcgacacggcggcgtagagcggcggcttctggaaggggacgaacgccttgacgcccctgcaggagatggacctgatggtgacccgccggccgccgccgccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaattatataaaaaagcactcaaaatgctgcagtctctctcaaagaaatcaagttcgttcagtactattttagaccccacaaagcaagaaaaattgtctgataatgcagttggttgtctaattttcttcttgctttagtcattgcaccacctgtctctttcttcttttccccaattccacactcatttgatatttggtagccgtactatgttgtgactgtgagaggccaccatacatacactatattaaagcaacatttgccaataagagtagaagctgttttaccaggaaattggataagctgaaacccatctaaccatttgtgatagcacaaagccataaactgatgtgtacaggcccatagatcacaaaacccaatgtagcacaaacccaatccaacacaagaaaaaaaaaacaacgaaaaatttcgtaccaatgcttaacgctttggagcacatggacaaaatattcataatcaagagatgaacacgtccaaccatgctgttgcatcctatgaattagtacaatggcaaactaagtgaaagacattacactacttgattatgagagcactgaagggatatcttcaaggacaaggttatttcatctatcttaccaaactttatatatatatatatatatatatatatatatatatatatatatatatatatatatatatatatatgaaaatggttctatacacctggaagtatacacctggaagtatgtacacctgctcttatccaccgtcgatctgtgattagcttcgatggatcctgatatcggattaacgagcggacccgtttaactttttaactagaaaaaaaattacgtaccccttaatcacagaaaccggaatgacatgagctcgcataattcctcggtcccaccagtgcatcggatacgaaaatcaggtcactgggagagaccgcgatataccagaactcggagaaggcggcggcgattcatcgtcgattccgcgacagcagcgagattcatcgtcgatccatggctgcgttgcaggtgacggcgtgatccatcggcgtggcgacctgcacgcgcggcgcggcggcggtgtcgaccgatcggcaacatcgtgcggcggaattgcaggtcatcgtcctccaaggcaacggcgcgacgggacgggactagtcgacggtgcgatgcagcaatagttgaactaacccaggcggcatcaatcactcgtcgatctcccgcaaagccttttcgaaagcgacaatgcatgtggttagtactacttaattatttcttatgtcgtgtatatcatatcaatcttatcttctttgcccaggcagtcgtatggtgcatatgcacacctcggagaggctagtgacgctagtcgtcgctagagtccgcaatatggtgtgcttgcacttgctccgatcgaacaatcgggatcccagacgatggctgtgccgatctcctgaaatccatgacgattggttcttgctttttagtacatatatatgtttttgatgcgaacggccgactgaggaaatgatgctgaaatcctgacagtaatgaaaccatcttcgttttctttcgtttttgaaacattcagttcatcctctttattggcagaatagatcgatcgaggatatttgcagtatatgcaatgcaatgaccatatcgtgcatgtatgtagctccataataattaattatgcacccacgcatttcaggtttagatatatactactggtctatttcagtatatagcttatgaaaaaaaaagaatcggtattcggaagatcagtgcctactaattatagttcaatgtgatatgtgtgtttttctgccatgacaagtacatactgctagtaaataaaaaaaagacactcactagaacggataccctcatctcaatcgggcacagcgtccgtcacaggctagaagtcactgatgtgaagagttatctcaatcgggcaaacagccgtcacgaatgaatatatctcaatcgggccctaagtaaagcccgtcaccgatagctttgacccagacgaccagtcaaactatagcccgttacagatgacctatctctatcaggccacaactagcgcccgtcacagatgactactaacctttatcgggcctaaactagagcccatcacagatgatactcatctcaatcgagcctaaactatagcccgtcatagatgactgatgacctcaatcgggcctaaattagagcccgtcacagatgactgctgacctcaatcgggcctaaactagagcccgtcacagatgactagtgacctcaatcgggcctaaactagagcccgtcacagatgatctcatctcaatcgggcatttagttatggcccgtcacagatgactataatccacaaaaaaaataaattttgttttttggctagcctcaggcctttgctagccatgcccgctgcaaagatgacagaaacaaacgcagatatccaatatccccaactccccagcatcacccattcatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattattcatcattttagtttaagcctaaacattcctttgggattaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatattgtggcacacatggaatccgcactggtcacctatttgttgcttcaccgagaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaatgatccaatgggcactgcggcattaatatagtgaaagttaattaagtactcaaggaatgtgtcatgctgttgtgtatatttagttaacacacttactattgattataggcacacataatgtacttcttgtctcggcgggaccacaaggtgtcgtagatgtagttgaccattccttgacggttattctggagatttgtgatagtgaccacttgtggatcaaggaaggcaacttccggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccactcagagcctgtagaggtcgaaaagatccttgaagtcgaccacgatataatttgttggaccaaggaaaggctttccatcgtgctgtccaaggatattggtagctttacttggcttcctggcgttagatttctccatgtagtataagtgaaggtccttgcaagcggtgcccattgcggcaagcacgtcatctccaaccaatggcatgcctagttggaactcctgtggagtgacgtatttcttcttgacctctttgcccttagtctcttcctggcccttgcccagatctagctttcttggagctagaagcgaggcctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccgaaatccgtgtcgtactgcaactgcacatcgtaagattgtgcatgacgatcttgagcaggaggggctgaaggagcagaggcgggtctctttggtggacgaccgcctggtgcagtggttggcctcgctgtaaccctgatctcaatgaggtccttaggccattggatgaaggtaccacgggcatttcctagtgagaggacctcgtcgttcggtggatacttcagagggaacagctcgtattcaggcttcaccgagtcgacttgaacttttgcacagtcggccctgagttgcgctccatgcactcttgtctctggggtcggcttgtacgcaagtccctcggctgctggaacagtgaagatcggcatcaccctaactgtgagggtgcagctcgttggttcctgcgatagattaatcaatttttttagaatattatatatcatatggattcgttacgtctttcatgtattgagtaagttcacggttaccgttatgtggtcgatggcgctgtcgaccgatgttggattttccgccaactcagttgatgcgcaactgctgcgtttttcggtgggacttcctaactctttgtgcgcagcagtagcggcagcctgggggatctgttgctcttctcggatctcttacctaatcttggccctcatcgactcgagcttttcgtcgaattcagatgtcagctcagctcgtatcgactcccggatcttggcttcaaggcgtgcatctttcttcgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgattagacacttactatagcttcgtatactcgttgatcttctacatttggcatgaagattgtgccatcatcatgtttctggtacctagccctggcccagttcctagcccgagggtgtgggatatcgccaaacacgagcggtgtaccacgattccttcgcttcttcatcctcacgctgccattcctcttccttaccggcatatccggcggtaccaagccggtgcggatgctggttcctagtctggagcaagcgatatgcctcgcttctagctctggactcgggggtcgacttcttcgcatggaattccgaccagacctgttccgtgatccaaggaaatttctctcttggatctggatttgccgggttgtagacgaactcgccgactagcttagtcttgaagttcttccaagcagtgcccataaccttgaaagcagcccgcctgagacggtcctcatgctccgcaggataatcaaagctctccttgaacgttagccaagcaatgtccttctctacggccggcacgagcttgaagtcgtcttgcagaataatgaatttctgcctccctatgaccccgcagatagacctaaatcggctcaatattttccttggagatgtcggcaaccctacggcgtctaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaaacacaattgagtgctacaatctattacaatgaattgaatgtcacttataaaaataaatgaaatatataaataaactaaattgcgcatatcacaacgatagaatgaattgaatggcacatataaataaattaaacatatcatcaaatcctaaaatcataaattcacctcataccatctattcatccacatatcatgcatctatcactaaattgattaatgcaccacattccatctattcatcatcatgtcatcaatcaaaaaatcatccgtttaccatatatcatcaatccctaaaatcatctatcactaaaatcatctatcactaaattcattaatgaaccacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctatcactaaattcatcccaacatccacatttcatcccaacatccacattttcattatcaaacacatgcaggtagcagagggaggcgcgatggaggactcacatgaggtcggccggggggggggggctcggtggtggcggcggcgggctcggtggagggcgtcgccggtcggtggaggtggcggcgggctcggtgcaggcggcgggctcggtgaaggaggagttcacggcggcggcgccggtcggtgtagacgccgatcggggaggtcggcgtcgggcgggcggcgtcgggcgtcggtgaggagtaggtgacgacgatgaggaaggacgtcgccggcctcggtgggggctgctgttcgtgtcggtgaagaggcaagcggcgacgacgaggaaggccgacgtcggtcggtgtagaggctcggtggcggtggcggcgggctcggtggaggcagcgggctcggtggcggtggtggcgggctcggtggaggcggcgggctcggtggcggtggcggcgggctcggcggcggtggcggcgggctcggtggcggtggcggcggtctcggtggtggtggcggcgagggaggacgacggcggtgaaggaggagttggcggcggcgctagggttctaaggaggcgggaaactgtagcgggacttagaaaaattttcgatccgatctgagaaaccctagttatattagagtgatgagtcatctcaatcgggctttgccgtagagcccgtcacagatgactcatcggtgacaggctccatactaatgcccgattgagatgacattcaggcccgtcacggatgactcatctgtgacaggccctaagataatgcccgatagagatagattaatctctatcgggcttgaactaaggcccgtcaccgatgactatttttccatttcccagataagtctttatatttgtgagtacaaaatatatagctgctgtataataattcattttattagtcataacacattttcggatagtaaatgatttcaaatcgaaatatggtcaacaacaaaattgatcctctcatcaagatctacaacttttattttggtcatttatctatataactttgtttctaacagcttaaaattggttttgacaatatgacaaatataaacagcatttgtaaatattacatgactttaaatgggaaagccatagacagctaacttgtacagctaatcaagatctacaacatttattttggtcacttcttcatccgacaaagtgatagtaccaatgtttacaaaattgacatatctgtgttgatatttataaaccagatgagagaaatatgatttttgtgaataatataactatcactttgtcagatgaagaagtaaccaaaataaaagttgtagatcttgatgagaggatcaactttgttgttgaccatatttccatttgaaatcatttagtatttacaaatgatgcttatatttgtcatattgtcaaaatcaatttcaagctgttggaaacaaagttatatagataaatgactaaaataaaagttgtagatcttgatgagaggatcaattttgttgttgaccatatttcgatttgaaatcatttactatctgaaaatgtgttatgactaataaaataaattattataca

SEQ ID NO: 81944 - DNA, 2175 bp, Oryza sativa
cccagtctctgtgatggcacaggtgactcaggcggaaaccttagccgccacagcctaccttccccaacctctcccctaccttgtgccacttgagcgagtggccgtaaagtcggtgcttaaagctggcggcctacgaggatgacgacggtggggctcgcggtggcgaccaccatagatccggcgtgggcgaatccaaggtggaggtcggccggaaagacgtcggcattgaggcgggatgccggcgcgcggatgacggcgacaaacgaaggtggaggcggggaagggagaagatagcggcgaggtgcgaactgcatgggggggtggcggtggcgacgacgatgccaaatccgcggcgggtgctgccagatctagaggcggagatggtggaggtaggggtggaagtgacggggtcgtagtagggtcggcggcgactacggtgggcgccgccggatcaggtcctcggccagggccgattgccgcccagtacgagcagttggcgtgaggtggcactggcgtagcacgggtaggctgaggaggcgcggcggctggcgatggaggacggagcaaggaggtttggccgtcggtgacggaggccgccacggtgcatggaggtgcagccgacaacggtgcgaggtcgtggctggcgtggaggcgcacctagcacgcgtggaggtgaggccggcctggaggccgccgtggaggaatgaccggcggcatggaggtgtggtgcagttgacggcaggtagcatcagcggcaacggtacactagagcgggtggcgtagctggtgaggctagccgacggtgggtgccggtacagcagtacccacgcactgacggaggtttgacagggaaggagcaatgtagcatcaatggtggataggcaggcggcagacgatgggtgaaaacctagcccggttttggccgagccgacaacgacggcgtttgcgtcacattccctcttgagggcattgtcatgtcgtcccatcgcctctaaggagtttgtcgggtgaaagcgcagtctccatgacggacggccgcggcggtgtttctgtcgctcctctccctggagacgttgtctaggcaacccctggccgaaacctcccaaacaactggtgcaagctcgctctagatcttggttctcttgtgttggcgccctagcttatacaaaatgaccatgtcggagggcctagggggagaaatggcggctggtctggtgttagccttctcctgggttcatgtgtcagagctgtcggtgtgtgggtggtagcaatttttttcttcgttttcctggttacgaccttacatggttataattttgtaatttttttctactctatcattatgaacttcgcactgtttggcgcgagtcgttcaaaatatatatataagggtgtatggttctgaagcaagacaaacactcgtttagatttacagcgtcagaaatacttatatttactgatggagatagtgactttcatattcttatttttaatggtctacaggccaaagttgagaattaagagtaggaaaaaaaccctccaatttctgtagtactttaaaataagatattggtggtgaaagtgaatgtgccattcatctacttccatagtaaattttacaaattattccttgaatttcttaatattaaaacacaaccataaacgaataaccacacaaaaaattaaattgaggtgaatattccctatggcaacatgaggacgggtaatatatttcatagaaatattttttatttattttggaccactataatatattttctatcggaagcaaattaagcacagtcattcagctagtaattttaaagttcaacagtggccgcggcttataagacaaagctcaaacaagtggggaacacactatacatggtccatatgactagcggcaaagaagaaaaataggtagattgaatcaattattaggtactttgtatataattgaatcttctttatattgctactgtctgcaaatgtgttgtgaaagcgttcagggaaggaacacgactcgtcatacatttttcacttatgggaagcatggctgttggcctgttgatgccacagttggatagacctcttgtgtcccattgttatcagatctcttggtacgatggtttttggttggtatatgtggccctaattaaattgccaaaaatcata

SEQ ID NO: 81945 - DNA, 2495 bp, Oryza sativa
aaccacaatttgttttagcacaaacaactagtgtgtcatgataaatgcatgatcttgtttatttgaaaaatgagatggccgattggccattaggtccaacaataagtctccattaatttgagaaataaaatgaggtaaaatcgtcatcacctcgaggtcatctatctcaatggtaaaaatgagaaactgaattatactataaaacatttcgtacaatagattacagactacacaaattcttttttccgtttcacttgttgtcagtgatcacctaatttttttcttacttgtcagtcacttaagcttgcacaaatatcactaacttgcataatttagaaaccttacaactttaagtttagaaaattgagggaattttacagcgctgtaaactcttcaaaaaatcacactgtaaaattcttaggcaatcagtgcaaatttaaaacttccaattcgagcatacgagggcattatgtatgaatataggtgctaatctattaccaaccagcatttaagaactcggcacattgcggtggcgacggcggcagcggcagtggcggcgacgacgctgggtggactggctccaaaggagatgacgttgagatgaggatcgacagtgatcgccgccggcgtctcaccttggctccagtttcttcctccgtggtacgtggctctcgttttgagtgtcttttgcaggaaaatcgggatggggacgacgacgatggtgttaatacctcgcatgagattgccgatgaggctgtcatcgaaactaggcagagtgggagagacaatggtggtcacaggcaagcaacaagtgatggtggaggccatggacgaccggctcgatctgatgaagcttcgctagtacaggagttctggagcgaggttggttttccgacgccggcgaaccgctggtgggaaaaacaacccgagcctccctctcgctttcgctctctttcaccgaagcttgctgagaaagacaacgctggcggatggaatttggtgtcttacagtcgatcaggaaaagaattcggtcctgctatacagcgtcgacgtggatggctgattcggccatggaaaggtcctcttccccgtccacgtccggcgacggtagtggtactgggggatttcctgccggcggcgacatcaaaccaagcgacaatggtttcctcagattgcgcattacaaggatcgtcctcagatcacgcgctttcactaggattgtttcaaaattcgaaacaatcttttgtgggccgtgtgatgggcccggtcggcatgcgtccttacggcagatcgagatatgacttgcttcgaccatcgttgacgcaatctgccatctctttcattccatcaacatagccatctcgccctagttacgctgcgatggcggcgactgaccctcctcgccacaaccagcagcggccgctagcaaatcatcctccccagcaacaaatcaatagaaccaacttgcaagaacaccacggcggccgggttgcgcagcaaggccgttctacgcagcaaggcggttggggtgcacatggtggccgagttgatcatcgtgatcaaagtagccggggtgcacatggaggctgggatgcaccaccaaatcaaggaggacatggtgctttaccttcctacagaaacaacaaaggtggacgtccgggatttggtcagcgcccatagggaagaaacttccggccagggttccagggccatggccgtgatgagcaacctcgaagggatgcaggcaatcaaggtgtccctgttcatcaagccctaatagaaagtactgtaaaacaagacattcaagccggccgaggagaaacagctgccctttcatccaagaatagtgtggaggtaacaacggcaaaagccaagaaacctcgtccacttcactgtttcaggtgcaagggtagtggccattgttggatggctgcaaaactgtccttgactgttttatatgtaacaagaaagatgcacatgtgccgaatagatgtcctattctaaaggaaccaaaacctactgctgctttatttggattcagtgaacagaacatgggtttcttgccgatacaggagtttgatatgaagttgaagccgccgaaacctgcgccaatggctttggtgaccattctcggtggtcatttagcagctagtgccgtgcagaatgagttggcacgcctcatccgagccgattggaattgggaggctgtgccacatggtgacaattcataccttgtgactttcccgtctgaggaggaactcaaccggatggatgatgttgaattcaggttaaagaatcacggtgtatctatcacaatccaacagtggcagcaagattccgatattataccggtgtatcagctcgacgaggtgtgggtgcacatcactggagtgctgcactcttggcgacactatctttgtttctgggctttgggcactgtagttggaaccacacaagaggtagatatgctgacctttcgtaagaagggcattatt

SEQ ID NO: 81946 - DNA, 1202 bp, Oryza sativa
ctagtctctaagaagactcataggggtatgtgtatgtatgagttcatagaggtgagtgtgcgtgttgtgagcgcccgcatttgtactttgttttaaaaaaatatcaaacattatttattgtttctcttttaatttaatagataaaataatagggaggggacgacattgttgcgtagatatgagagtgaggaggaggtggagattttgtttttccaatttttctaatttttctaaatgacttaagtgaaagcctacgacgggatgtttcattttttttaagaatttccaatgtttatccctttttttataggacgtgccccatggtaacttaagattttttttcaaaaaaaatagatctaatagttaaaaataatggagacgtcaatttaattgaattaatttaatctagcacctcgtacgtccagccacgtgtcgctcggtgattcgcagtcagtgttcgttatgttctttttgtttcttttcgtgggaaaaaggctgttggttactccctgtgtcaaaaaaattagagataaatatggaaaaattcacatttatccatatcttaactacttaaaaattagtaactttccaattgtcacaataattttttgtccgtcaatccgaccaagcggcaccctccatccacatacgtgcaattacatcccatacgatgcccaaagaaaaaaaaacagagtttgaatcaaaataagctaaaatttctcacctattttgactcggaaattataaaatatttcctccagtgtcctatagccaattacataatttttgtagtgtccatcagccatgtcacgtttttacggtgtctcccagccaattacacgttttttgggtgttctgtatcaaattttgcctttttcttaaaattttaggacatattatatggtgatttattagcgctctagtgggctttaattgatttttgttacctatagtgatttagtataacataatacatatgttcgattaattattggctgttatttagttgccattcaaatgatagggtctaccatcaaatgatgtattttaactttttatagtaaatatagctaatgttatcttgatttatttatttaattataaataaaacaatagttatattatgttagttaaaaaaaagaagaggagataattgaattggagaggagatgatgggtcagtccgaggtatacaaaaggtat

SEQ ID NO: 81947 - DNA, 19165 bp, Oryza sativa
  unsure (1)..(19165): unsure at all n locations
cccactgtctttctttgatataatggttcatctccctgttcatctggtgaagcaaacaaaactatgtggcccggcttttctaagggaaatgtggccgtttgaaaggtacatgggagttctaaagtcgtacgttcgtaacagagctaaacccgaggggagcatcattgaaggttacacgaccaaggaggctattgagttctgtgtcaattacatgttcgatgccgatcctatcggagttccagcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatgattcaagaatcgtgtgacaatgtccacggatgtcccaaatgagatagtacagttgttggggatgggaccgtcttggaccatagacacatggcaaggatacgatataaatggatacacattttataccgtcaaacaagatgacaaaagcacagtgcaaaacagcggcgtccgtatagatgcattccaggatcaagttgggtcaaacacatactacggccgcattgaggagatctgggagctaaactacgtcaagttcacggttcctttgttccgctgccgttaggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgccgtcgatgaagaagaatacaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttaaccatatttcaatttgaaatcatttagtatttacaaatgctattaattagatttgtcatattgtcgaaatcaatttcaagctgttgggaaaaaaattatatagaataatgaccaaaataaaattattagatcttgaaaggctctacaactttgttgttgaccatatttccatttgaaatcttttactatccgaaaatgtattatgactaataaaatgaattattacacagttgctatatattttacactcacaacaaatgaaagatggaaaatgagtcatcggtgacgggctctacggtaaagcccgattgagatgactcatcactctaatataactagggtttctcagatcggatcgaaaatttttctaagtcccgctacagtttcccgcctccttagaaccctagcgccgccgccaactcctccttcaccgccgtcgtcctccctcgccgccaccaccaccgagaccgccgccaccgccaccgagcccgccgccaccgccgccgagcccgccgccaccgccaccgagcccgccgcctccaccgagcccgccaccaccgccaccgagcccgctgcctccaccgagcccgccgccaccgccaccgagcctctacaccgaccgacgtcggccttcctcgtcgtcgccgcttgcctcttcaccgacacgaacagcagcccccaccgaggccggcgacgtccttcctcatcgtcgtcacctactcctcaccgacgcccgacgccgcccgcccgacgccgacctccccgatcggcgtctacaccgaccggcgccgccgccgtgaactcctccttcaccgagcccgccgcctgcaccgagcccgccgccacctccaccgaccggcgacgccctccaccgagcccgccgccgccaccaccgagccccccccccccggccgacctcatgtgagtcctccatcgcgcctccctctgctacctgcatgtgtttgataatgaaaatgtggatgttgggatgaaatgtggatgttgggatgaatttagtgatagatgattttagtgattgatgacttgatgatgaatagatggaatgtggtgcattaatgaatttagtgatagatgattttagtgatagatgattttagggattgatgatatgtggtgaacgaatgattttagtgattgatgacatgatgatgaatagatggaatgtggttcattaatgaatttagtgatagatgcatgatatgtggatgaatagatggtatgaggtgaatttatgattttaggatttgatgatatgtttaatttatttatatgtgccattcaattcattctatcgttgtgatatgcgcaatttagtttatttatatatttcatttatttttataagtgacattcaattcattgtaatagattgtagcactcaattgtgtttttttttgtttttttggaaaaaagtagacaatgtctcagcaaggcgaaccaatgtcgacgacaactagtgggtcctcaagggcacgtactcctaggacagggaacaaaattcctaaggaacggttccgcataacagcggtagacgccgtagggttgccgacatctccaaggaaaatattgagccgatttaggtctatctgcggggtcatagggaggcagaaattcattattctgcaagacgacttcaagctcgtgccggccgtagagaaggacattgcttggctaacgttcaaggagagctttgattatcctgcggagcatgaggaccgtctcaggcgggctgctttcaaggttatgggcactgcttggaagaacttcaagactaagctagtcggcgagttcgtctacaacccggcaaatccagatccaagagagaaatttccttggatcacggaacaggtctggtcggaattccatgcgaagaagtcgacccccgagtccagagctagaagcgaggcatatcgcttgctccagactaggaaccagcatccgcaccggcttggtaccgccggatatgccggtaaggaagaggaatggcagcgtgaggatgaagaagcgaaggaatcgtggtacaccgctcgtgtttggcgatatcccacaccctcgggctaggaactgggccagggctaggtaccagaaacatgatgatggcacaatcttcatgccaaatgtagaagatcaacgagtatacgaagctatagtaagtgtctaatcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcgaagaaagatgcacgccttgaagccaagatccgggagtcgatacgagctgagctgacatctgaattcgacgaaaagctcgagtcgatgagggccaagattaggtaagagatccgagaagagcaacagatcccccaggctgccgctactgctgcgcacaaagagttaggaagtcccaccgaaaaacgcagcagttgcgcatcaactgagttggcggaaaatccaacatcggtcgacagcgccatcgaccacataacggtaaccgtgaacttactcaatacatgaaagacgtaacgaatccatatgatatataatattctaaaaaaattgattaatctatcgcaggaaccaacgagctgcaccctcacagttagggtgatgccgatcttcactgttccagcagccgagggacttgcgtacaagccgaccccagagacaagagtgcatggagcgcaactcagggccgactgtgcaaaagttcaagtcgactcggtgaagcctgaatacgagctgttccctctgaagtatccaccgaacgacgaggtcctctcactaggaaatgcccgtggtaccttcatccaatggcctaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggatttcggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatacgtcactccacaggagttccaactaggcatgccattggttggagatgacgtgcttgccgcaatgggcaccgcttgcaaggaccttcacttatactacatggagaaatctaacgccaggaagccaagtaaagctaccaatatccttggacagcacgatggaaagcctttccttggtccaacaaattatatcgtggtcgacttcaaggatcttttcgacctctacaggctctgagtggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccggaagttgccttccttgatccacaagtggtcactatcacaaatctccagaataaccgtcaaggaatggtcaactacatctacgacaccttgtggtcccgccgagacaagaagtacattatgtgtgcctataatcaatagtaagtgtgttaactaaatatacacaacagcatgacacattccttgagtacttaattaactttcactatattaatgccgcagtgcccattggatcattctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttctcggtgaagcaacaaataggtgaccagtgcggattccatgtgtgccacaatatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaatcccaaaggaatgtttaggcttaaactaaaatgatgaataatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagttggggatattggatatctgcgtttgtttctgtcatctttgcagcgggcatggctagcaaaggcctgaggctagccaaaaaacaaaatttattttttttgtggattatagtcatctgtgacgggccataactaaatgcccgattgagatgagatcatctgtgacgggctctagtttaggcccgattgaggtcactagtcatctgtgacgggctctagtttaggcccgattgaggtcagcagtcatctgtgacgggctctaatttaggcccgattgaggtcatcagtcatctatgacgggctatagtttaggctcgattgagatgagtatcatctgtgatgggctctagtttaggcccgataaaggttagtagtcatctgtgacgggcgctagttgtggcctgatagagataggtcatctgtaacgggctatagtttgactggtcgtctgggtcaaagctatcggtgacgggctttacttagggcccgattgagatatattcattcgtgacggctgtttgcccgattgagataactcttcacatcagtgacttctagcctgtgacggacgctgtgcccgattgagatgagggtatccgttctagtgagtgtcttttttttatttactagcagtatgtacttgtcatggcagaaaaacacacatatcacattgaactataattagtaggcactgatcttccgaataccgattctttttttttcataagctatatactgaaatagaccagtagtatatatctaaacctgaaatgcgtgggtgcataattaattattatggagctacatacatgcacgatatggtcattgcattgcatatactgcaaatatcctcgatcgatctattctgccaataaagaggatgaactgaatgtttcaaaaacgaaagaaaacgaagatggtttcattactgtcaggatttcagcatcatttcctcagtcggccgttcgcatcaaaaacatatatatgtactaaaaagcaagaaccaatcgtcatggatttcaggagatcggcacagccatcgtctgggatcccgattgttcgatcggagcaagtgcaagcacaccatattgcggactctagcgacgactagcgtcactagcctctccgaggtgtgcatatgcaccatacgactgcctgggcaaagaagataagattgatatgatatacacgacataagaaataattaagtagtactaaccacatgcattgtcgctttcgaaaaggctttgcgggagatcgacgagtgattgatgccgcctgggttagttcaactattgctgcatcgcaccgtcgactagtcccgtcccgtcgcgccgttgccttggaggacgatgacctgcaattccgccgcacgatgttgccgatcggtcgacaccgccgccgcgccgcgcgtgcaggtcgccacgccgatggatcacgccgtcacctgcaacgcagccatggatcgacgatgaatctcgctgctgtcgcggaatcgacgatgaatcgccgccgccttctccgagttctggtatatcgcggtctctcccagtgacctgattttcgtatccgatgcactggtgggaccgaggaattatgcgagctcatgtcattccggtttctgtgattaaggggtacgtaattttttttctagttaaaaagttaaacgggtccgctcgttaatccgatatcaggatccatcgaagctaatcacagatcgacggtggataagagcaggtgtacatacttccaggtgtatacttccaggtgtatagaaccattttcatatatatatatatatatatatatatatatatatatatatatatatatatatatatatatatataaagtttggtaagatagatgaaataaccttgtccttgaagatatcccttcagtgctctcataatcaagtagtgtaatgtctttcacttagtttgccattgtactaattcataggatgcaacagcatggttggacgtgttcatctcttgattatgaatattttgtccatgtgctccaaagcgttaagcattggtacgaaatttttcgttgttttttttttcttgtgttggattgggtttgtgctacattgggttttgtgatctatgggcctgtacacatcagtttatggctttgtgctatcacaaatggttagatgggtttcagcttatccaatttcctggtaaaacagcttctactcttattggcaaatgttgctttaatatagtgtatgtatggtggcctctcacagtcacaacatagtacggctaccaaatatcaaatgagtgtggaattggggaaaagaagaaagagacaggtggtgcaatgactaaagcaagaagaaaattagacaaccaactgcattatcagacaatttttcttgctttgtggggtctaaaatagtactgaacgaacttgatttctttgagagagactgcagcattttgagtgcttttttatataattacaaatgcaaatatatatcacacacacaaacacacttgcctcctgtttattgcatccagaaatgaaagtaaaaaaaaatattaggaacagttaaaaatcaggcagccaaagaacacagtaacagcatatactatctgctccccaattgattgattgcacctagatccaatatcatccaaataaacaaaagagcacaaggtcaaatctttagccaccaagatcccatcagccacaaatcgatccatctccaagctcaaaatcccaattctttccaagaaagatttttctcggaggccatgtcgaccgccggcggcggcggcggcggccggcgggtcaccatcaggtccatctcctgcaggggcgtcaaggcgttcgtccccttccagaagccgccgctctacgccgccgtgtcgctcgccggccgccggggaagacgagcggcgaccccgacggcggggagaacccggactgggacgccgccgtcttcgccttcgacctccccgccgccgcggatggtatgctgcagttcgaggtgaaggcgcagggcgctgctcgggagcaagctcgtcggcaaggatgtccgntgccgctggcagacctcgccgtcgccggcggcgacggcgcggcggcggcgccgaggcacgtgagctaccaggtgtgcgcccccgacggcaaggcgaacggcaagctcagcttcaccttcgccgtcaccggcggcggcgcgtaccagcagccgcaggtggatcatccaactccaatctcctcctcttgctgcgcgccaccgccgacgtcgacgacgacgacgacgtcgggtgcgccgtatccgcctccggcgatggcaagctacccgccgctgccatcgctgtccgcgacaccgtcagcttcactgtacccaccgccgccgccgagcagctaccctcctcctccaccgccgccgccgccgccgcctcacgtgacgcaaagcttcgcaccaaacagcagctacccgccgccgcctcctccgtcgcagtacatcgccggctacccgccgccaccaccgagcaacttctacccgccaccgccggcaggctacccggcgcccagtttcccctctccgacgagcacctacccgccaccgccgccgccggagtcagcctcatcgcagtatccaccaccactgccaagatcggcgccatgctgcgatcgctcggtggaccgtgcgctgccgtcgtacatgtcgccgcgtccgccgccgcccggcgcgccgtgctaccccccgccggcggcgtggttgccggatcaagaagcggcgggagcgccgtacagcttgtacccccaacccgggactcgctacttgtagatgatgaattctgctaaattgatttgagctttgcgtatatcacaaattcacaagttgaattgaattctgcttttcatcaaaagaaaaggaaagagttggattcgatctgtaaattaactgtgaatgctttaatcgccaggacgggaacaatgaattgatcttgtggatttgtgagcatgtcgggttgttttgagcaagatcaattgtgaatgtttagtttgtttctggatttttttcttcttctccatgttaagctgtaaaaatctcttcttgtgtaaaggaaaagtcatcatcctttcgacggagctgctgcatatgggcttattgtaatgctgtgtatgggtagatgatttttttttttcaaaaacaagattattatataaaattttctgtaaaaaagccaaataaatctagtttttaaggttatagtcttaatttctattcaaactactagactgtgcgtcctcgttgctaaactgtttaagacaattagatgacctaacttctactctctcttttttcacgtgtgtttattccctaaccagttgtgttgcttactacatgatcttggaataagttcaacggaggactctcaacttgatagcgagaaatgtatacccctaaacttatacaaaccgtgcactcaaggtcatgtggcaatatatatgagtggtttcgctgacgtggcatcctaatcaacaaaaaaattaaaaaagtacgtgggacccatatgtcagctgtaatttttttttcttctcctcttctcttttctctcttctcttcttcagcgagggaggccgacggctggcgggcgagcacggcggcgggcctgtgtggcagcggagcggcggcgggcggcgagcggagcgcggcggatgagttcgccgtcgtgcctcccgccggctcctgcgtctccgccacccacactgtctaccactacgaggcggcggtcagagcaacccccgtccttgtcgtgcttcttcccttcgtcggaagcgagcggaaggcgaagcaggtaggcgacagcggcagagcagcgacgggcgagcgcgatagcggggcggctggcaaaaggcgagcacggccgcaggcggcgaactggtggtttgctgccagatagtgccgccacggcggaaggcgagtggaaggtggtgacgcagctgtgcagggcatcgtgacaccatcgcaggagagcgagctcgtcattgccaaaacaggcgacgtcatcgcctcaacctactacatgagagcgtgggagcgcgacgccggcgcagaggcggacgcgttgctagaggagctgtggaacgtgaaggccaagctcgagctcgccgagacgaaggcggtggcggcgggcgcgctggcggagaaggcgcgagatgcgtacgagcgtgacagggaggacatgaggtgcacagtgcgccgtgctccaccgctacccgcacctcgacctggccaggatcgtcgtcgcgcaaccgggcgataacgccggtgccagtcggcctcctctctctctctctccctcctccggtctcgctttgtctctccccactcccccaccgcgcttgcccgccgccgctccgcttcctcgcaggcccgccgccgcgctctcccgccgcccgcccatcactgctccgcccgtcggccgctggcctccctcactgaagaagagaagagagaagagagaaaagagaagagagaagagagaaaagaaggagaagaagaaaaaagatgtgcagctgacatgtgggcccccacgtacttttttttttctgactaggatgccacgtgagcgaaaccacccatatatactgccttaggaccttaagtacacagtttgtatgagtttaggggtacatatttcggctttgttcggttacgcccagattcaatccgggccgggaatgacaagtatagtaagaaatttatgatagatacaataagagactaggatttattccagaccgggaaccaatttactcatgatagatacaacaaaacatccgaattagttccacaactcttgactagtgggttgattcctggtctcttattgtccctatcatgagtaaattggttcccagctcggaataaatcccggtctatcattgtatctatcataaatttcttactacacttatcattactagcccggattaaatccgggtgtaaccaaacaaggccttttagaaaaatctcgcccttaagtcaagggacctccggtgaacttatttctacaatcttctctccgaacacaccctaaccagcagaggaacctgaaaattactcctctatattaggccgctatgtctgactaggtgaacctcggcagaggatggaaccaagtggcccattagaggcccaaaactcctggccttgctgccctgggttgaattggtcaaggccctacataggtcccacccttttttttccttgacagtagctctgtaagcaccaggtagccacaaagacctagggtgtgtttggttggatagatgagcctggatgtggatgggagatggccgctcgagtttttgtagtgtttggttggagggccgggtagatggggtagcctggaatagggaatattctctcaatatgctggatgagtgcatccggctgatttggctggatgaagccatccagttttggattgggtgatgtgttctattccgattggctgtggttggtttgatttcctgttaagcaagctccaaataattttttctcctaaaccgtttatctaatttatgatttgattacaccattatattttttataattaaatctttaaaataagatctcggatgattatattttgttaaaaaatatatatatgacaaatgggtcccattaacttttggcttttcccatccatgctatatccctccaatcaaataagaaattggatcgtcatatccatacaaaccaaacaaaaaattggattgtcatatccatacaaaccaaacaaaaaattggatcgctatatccaacaaaatatggatggccatatcctatccatacatgaccgtgaaccaaacacacccctagttaatactcgttgacttttttctgtacatacagttttacatatttcacaaaagtttttgaataaaacgaatggtataacatgtttaaaaaagttaacggcgtcaaatattttaaagacggatggagtatgtcacgtaggataaagaacaaaatcactgtccaaattatcgagggacatgattaacactggttttgagagtagtgggtggctttgtaccatattttacgattgatgctaatgaaagttgacccacagcgaggtatctcaagcggactttatcaactaagggagtgacgaccttatctggtaaattaggcccaatataggcccaaaatttctggcccttgctgcctttgggctcaacacttgaaggcctcctcctcctccttcaatgtagaatccaaccgaggccatggagcagcccaaaacggtgcaatggcgtgagcaacagacacattgacttttttaaaaaaaaaaacacagtgtaaatgtagacgctaataacacggtcacactcatcgtccttgtgaacacaaacacgtaaatcctacccctataaacatctccagaagattagaccgacatatcttgatattaacgaagtcaccacgtacacgttgtttaatcatcttgcttagttagtcatcagttaagggatgacagcactagtaatcgacaattactcgatcggtaggaagtgcaggaggagtagaccagttaattaactggagctcgtggttatgctttttactagttgacaaaaaatttggtcggtctcggtcaaacgatggcacagcacgggcgcagtttgtagctgcatctaggccactggtggtgagtagtggttgctggagctgaaggagcatcatccaccaccatggccatgtggggagcaggagctgaaggagagcacgcacgcctatcactatcatagcattgtacgcacacgcgcgcgagcgattcctgttcagatttccatgactaaaatatatcatatatgatcttttattgctactttctttgttttttgttttatgtcctaagttgtttgatttttttttctttgttaaattttttataagtttgagcaagtttatagctatagtaatactttaaatacaaaacaaacattatatcaaaatatatttaatattaaatttaataaaactagtttgacggtgtcgtataattttctctataaattagatcaaacttaaaagaattttgactaaaaaaattcaaacaactattttatgacggggcagtaatcgagaagtatcgtacctatccatggagtgcaaaacaatggcacggtccatgtgtcgtgtcgtactaatatccagtctattcgtgtaagcgcacgcgcacaaactccaccgatggatgaatggatggatgcatatccatcaatctgttgtctaatctcgcagcatcagcagtgcgctcctccggcttaccgctggttgtctcttctccagagaggcagagaccagagtttcaactttcaacctcacagggggcattttaaacatcgtcgtcacgagtctaaaccaaatcaggatggtttctctggtgcagaaatgaaccaaatggtttatcataagtttctcaagggtgcagaaatgaaccaaatagtttatcataattttctcaagggtggtacgaatgaatgaattaatgactactataatacgggatatctctttggaacacattacaatatattaaaaagaataaaaataaggtcttaatttgtaggggctatattcggtggacacacttaccaacggccctgattatagatcttaaggatcaagactctaaataacgaatttaggagagagatgcgttagttaattacatgtatctatacatcttgtattataaaacaacctaaaaagaaaaagcagtcgtgcctttagaatgaagggagtaattgactttgactatctgaacgtgcacatgttaaatcctgcattcctcttccgttaattagcccgaaaccaagaagggaaaggtagagagataaacgtatacgtgttgctcgctgattggtcgcctatcctctctgggacaaaccccgttctgaccgctaccttgtccccagttaaaccctttcccaccattgaccatgaatgcggtacacgtggcaagcaatccacaccttgcattgtccccttcatccttggttaattaccctggcactggattaattaccttaacctgagagtaacatcacagtacgtgtgtagtaaaatactcctgtgaaggatggatataccagcaaaatcttgtcagctggcattttatcttatcctgttctgatatgatgactagcatacactgtaggagcatatttttcttactattccgctggcattaattactgtaagtacaagttatatactccaactatttttatataaggaatattataaagttacaaattcaaaactaattactcaaactatgaatatatatatttggtatgtaaaaattgttccaatagaattatatttttaatgatatttcgattttataatacaccttatagaaagaaaaggagggagtatacgtaaccaatgcaacgaaaaataatttcaggataaggtctttacatttctacctttaattagtggtccaaactccaaagcaaacctgagtgattataaattaaggaaagaaaaccaagttagtaattttgaagttatatattaaatttcaaaattggtgtagttttatactccacaactcaacaagcaatactcctaaataaaaaatccaagcaaagtagatctacctagctagcttaatcatataagcttcacctggttttttgtttgcacatcatgtaagaaatcatgcatatgagtgtctctttagtctatatatacatagagatctcatataattacatactggctaccaagataatatcacagatctgtatataatactccagcatggcctttctactgattgactatgcggatagtacagctaattagacgatgtgctagctgttgtatattgcacaagttgatactctcctctgacgttagtaggagtacactataacctacacttaattaattaattaattaaaattaaaaaaatgtgggtgatggagcagataatggtggctggaagcccggatccaaggccccatctttgaccatcaggtcaaaactgtgtgtgtgctgacatctaagcgagtagcactgcttgcattgctacctttctaagcaaaaacaggccattatatagtctagagcccacatgcttaattgttttattttaattcccatcttaattttgagtagtgatactgccacgtgtacagttaggtactgtgttcaaacgaaatttgtgatgcttgtgttaattgattaacactctcacaccgacatatataggaagtgctatgagaagatgcccgatagtacagtgataaagggggtgtggttttaatcctaaagtttcgtattcaattttcaacatgctcatatttttttatgaaaaatgtcaattttttttcaatctgatccttatataggacatgtttaggagtttttaatagctacatccattgaatcccaattctctcatattgcctaaattttactttaggtcgtaaaatctaatggttgaaaaatctagaaatgaacgattatatagaagaaaaaaaaccataagttcttcaaaacccttttttttttcttatcagttggctacttaccatctacttcgtgtgatctacaattcctttaaacaagaccttaattacattttacaccctgagcccacctgccatcgatggctagctcataacttagctaatgtcccaccgctagcaatagtagctacttgctcaatttcctactgataataatgaaggagttcaaggcaagcaaaggagaagtcttaccctgcatctagagtaccaactttgaccagcttattagcacactcaattagtgcacatgattcccggttttttcccgtcaaacaaacaccaccacactcaagtcgccacgtgtaaatattagtcaatactcgttattgaaaccggacatattatattaaatgacacgggagattacaactctgccatcataataaacagataaaaagaatatcaaaatagagcaaagagcctcggcgtcttgaaaattcacatgaaattaatacgatcgcatgagactacccacaatgttaaccagctccgacgaaaataaaaactaatactataccaatattaatatatagcacctcctctaatttcacaaagtttcatatcaaaactcaccggcggtgggccctagatccaattgtcattgcataacaaaatatagcaataggccctctctagctcacacttactccattagtctcaacattgacaggctgtggactgggacccacctgccggcattctcatctctctcacacacacacaccaaattctaatcaaaataaaagcaaaggggatcatgatagtgtcacggctttgaccggctactgccattagataagccctaatcaaagtggattagtgcttaattagagtgtgtgattagcgcgccggatttggatctgaatcggagccgggagctaggatcagtgagctggaagtataatgcccccaatttctcaatctttttttaacctcggagaacgtgctctcctctttcttttaattttctttttctcttttcaattcaatcttgccttttaattttgaccccggtcaaactgctcccatctcgacatctctcatggaaacaaacgcacgcgtcacatgccacacatgcgtttcagtgtacagtaactgaccgaaataattactgacttaacaacaactgtcaaaagttactactaattaccttagctaacaaagatacttagcactaatcaggaacaagatgacgtaatgcgtagaggcatattcgaatctttcactgttttgatccgcttggaacaccggttaataacggcataacgcgtaatatacgccatagtgatttggacttttttttttctacgtacttttttcttttctttttggcctaacgaccgtcatgatgagcatttttgactggatttgtattcgaattcgatttattccgtctgactttgcttgggtaaaacggcacctgaaaattcgtgcgtgcgtgcgtgccttgaattatgcacagcatttgcagtttgaccaaggcttgtgctacgtgcggtttagctgcagagatctcggtgtgagtgagtgtgtgcactgaacgatccaaatatttttgaatggtttatgccaagtggaatttgaatttgctatgaaaattatggtattcatgcctacaaaattgtttgtaatcagttttggaaatttggataccactgtattgctggactcgatgggcgcgcacacaggatgtgaaatgtggggaggaagcagtttaaagtttaaacaaaccagaaactgaaaaaaggggaaagcaaaagtgagttgaaattttgcctgccaccacgcagccttgcttttttttttcttcttttcttttttctgatcagaatgcaacgaaaaaccatgtacaaattagcaccaaaacttttctgtaattacaaatgcggacacagctgcagtcgaagctgcagctgaatcatcatcgcctaaactgaactcggatcgagcttaatcttaatcacccccgttaattaccctcccggagactaattaattgattttagcctagccggagcacgccaccgcgccgccattgccgcagacgagggtggtggtggtggtggcggcggcggcctctcgccggcggcggctgccgagcctgccgaggaaggggaggcctcgacctttggaggatcttctggtggtggtggcggtggcggcggcggtggcggtgtcaccggcggcggcggcgacgacttcttggatggtgtccagcttgggcgaccaccgccgcgccttgctgtagccgacgagctcctcgtactccttctccagcttcttgtccccgcgcagcacgggggggttggtggcggcggcggcgaggtcggcgaccttgtcgtcggcggcgaggaggaagtcgtcggagaacttgatctggagcgtgccggacgcggtgcggaggagctcgaacggccgctgctgctgcttcttggcggcggaggcggaggaggcggagaggaggaggaggagggaggaggcgagggagacgaaggagaggacggagtggaacaggtgggcggggaggaggaagtaggcgtggcccggctcgagcacctcgccgggcg

SEQ ID NO: 81948 - DNA, 1460 bp, Oryza sativa
catttaacccaatcactgctcaacgctacaccacgttgagactggcccaaaccaccacctgaactaatcagttccattatgctaagctaggggtgagactaatcacagtgaatctggttgatcgcccataaccacgagcacggctattcgaatagttttactctgatcagaggtatacaactatacccacaagacacagccccacgacacattcccgtgagccgacatgccatcacgacataccaaaaagaggccgtgacaggacccttcgcataacccctctaaccaagcacaccacacctcaagtttcacccccactcctcaaaaggcaatgggcacctctcatgcctaggtgaatccagaagcgacaaaggccatcgcagggcctattccgctccatcacgcccacccttacctggatgtgtcggctagaggaaagctacactacaactccagccgttgcccaccctgcttgtggtaagtacgataagttcttccagggcatcctgcgaaccggtccttaatcgccatgggcacgaccagcaaaaccatgcacccacagcccaccatttagtgtattttaattaaccaacaccattgcggtggtactaaaccaaagtcatgctagattccaaagtctatgtatagtgtgtttccccctttgtgtactagttgaactaagcatagctatgcaattcctaatccaacatatagccatgttacaacctaagctagcaaaggaataagatgaacaaatagtatggctgataatagtaggtaaacatctcatctagtaacattataaaacaatgcataattttaaagaaaacatagagcatttgcaatataggatcaatatgttcaagtaacaagcatgacttgccttgctctgcggctagagggacctcggcgactatttcaaagtacaccgaagcgtcgggagagccagaatctacgcgacatacaaggcaaacaatgcaaacatgctataagactactaaaacagagaacaaaacattttttaatggattctttgcatttttcttgatttactgagacttgaatgggcttaaacggagcacagtggaccgagtccacgggactggggagaggagcaccatgtgacgctgacgtggcgccgaggtggcgcacacgctggcggccaagtgggcggaggcggctcgcagccggcgcgcacgggcggcttaagccggcccggcgccatggcgacgcggcggcggcggcgcgggcggcgacctgcggcgaacggctggcggcgaagagcggcggcgatgcggcggtgctacaagggggagagggagagagggagaggagatgctggtcctcaccgagggattcggtcggcatggaggaaggcgacggcgaacggcgaacggcgacgatgggcggcaagatgtcgacggtcacgggcgaccgagcttcgtggtaacctagggaac

SEQ ID NO: 81949 - DNA, 1820 bp, Oryza sativa
cccagcagaaaacgcagggatagtggaagggaagaaaagcaaaaaaaaagagagaaaggaagaagaggttaaactagtgagggggaacacaaaaaaaaacctccatcaagtaaatttcccccaagttcttcccgttctttcctcaacacacgttgttcttcagaggaagggggtggtggaaagggaagaaaagaaaaaaaaatcaaaagatgggaggaagaggtgaaaaggagggaggtgggaacagagagcaaagagaaaaacctccattaagtaaaaatttttcgggttcttcctgtccccccagcacacgttctttctccttcttcgtgttctttctctcctttctcctttttgcttttccaatctgagttttgatctctcctctagtttttcttttggatctgagttttgatctgagtttctatcttggagcacaagacattttttaagggactcagggagtggaccatttttgtgacagaacccaattcggagctaaaaagcccaaaacgggtatcatgtgagagcccatttgttttgttgaaaaaagcccaaatcacagctaaaaaactgaaaatccagactcactgaactacagccaaaaaagactcgggcccacaccttcgctggcccataacttagcccaaaaaactggggcccaaacattgggcttttgttagttttttggacccaaaagtgtgttttaaccaactttgggctttgggctttttgttagtttttgggcccaaacatctgcaccaggttgtgattttttttgcacgtcacattttgattttttgagctttaccgttagatacatatctaatggtgcacaaagttgactgatcaaatgcaaaaattgcaatcgactgcagaataggcggtcccgattagcaaacacaaaggattaatgaacaactaggtcggcttgtgcggttgtgcccgagtgtggaatggcagacgctgcccaggaataacggagatgggatcgatggcccatatacaaaacaaggatggatccatccaatggtgtcgtgcagctgatcaccaacgtacgtaaccctagagcgtcggcaaaggcaatgtggcggccgattcttctccagcctcgccgcactcccatctcccatctccggcgtcgtggccacgacgcgaccggccacgacgcgaccgacgacgacaaggcggttcttcccctccgccgcctgattggctcacggggctacgcctcctcctctgatgccaccaacgccgccgcctctgccgccgccaacatcgcggctcctcgagctgacagcaggaggcggcggcgttcaccggcggcaaaggcgaaggcgaagcagcatctgtacgtcgtgctgaatgaccggaaggacgcgtgcgagatccacaagctggacatcgacggcggcggcggtggccgcctgatgatgaacgccggcgacatggcttcgctgaagaccctccggcggctccccgagccgccgctcctccggctgcagagccccacagtccacccatgctccaagttcaccaccgtcggcagcagcatcgtcaccatgggcgagtatttcagcgatcattattgcggcgattggtttcgcgaggccagggggaacacccttgtctacgacaccaagacggcggcgctcaccgtcgtgcgccacctcccggaaggccttcttggtgtctacgacttcgtggccgccattgccgtcggcgccaacaggctgtacgtgctcgacgagggcaccatggacgattaccgtggcagaatcgttggaggcatgcactggtttagattgaccgacgacgac

SEQ ID NO: 81950 - DNA, 22631 bp, Oryza sativa
aggtgagggtggggcccacgtgggggtggcaggtttgacactttgaccggcattttttttcttttttcttttttctttttttgcgcggcgtttggatctagctagttcctcagtcgtcacactaccagcttggctttcccactttttttattttcctttttctctttttatatatactactgtataaatataaaaaatacatatagagatattcaaaagatgcgggtgtgtcagaatgtggggcccggtgttcagtccacgtgcctgcgacggtgccagccagtgtgtgtgaccgtggatccatttcgaggcgacgtacgctcgtgcatccatccactcgtgcgtgccaacgtgacaactactactcctcttctaccgtgcaaattttaatggcgcgatcgagttggcaaattgcgcctagtaatcgaggtgagttcgtggatgtttggagcacgtttggttagtgtgagggagtatttttgtaccggattaaagtaataatgttgcgtagctttaggaaccgggactgatgtgtgacgagcgatttctagcgtttggttagagtgattttgcatggagttcttgaaatctggtatagtgcgacaaatgatttttatcctcctgttagagcatagtaatattttcgtgtgtctctagaaaccgactaatgttcgtattgttgtgaagctcttgaaatctactatagtgcgacaaatgattctagtcgattaaagtgatattgttgaggagatattgaaatatgctatagtacgacaaatgattatggccttcagctagagtgatattgtcgcgtacctctagaaatagactaaaggatgcattcagaagtcaatgttcttatttcccactccctcgttttctacgcgcgctactctttctaaactgctaaacattgtgtttcttgaacaaaaaactatagaaagttgtgtaaaaatcttatttattcttttttaacattatttacttaacatttaattaatcatatgttaataagctatctatttttcatgcacgtgggagaggttcccaaccccttctccagaacacatcctaaagtgatattgttgtggaggtcttgaaatctgctgtagtgcgataaatgattctagcctctagctagagtagtgatatcatcgtgtagcactaaaaactgaccaaagttacattgttgttgagcgcttgaaatctgctataatgcgacaaacgattctagcctttggctagagtaatattgtcgtgcagctctaaaccttttttttttgatagtttgtggtcaagaaaaacatttgagttgcatttgtgtcacggaattaagtcatggatgcattgggaaaacacaatgtgtttgtcggtaatcctacctaatatgtggtgagcatttttggtgtcagattaaagtaaatcttgtcatggagctctacgaaccgaccgaactgtgaagagcgatttttggcatttgattaaagtaatttgtcatggagctcttgaattctgttgtagggcgacaaatgaatttttgttgtggatgtgatcttgaaatatgctaatgtgcgataaatgattctagcctccggctagagtgatattatcatgtacttatagaaacagattaaagtaatattgttgtggaggccttgaaatctgctatagtaaaaaatctagcctctggctagagtgatattgtcgtgtagctctaaaaactgactaaagttatattattgtggagctcttgaagtttgctatagtgtgaaaaatgattctaacctctagctatagtaatattattgtgtagctctaaaaatcgactaaaataatattgctgtggagctcttgaaattttttaatagtgcgataatgattctagtctctcgttagagtaatatttacatgtacctctagaaaccgactaaagtaatattgttattgaggccttgaaatctaccataatgtgaccaatggttctagcctctggctaaagcgctgaagtaatattatatatagagctcttgaaatttgctatagagcgataaatcatttaagcctctagctagactgataatatcatgtacttctagaaactggctaaagcaatattattgtgtggagcttttaatatctactattaaaaaaattagcgaccggcaatttcgttgtgggatcatgaaataattttagcaacgggccaaaattatattggaatagaacactggatcactaagaaacattttttatggcacactgaactttgccaaagagaggcgcctctagctagttaatttgatcaagaaaatattgaagtaacacttgttccatgaaattaaaaactgtagcgctcggttcaaagtattattatcgtttaatgtttggaagactcaagtgtgtgacaagttcaaagtaataaggtcatgtggcactttattaccaaaaaaaaaatcaatggtgtgtggccaagaaaatattaaagttgtatttgcgccaataaatcaagtttctgataaaaatatatcctcgtcaattgtccagctagtttgcctaaattgtgctaagcatttttggaatttggttaaagtattattgtcgtggagctctagaaatgaaaatgtgacgagcgattcaatatttggttaaagttattttgttgtcgagctcttaacccgctatagtacgacaaatgattatatccactagccatagtaatattgtcgtagagcacatgatcatcaacaaactttttatggcctactaaactttgccaacaagcaaagtcgctagattgatcaagaaatgttgaagttaaactttgccaacattagagttctctgttcatcaagggaccagaaagatgaactatactcgttttctcacaatatttagacaaaaaaaaatataaccatttgtttactcttctcaattcttgttggaacaacctctcactcctatgatatgcatagatacaaatgaacaatcagccccctacaaaatttttgccggaaaagtcccctacaaaattacagtgacataaaaaaaaaaggacgatcaacatggataataaactaaggaggcacgtacgtatgtaaatgctaaagtttcattttgtttagcatagcaatgcaattcaataggcggttgacatactgattctggacttgtttagatcaattttttcacccagtcacatcgaaagtttggactcgctaaatgataccaaacttttacattagaataataaagctaccaatagttaacctgatcaccaaatgatcaatgccttctagaacaactcagaccctcttctagaacgaacagaagcacaattcaagcaagaactactaccacaaaggtccaagaaagcggtgcaaaatttggttttggatttgaatttgtcgacgcatgatgttcaaccgtagtccgatcgtcactactacactcctctgcagtccggccgcatgcatgcatcttctgcagctagccagctctgaatttctctgatcatcatcatgcatgcatattatcatatcatcagatcgatcaccctccttccaaaacatgcattcatcatcaacagtaaaagactactactcctcctaaaagttaatttgtttgttaggtttggtgttgtggcgttggaccaacaacaacaacaacaacaaagccagcagcaaacacagcagcaacaatcatgtgtgtcgttaggttcggtactatctgtcaaaggatcgagtccaagctagcgtttgcatggaccagagactgctgctgctgctatcgatcaaccacacaagtgttgaaagttccaaccaaacccactgtctctaggcttaacacttgctgttgtcagctagttggtcccatggaaactacattgtcttaatttgggtgcagtttttagccacaggttcagtcattttggaacagctagtagtgattttgtccgctatttcgcctgtttatccaatgggtggaacagtggttttcaggggggaacagtgatttgctctgagatttctatagctcttttagacttggagtaattgttctaattatttatccctccttccctggccgccattgccgcgccttatcgccatcctctcccttcttcccaccctattgtttcgcttatttgtggaataaggcaaacggcatatttgcaaacgaaaaataatttatgtgtggaataagtcaaacggcatagttgcaaacgaaaaataatttatgaataaaacttttatggtcaattgtcctcgccattaataccaaccacaacccaccaccatttagcggccatacaccaaacatcacacgtttgtacatgccccaacacaagttttaagacatggagaccacagtcgtaaatcctctcatagaaatcctaacaaaaagtgcacatacacttactatcacaggggtttaatcctggttgggtccaccatcatacttttgttctttccctggtaattaatacatccccatttcatattataagtcgtttgatttttttcctaatcaaactttgttaaatttgactagatttacaaaaaaattaacaatatataaaatattaaagtaatatattttgataatatgtttgttttgtgttgaaaatactactatatttttctataaacttagtcaaactttaaaagtttaattataaaaagtcaaatgatttataatatgagatggaggaagtacgtaggaatagtgttatgtcacaagtattttgacgataaaactctagtagcaattacaaaatagaagcagcaaaattgtctagagtattaaagttttcatccggtttcgttcgcattcctaaaggttgccgtgatatctgaatttcgtccacccaaacagatctcggatcatgactccacacctttaatctaagtttcaaaccctcctttttgcttcaaccgatcgacctgtggacgtacgaaaaacagaaggccctttacttcatgtgcactactcgagtgattccttttttcggaacgaattgaatgaacataattcgagtcaaaaagcaaattaaccaaaccaaaaagcgaacgcacgcagtgtcgtcctatcgaaatgcacgggtgacaacactggagtatagtagtggcagtactcttttccatgatctttattagagaatgatatactccctccgtaatgtttgacaccgttgactttttagcacatgtttgaccgttcgtcttattcaaaaacttttgtaaaatatgtaaaattatatgtctacatgaaaatatatttaacaatgaatcaaatgataggaaaagaattaataattacttaaattttttgaataagacgaacggtcaaacatttgctaaaaagtcaatggcgtcaaatatttcgaaacggatggagtatttttttttgcctatcatttacatccaattgaatatatgtaagcttttaggacccctttaaaatacaggattgagaaaacacaggaatagaacaaaacataggaatagaatgtcatgattattggattcctatgggattttcaaacacgggaaagtcttcaaaccatcgtttgattaacatacaggaaaaatactggaattttagacacacgtagagaaaatcatgaggtgagacctcatgttattttcctctaaaattgttctagcaaggttaattccatagtaattttaaagggattagtaggaaataatccttagattcaaaagactctataggataaaattctatagaattcctatagtttttcctttgtttcaaaggggctcttaaaattgagaacttgacctttcaaacaacccaatgtaaaatttactttcataaaaatttaaacttaaaatttcaaaatgctactcaggtgacggcaactattacgctacctactctttcgctgcaactgcacgcctgcctcgagacctccttctctccctctcctccggcgcggtggccggccgggcggcgctttgacccacactgcccggccacggcgaggcgtagatgctacgtaggagcaggagtagggtaggagctagctgggccggccatggcgctccttttgcagcagctgggagcagtgcatcgagacccggagacccacgagagctacggtatctgtgtctgtgtgtgtgttttttaacgtacgtgcgcgtagcacaaggctgccgagtaatacccagatgagaagaccatgatgccatctctctctctcacacagagtagggtgcgttcgtttccggtgctttggaactcattccctccataccgaaaacaagcggttcattatcacgtaattaattaagttttagtgtttttttaaaaaatagatcaatatgattttttaatcaactttcgtatagattgttttttttaaaaaaaacacatcgtttaacaatttaaaaagcgtgcgcgtaaaaaacgagaggggagagttgggaacaccctcttgcgaacagagccaagagcaggtaaactagcagcctataaatcagctttaaaagtatatcgagatgataaaaaaagagagagaagcatgtggctacagatttatagccaactgtagtacggactttaagacacaatgtgtgtatgacagatgtgaccagatattaatagtgtagtttttatttataggtaactattatatgaattgactattaaattgactatagataatttagagttagtagttggctatactattaaacttgctccgagtttaacactccctccgtcccattttaagtatagttgtgggtttctatgtaatgttgatcgtccaccttatttaaatatatttatgattaatatttttattatgacatatgataaaacataaatagtattttatgtgtgactttaaaaaaaacaaatcataaatatttaaataagatggacggtcaaacgttagacatgaaaacccacgactgtacttaaaataagatgaaaggagtatatagtagcgtagctataagccaactgtaaaattatgtggagaagaaggaatttaaaaattgaaaaagggttagagtaaggataatagcaagcataagtcaaaaattgaaaagggttagagtaaggataatagtgagtataagtcaactatacttatgtggaggagagagttaaaaaaataaatgagagttcacttaacacgtgctcctggataaatacactaaatacataagtgagaaaaggagagaggagaagaaaaattgaaggctctattatttaacttgtacttggctttgatggaagagctgactattcacatacttcaacatgaatatattaaatgtataggcgagagatatagagaggagaagaaaaatagagataactttataacttatctactatacatgttaactctattattatttccgttctaaaatataacaactagtattatctatgaacgtggacacacatttatctaatatgagctatttaaagatggagtgaggccgtgtttagttgttttggcaaaaaaaaattgacatatacggacacacatttgaagtattaaacatagactaataacaaaacaaattacagattccgcttgtgaactgcaagacgaatctattaagtctaattaatccgtcattagcaaatgtttactatatcaccacattggcaaatcatggtgtaattaggcttaaaagattcgtctcgcaatttacatgcaaactgtgtaattgatttttttatcacatttaatgctttatacatatatccagacatttgatgtgatgtttttagttaaatttttttttatctaaaccaggcctgagaatgaaacaggaggttcgatttttacccgggtcaagtggcgaagaattccaggtagtacaggtagtactgctttttactgcggtgaaaggagcaaagcttctgcgtctgcttggcgttggtctacgtctaacgtgagcgtgcgtgcgcctgttggtcgtcgtccgaatggcctggtctccaacctcctttttcgttcaacgcctttgttggtcccccggcccctctcttcctcttcttcatcgatcaccaccttttcttttttctttcttcccctaaagattatatttgcgcgcagctgatgcagtgcactgcagcagggagagcagctgtggcactggcagtggctggctgctgctctttggtttgggtttgcctgcctagacgaacctctgcaccgtcgtggtccacctctgtcttgttaagtactcccttgattctcatacggctcgtttggttggagggagtttttaggagagattgggaatttaaagggatgatgttattaagggcctctttgaatcaaagaatttatgtaggaattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttcccgagtactcttgtctccctccagtctaccaagatacatggaattcattgcctacaggagatgaggcagcccaggctgtagaactaatggagcgcatgataaagctgaaagagcaaggtttgcagggagaacagatcacttggcacttcataaaaagccgattagctccaatcaaagagaggtcccgcacagcttttgagtttgacggcaaacatgatccaaatcgtgaagatccagactctcttaactttaagattatgaaggaaaggatgtacaagatcttctcgaatgctatcgtcgtcagctattcgcacttgctgctagtcatgccattcaatgctttcaatcctcctccaccgatatgtaatcaaacatttcaacttttcacagaatatagtcttgtctttttgttgaatcaattaacaatgaatgatattacgaccaggaatttgctttgatgaaatcggaccccccagtcgtccaatgccgatcaccccaccgccaaaccggtcaagggagcgggggtcccaagacccgttctgaagcccggccaaatacttccaatccagccagatttacgcaaaaggaagttggtgtcaagtgacgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgaccagccagatttacgcaaaaggaagttggtgtcaagtgatgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatattcgtgaaaccttccttgtcatatcgattaaccgaagagcatttcagtgcaagccgccaggatttccgacctagagaggcaggtcgaagctctggagaaggacaaggccgaactagcaaagcagagggacttggccttaaaagatgttgaaggtaatgataactagttccccatgctcttatagccacctgttgatacaaatttattcgtgcaaatcgcaaaatcaagtcccaggcacagtttgatgtcttaatcaataagatcaataggcttgaaggggccagggataaagtcgctaatgccgctaccctactcatccaagccatgttcttcaataacgccggttcgagtacacttgacgcttccgagatcttcgacaagctgagagtcgctccggatacttacttcaagaatattagggaggttggatgtatgggagcaagcatggcgttagctatgaccaaatctttataccccaaaatcgatattgacgccgttgatgggtttgcagacgggacaagcgaagaaacagccctcaacctcatcaatgatgcgcaaaaagccgctgacaagattgctgctgacatagttgagagattccaggatggcgaccttcggccgactgggtctgataattccgacgatgaaaaaactgacactgattgatgttatattgtaattgtgattctgatgatgatgatgacgatgatggaggtacaatttgtacaatactgataaatttatgctgtgcatgatatttcaaacttagctcctgatttcttaaaagtttttgtcaaaccttgttgagcctaaaactcgcaaaagttgttaaaaaactttcagtcctcattgactaagccaaaaaatcaaacagagcaatgataaatcaagtaagcgaattgaattgataaagatcacactccattatcatagtagcccccgactgacaactcaagaaaaggcttgatgttagcagtcgaagaggaaaatacagaagtgatgcctaagcataaaaacaacgaaggtgttcaatattccaagaattgttgacaagagtaccatcttcacgcttgagtcggtaagaacctggccgagtgactttagcgattatgaatggtccttcccataagggagataacttgtgccgatcctatgtagtttgaattctcctcagaaccaggtcgccaactaaaaaggctcgcgatcgaacattccgattatgataacggcgtaacccttgtaaataccgagctgactggattagggctgcttcacgggcttcttccagtcggttgatgtcatccactcgatcctcttcatggcgctcttcccggaagttacgaaatcggagggattcaaactctacctcactcggcagcattgcttctgcgccataaaccaagaagaacggcgactggccagtagcccgactgggggtggtgcgtaaagaccaaagtacagacggcagctgttctacccacttgccagcatagggacgcagtcggtcgaaaactcgtgctttgatcccttgaagtaccatgccattggcgcgttcgacttgcccgttactcatggggtgtgccacagaggcgtaacaaattttaatgccaaagtcttcacaaaaatctttaaatattccgcccgtaaattgagtgccgttatccgtaatgatacgattcggtactccaaaccgatgtacaatattgatgaagaaatctctagctttgtctgcggtgatggtgacgaccggtttggttttaatccacttggaaaacttttccacagctacaaagagatgagtataacccccgactgcctttttgaatggaccgaccatatcaagcccccaaaccacgaacggccaagacaacgggatggtttgtaactcctgagctggtaagtgagtttgtcgggcaaagaattgacaaccttcacatgttcgcacaattttgtcggcgtcggaaacagctgtgggccagaaaaaaccctgccgataagccttgccaacaatggttcgtgcagcagcgtgattaccgcagatgcctgaatgaatgtcttttagcaattgtcttccctcttccaaagatacacagcgttgcaggattcctgatggacttttcttgtacaactcggtctcatgaatgacatagagtctgctgcgcctggagatctgcttggcttcatttttgtcttgagggagttcttgtttggttagaaattttatgagaggttctctccagtcggcttcaatcatgcttacgccttgagtatccatggcttcaattgtttcttttctgggcacggttggttcgtaaagatgttcgacgaacacatctgaaggagccgcttcctgttttgaaccaaaattggccagcctgtctgctgcctcattattatgtcggaggacatgggtgagcttgagtccgtcgaatttatcttccaacttgcgtacctcttgtcgataagcggtcatattgtcatctagacaggaccattctttcatgacttgattaacgaccaactgagaatctcctcggacgattagtcggcgaatgcctaaagagacggcaatccttaatccatggagcaacgcctcgtattccaccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgttttcttgacactcggtccactcggcgaggaagtcagctaaagcttatgacttgatcgaagttcgtggcttgaaagatatgtccaaagatgtcaattctaaggcccacttcgctatccgtccgtttgctttgtggttatgaagtatatccccgagtggaaacaatgtgaccaccggaccgagtgaccttgaaaatagtgagacaatttcctaacggtaattaagacgccatataataaattttgaacctgaggatatctcgtcttggagtcggccaaaacctcgctaacgaagtatattggtcattggactttttgaacatggccttcctcttcacgtttgacaaccaggaccgtgctcacaaccttagaggtcgccgacacgtataacagcagcggctcttgtggatgtggcgaggccaaaactggtgtagtgagaaattttttgaagtcttcaaaggctttttgtgcttcgggtccccactggaaattgtcagttttcttcagcaacttgaagaagggcatcccccgttcaccgagtcgcgaaacgaaccggctgagcgccgccatgcaatcagtcagcttttggacatctttttgtgagcttggcggtttcatgttgagcatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgcgatcaggtcatacttctgcttggtcttgacgactacatcatcaacataagcttcaacaatgcgaccgatctgagttgaaaaacatctttgaatcatgcgttgataggttgctcatgcgttcttcaatccaaaggacatggtgatgtagcagtaggacccaaagggcgttataaacgaggtcttcaagtagtcggattctttcagtcggatctgatgatatcccgaatagcagtccaagaaactgagtagctcgtagccggccattgagtcaaccacctggtcaatgcgaggtaacccgaaaggatctttagggcaagacttgttgaggtcggtgtaatcgacacacatgcgccattgcccagtcttcttccgaaccagaactgggttagccagccagtcgggatggaggacttctttaatgaagcctgctgctaacagtttggctaattcctctttgatcgcatccttcctatcttgtgcaaagcggcggagtcgttgtttgatgggtttggcgtcttccttgacatgtaaagagtgctcaatcacctctctgggaataccaggcatatcggatggtttccacgcaaaaatatctttattattctgaagaaaggtgatgagagcgctttcctatttacaatctaactcagcgcctattacagcagttttggtaggatcggagggatctagtggaatcttcttagttttgtcgtcgccttcttcggtctttgacagcttggtcgtaggcacctctccttcgcttgccgtagtggcagccaatcggatctcttcgcgagcgagagtgatctcgtgggtttgggctatttcgcaactttctttgtcacatgtgacggcttgcttgatgtcgctccgtagtgatatgactcctcgaggaccaggcatcttcatcatcatgtaggtgtaatgtgggacggccatgaatttggctagagccggtcgtccaagtatagcatggtacgttgtctcgaaatcggcaacttcaaaacaaacgttttctgtgcgaaagttttcccgagtgccgaaggtaaccggaagagtgatctggccgagtggtgtagcggataatcctaggatgacaccatggaagggtgcattactcggctttaattccgttcgaggaatctgcatatcgtccagagtcttggcgaaaaggatgttgagtgcactgctaccatcgatgagggttctttggagcttgacgttacgaaccactgggtatagtaccagggggtaccgccccgggtggaccactcggtcgggatgatccgagcggtcgaacttaattgctatctctgaccaccgaaggtattggggcgtgttaggctgaaccgcattgatctcccgttctgttagcttctgctttctcttagattcataagccaggggtccgccaaagatgtgaattagttctttgcgatgatcttgaaaaccaagtgggacatcgtcttcaccatctttcttctttgatgtgccttggtctccgtctgagggcttacgtgcgttcttgacgtattgctctacaaactgtttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagaagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtggcgaatgcctttagtaaaggcggcaatgatgacgtcatcggtgatgtcggagatcttgttgcgttgctcagagaagcgtcgaatgtaatctcgaagagattctccagacttctgaatgatgttgtagagatcgaagtgtgtaccaggccgttcaaaagtgccttggaagttggcgatgaagtggtcgcgtagctctgcccatgatccgatcgtgccgcggggtagcccgtgaagccatgaccgggcagaatccgctagggccacaggtagataattcgccatggctttgctgtctcctcctgctacgcggattgcgagaccatagacggtgagccaagactcagggttggtggtgccgtcatatttctcgattccggtcgacttaaagccagctggccaatccactcgacgcagatcgcttgtgaaggcagcaactccgtccacatcgtcgtcgtagcgatccggtgaatgatggcctcttgctgcgcggtgctggttgatggtgtcacgaagatcgatggggcgccttcgatgtggggagtgtggtcgttcaactcgacgctccctgtatcgttcgggaggcgaacgaacagaccgttcatcatgtcccctgctcctgcgactagatctggcgccgtcaatgctgaggcttggctggtgatagtcctgagatcgaaggtgagggactcggctaccagtcggggtgcgggcgcttgcggagttggctggaaacgaagcaacgatcatggtcttcgtttgattcaagatgtttacaacatgatcagcttgattgagtacgtcttccttgaggagggtgtcgaggagagtgattgctgcaaccgcgttctgctgggggtgcgaaaaaccgctgttccatcgacgtcttgttgcccaatgagctctctcgctcgtcgcccaaattccaaggcgcgctgccgtcgatcttcaccctcctttgcaatccgttcgcgatcttgttgctcacgctgtagtcgttctcgctcctgttgctgtcgctcttcctccagttggcgacgttcagtttcttgccatgcgcgctcttggtccacttctcgggctcggcgttgttcctccgtttcgttgtcagccacgaatacgccgaagaagagaggcgtgtagttatcctcatagctgtcgtcgaagttgtcgaagtcgtcgtggtcgtagtggtagccgaagtcgtcgtagtcgaggatctcggttggtcgagaactgacaccgggggagctaaggtagccatccaactcttccgtcgagactgtcccaaggggttggagtataacgccaacctccctggatctagatcggatcggggccgaagccggagctcgcctagatcttcgagcaggagatgtcttggctgtgaagacagcggccaaatcatcaggaagttttatcaggattgagggataggacccgtcatcttgatctggtcgcggaggagtagattagatctcgtccgagtggtttgaagccgactcgggagagatgatcttggagtaggcctcggccgagttcggaataccgaacggcgcggggacctgatctctccccgactagttcgaatccgagttaggagagagatcttgccgaagtcgttggtgatgaagttgaggctgccgaaccggaacgcctgtccgggagggaaggcgaagtcgtcgatgccagaaacggaacccatcgcacttagccggtaaaaacttgacgctacccctacctggcgcgccaactgtcgaaacaagatttcggcaatactaaaagggggtggctatcaagctaggaaagtggatgggtttggagacgaagaattttatacaggttcaggccttcttattcaagaagtaataccctactcctgtccggggatgattccgccgagtgtattattgattgtataatctaggtcaaaaaaccgtgccccgataagcatccggacccctccttatataggggaaggggtccgctttacaaaatacagtccatatcctaaaagaacatggaattacagataaaatataatcgtaaccgactaggatctcgggtatttccttgacatacaagtttagaatctaacccgagtcctcatgaagatattctgtctttattcggtatcctgtacccagctagaatatgaccgccatgtagatatagggtatccataatctccacatgtttatttaggagacatgagaattttggtgggatggggatggggatgtggaattgaggaaggaactccctccttttcaatacctgggtaggggcaggtgattgggagggaattcctcctttactttgtctatgcaaatctcaactatccatttttattaatgacataatctccaactaaactccctatcagtttccatcactccaaccaaacaagatactgggattaaaaatcaaattcccatcttaatctcatcataaattcccttgtgtaaactctcaatccccttccctcgagttaccaaacaagccgataagacttagaattattttatattttgatttttcaaagtaaatgggtcataccttgtagttttcatgtatatatctgaaatttaaatgatttaccggaacccaaatacacattcaatactcatcgattgcattatatacacttacaccttcatcggttggcttatgttgttgcgtttcagcataagcagactgatgtttatcggtataagcgtttccatcgtttggcttataaagagtaatggctgattagtggatcttctgtggcatggtgatcgttgagaggtagggttcgagagaggggagtggggaatcgaggttggtctcctagcgatgtggccgtagaaaggtgtcgggaaggattggtcccactaccaatggctgatgcataatcagcccaataagctaaccgatggacttttgctgaaaatctgcctctgcaacattgaaccgatgagagtgttctttgatctttgttacattacatgtagttttggtcatggtgataaaagtaatatatctaactcttttggatggatagaatatattactaaattttcatgcgtgtgtgctataattgggatcaaaatgcttataaacgaccagaaacaatattgtttctatgaaaaattagaggatataaattctatgtatatagctaggattcaaatctggcgataatggtaccacttttacagaaaccaatctgaaaattccgtcaccattttcatctcctaggttgctagccagctgcttatggttgatggaccagatgtatagttactgagctctaaattggctatagtattgtattatcctttttaatggtaaatagtctgaaggctgagattttcttttggctgtggtttataggccataatatgtgaccaaagcaatgaaaaataattctacaataggatttttatgcttatactttcagcggtttaaaagtcagggatgaaaagtgaaaaacgatgggaaaaacatcaagagtaatataaaatcgactttgaaaattcaaattagactatgattctcatgtatccatatgcacatttgtggtacccgaattcgaatttcgctgctctaataatggaagattggttcaggatttgatgggtttataagtcatttctattaaaaaaaaacaaggtcgcaagatacggtcttaatatgttggaccttagcaatttaaattcgtactattcgtgaaggtttctttaaataatgtccaaatttggtagaaatttattcaaaaattaatcttgtgaaattttcccttaaatacccaatcgagtctccctctccaaacgacttaaacttgcttcacacactttttcccaattttatatatcatcttaaccttgctgccatattctttactggttaacggataaatggatgaataggcatgttctccgaactaattaacagtacgatttaaagaatgctttctatatataaatgtattgcaaaactgttttaaagtccaattttcaacataattcatacactgatagagaaaccatctttggtcggtcgaccccaatccacaatagtcccggttccattaaaaaccgggacaaaatgatttttagtcccggttaataagaggaagatctttagtcccggttgttgttaccaaccgggactaaaaatcatctttagtcccggttggtttatttttagtcccggttgattccatgtcaggccgtgtcagggccctatgatctttaatcccggttagtaacaccaattagtcccggttggtgttagtttttagtcccggttggtgttactaaccgggaataaaaatcaaaacacactatataatccatataccgatcctcttttcccgtccacacaacaaactcctccctctatctctttttttcctctcta

SEQ ID NO: 81951 - DNA, 515 bp, Oryza sativa
tttttctcgacagttcaaacttcactgagaaatgttaattgatcacactaatttctttttcttttctcttatcagttacactgtaaactaataaattatgtatactgaactaagtatgagcatcttgtatgacctgaagtcaatatccgtgggtttatttttcgaatgcgtgaagcggcagcaattttcatcgcccccatggcttctgtctgttcttcaatgcttgccatgcaattggagtatactgattacatctacatcgacaagtggttcgtccacatgctggagggctctgaattcctagccatggacgcccgcttgctgcataggaaggttgggatccatatgcttgtccagcctgcaggcaagatgcagtcgcaggtggccacatgaatgacatgtcagttcagaacgttcagatccaaggctttaggtcaggcaggcagaactgctgaattttattatggcacatgatgaattgctgcgtattgccttgctaatgcctggttcaaatt

SEQ ID NO: 81952 - DNA, 65317 bp, Oryza sativa
  unsure (1)..(65317): unsure at all n locations
gtggtggggtggaggtggaggtgggagataatggcgtgtggtgtggggggaggtgggtataagagggaaggggggaggtgggggtggggcccacgtgggggtggcaggtttgacactttgaccggcattttttttcttttttcttttttctttttttgcgcggcgtttggatctagctagttcctcagtcgtcacactaccagcttggctttcccactttttttattttcctttttctctttttatatatactactgtataaatataaaaaatacatatagagatattcaaaagatgcgggtgtgtcagaatgtggggcccggtgttcagtccacgtgcctgcgacggtgccagccagtgtgtgtgaccgtggatccatttcgaggcgacgtacgctcgtgcatccatccactcgtgcgtgccaacgtgacaactactactcctcttctaccgtgcaaattttaatggcgcgatcgagttggcaaattgcgcctagtaatcgaggtgagttcgtggatgtttggagcacgtttggttagtgtgagggagtatttttgtaccggattaaagtaataatgttgcgtagctttaggaaccgggactgatgtgtgacgagcgatttctagcgtttggttagagtgattttgcatggagttcttgaaatctggtatagtgcgacaaatgatttttatcctcctgttagagcatagtaatattttcgtgtgtctctagaaaccgactaatgttcgtattgttgtgaagctcttgaaatctactatagtgcgacaaatgattctagtcgattaaagtgatattgttgaggagatattgaaatatgctatagtacgacaaatgattatggccttcagctagagtgatattgtcgcgtacctctagaaatagactaaaggatgcattcagaagtcaatgttcttatttcccactccctcgttttctacgcgcgctactctttctaaactgctaaacattgtgtttcttgaacaaaaaactatagaaagttgtgtaaaaatcttatttattcttttttaacattatttacttaacatttaattaatcatatgttaataagctatctatttttcatgcacgtgggagaggttcccaaccccttctccagaacacatcctaaagtgatattgttgtggaggtcttgaaatctgctgtagtgcgataaatgattctagcctctagctagagtagtgatatcatcgtgtagcactaaaaactgaccaaagttacattgttgttgagcgcttgaaatctgctataatgcgacaaacgattctagcctttggctagagtaatattgtcgtgcagctctaaaccttttttttttgatagtttgtggtcaagaaaaacatttgagttgcatttgtgtcacggaattaagtcatggatgcattgggaaaacacaatgtgtttgtcggtaatcctacctaatatgtggtgagcatttttggtgtcagattaaagtaaatcttgtcatggagctctacgaaccgaccgaactgtgaagagcgatttttggcatttgattaaagtaatttgtcatggagctcttgaattctgttgtagggcgacaaatgaatttttgttgtggatgtgatcttgaaatatgctaatgtgcgataaatgattctagcctccggctagagtgatattatcatgtacttatagaaacagattaaagtaatattgttgtggaggccttgaaatctgctatagtaaaaaatctagcctctggctagagtgatattgtcgtgtagctctaaaaactgactaaagttatattattgtggagctcttgaagtctgctatagtgtgaaaaatgattctaacctctggctatagtaatatttttgtgtagctctaaaaaatgactaaaataacattgttgtggagctcttgaaatttgttatagtgcgacaaatgattctagcctctagctatagtaatattattgtgtagctctaaaaatcgactaaaataatattgctgtggagctcttgaaattttttaatagtgcgataaatgattctagtctctcgttagagtaatatttacatgtacctctagaaaccgactaaagtaatattgttattgaggccttgaaatctaccataatgtgaccaatggttctagcctctggctaaagcgctgaagtaatattatatatagagctcttgaaatttgctatagagcgataaatcatttaagcctctagctagactgataatatcatgtacttctagaaactggctaaagcaatattattgtgtggagcttttaatatctactattaaaaaaattagcgaccggcaatttcgttgtgggatcatgaaataattttagcaacgggccaaaattatattggaatagaacactggatcactaagaaacattttttatggcacactgaactttgccaaagagaggcgcctctagctagttaatttgatcaagaaaatattgaagtaacacttgttccatgaaattaaaaactgtagcgctcggttcaaagtattattatcgtttaatgtttggaagactcaagtgtgtgacaagttcaaagtaataaggtcatgtggcactttattaccaaaaaaaaaatcaatggtgtgtggccaagaaaatattaaagttgtatttgcgccaataaatcaagtttctgataaaaatatatcctcgtcaattgtccagctagtttgcctaaattgtgctaagcatttttggaatttggttaaagtattattgtcgtggagctctagaaatgaaaatgtgacgagcgattcaatatttggttaaagttattttgttgtcgagctcttaacccgctatagtacgacaaatgattatatccactagccatagtaatattgtcgtagagcacatgatcatcaacaaactttttatggcctactaaactttgccaacaagcaaagtcgctagattgatcaagaaatgttgaagttaaactttgccaacattagagttctctgttcatcaagggaccagaaagatgaactatactcgttttctcacaatatttagacaaaaaaaaatataaccatttgtttactcttctcaattcttgttggaacaacctctcactcctatgatatgcatagatacaaatgaacaatcagccccctacaaaatttttgccggaaaagtcccctacaaaattacagtgacataaaaaaaaaaggacgatcaacatggataataaactaaggaggcacgtacgtatgtaaatgctaaagtttcattttgtttagcatagcaatgcaattcaataggcggttgacatactgattctggacttgtttagatcaattttttcacccagtcacatcgaaagtttggactcgctaaatgataccaaacttttacattagaataataaagctaccaatagttaacctgatcaccaaatgatcaatgccttctagaacaactcagaccctcttctagaacgaacagaagcacaattcaagcaagaactactaccacaaaggtccaagaaagcggtgcaaaatttggttttggatttgaatttgtcgacgcatgatgttcaaccgtagtccgatcgtcactactacactcctctgcagtccggccgcatgcatgcatcttctgcagctagccagctctgaatttctctgatcatcatcatgcatgcatattatcatatcatcagatcgatcaccctccttccaaaacatgcattcatcatcaacagtaaaagactactactcctcctaaaagttaatttgtttgttaggtttggtgttgtggcgttggaccaacaacaacaacaacaacaaagccagcagcaaacacagcagcaacaatcatgtgtgtcgttaggttcggtactatctgtcaaaggatcgagtccaagctagcgtttgcatggaccagagactgctgctgctgctatcgatcaaccacacaagtgttgaaagttccaaccaaacccactgtctctaggcttaacacttgctgttgtcagctagttggtcccatggaaactacattgtcttaatttgggtgcagtttttagccacaggttcagtcattttggaacagctagtagtgattttgtccgctatttcgcctgtttatccaatgggtggaacagtggttttcaggggggaacagtgatttgctctgagatttctatagctcttttagacttggagtaattgttctaattatttatccctccttccctggccgccattgccgcgccttatcgccatcctctcccttcttcccaccctattgtttcgcttatttgtggaataaggcaaacggcatatttgcaaacgaaaaataatttatgtgtggaataagtcaaacggcatagttgcaaacgaaaaataatttatgaataaaacttttatggtcaattgtcctcgccattaataccaaccacaacccaccaccatttagcggccatacaccaaacatcacacgtttgtacatgccccaacacaagttttaagacatggagaccacagtcgtaaatcctctcatagaaatcctaacaaaaagtgcacatacacttactatcacaggggtttaatcctggttgggtccaccatcatacttttgttctttccctggtaattaatacatccccatttcatattataagtcgtttgatttttttcctaatcaaactttgttaaatttgactagatttacaaaaaaattaacaatatataaaatattaaagtaatatattttgataatatgtttgttttgtgttgaaaatactactatatttttctataaacttagtcaaactttaaaagtttaattataaaaagtcaaatgatttataatatgagatggaggaagtacgtaggaatagtgttatgtcacaagtattttgacgataaaactctagtagcaattacaaaatagaagcagcaaaattgtctagagtattaaagttttcatccggtttcgttcgcattcctaaaggttgccgtgatatctgaatttcgtccacccaaacagatctcggatcatgactccacacctttaatctaagtttcaaaccctcctttttgcttcaaccgatcgacctgtggacgtacgaaaaacagaaggccctttacttcatgtgcactactcgagtgattccttttttcggaacgaattgaatgaacataattcgagtcaaaaagcaaattaaccaaaccaaaaagcgaacgcacgcagtgtcgtcctatcgaaatgcacgggtgacaacactggagtatagtagtggcagtactcttttccatgatctttattagagaatgatatactccctccgtaatgtttgacaccgttgactttttagcacatgtttgaccgttcgtcttattcaaaaacttttgtaaaatatgtaaaattatatgtctacatgaaaatatatttaacaatgaatcaaatgataggaaaagaattaataattacttaaattttttgaataagacgaacggtcaaacatttgctaaaaagtcaatggcgtcaaatatttcgaaacggatggagtatttttttttgcctatcatttacatccaattgaatatatgtaagcttttaggacccctttaaaatacaggattgagaaaacacaggaatagaacaaaacataggaatagaatgtcatgattattggattcctatgggattttcaaacacgggaaagtcttcaaaccatcgtttgattaacatacaggaaaaatactggaattttagacacacgtagagaaaatcatgaggtgagacctcatgttattttcctctaaaattgttctagcaaggttaattccatagtaattttaaagggattagtaggaaataatccttagattcaaaagactctataggataaaattctatagaattcctatagtttttcctttgtttcaaaggggctcttaaaattgagaacttgacctttcaaacaacccaatgtaaaatttactttcataaaaatttaaacttaaaatttcaaaatgctactcaggtgacggcaactattacgctacctactctttcgctgcaactgcacgcctgcctcgagacctccttctctccctctcctccggcgcggtggccggccgggcggcgctttgacccacactgcccggccacggcgaggcgtagatgctacgtaggagcaggagtagggtaggagctagctgggccggccatggcgctccttttgcagcagctgggagcagtgcatcgagacccggagacccacgagagctacggtatctgtgtctgtgtgtgtgttttttaacgtacgtgcgcgtagcacaaggctgccgagtaatacccagatgagaagaccatgatgccatctctctctctcacacagagtagggtgcgttcgtttccggtgctttggaactcattccctccataccgaaaacaagcggttcattatcacgtaattaattaagttttagtgtttttttaaaaaatagatcaatatgattttttaatcaactttcgtatagattgttttttttaaaaaaaacacatcgtttaacaatttaaaaagcgtgcgcgtaaaaaacgagaggggagagttgggaacaccctcttgcgaacagagccaagagcaggtaaactagcagcctataaatcagctttaaaagtatatcgagatgataaaaaaagagagagaagcatgtggctacagatttatagccaactgtagtacggactttaagacacaatgtgtgtatgacagatgtgaccagatattaatagtgtagtttttatttataggtaactattatatgaattgactattaaattgactatagataatttagagttagtagttggctatactattaaacttgctccgagtttaacactccctccgtcccattttaagtatagttgtgggtttctatgtaatgttgatcgtccaccttatttaaatatatttatgattaatatttttattatgacatatgataaaacataaatagtattttatgtgtgactttaaaaaaaacaaatcataaatatttaaataagatggacggtcaaacgttagacatgaaaacccacgactgtacttaaaataagatgaaaggagtatatagtagcgtagctataagccaactgtaaaattatgtggagaagaaggaatttaaaaattgaaaaagggttagagtaaggataatagcaagcataagtcaaaaattgaaaagggttagagtaaggataatagtgagtataagtcaactatacttatgtggaggagagagttaaaaaaataaatgagagttcacttaacacgtgctcctggataaatacactaaatacataagtgagaaaaggagagaggagaagaaaaattgaaggctctattatttaacttgtacttggctttgatggaagagctgactattcacatacttcaacatgaatatattaaatgtataggcgagagatatagagaggagaagaaaaatagagataactttataacttatctactatacatgttaactctattattatttccgttctaaaatataacaactagtattatctatgaacgtggacacacatttatctaatatgagctatttaaagatggagtgaggccgtgtttagttgttttggcaaaaaaaaattgacatatacggacacacatttgaagtattaaacatagactaataacaaaacaaattacagattccgcttgtgaactgcaagacgaatctattaagtctaattaatccgtcattagcaaatgtttactatatcaccacattggcaaatcatggtgtaattaggcttaaaagattcgtctcgcaatttacatgcaaactgtgtaattgatttttttatcacatttaatgctttatacatatatccagacatttgatgtgatgtttttagttaaatttttttttatctaaaccaggcctgagaatgaaacaggaggttcgatttttacccgggtcaagtggcgaagaattccaggtagtacaggtagtactgctttttactgcggtgaaaggagcaaagcttctgcgtctgcttggcgttggtctacgtctaacgtgagcgtgcgtgcgcctgttggtcgtcgtccgaatggcctggtctccaacctcctttttcgttcaacgcctttgttggtcccccggcccctctcttcctcttcttcatcgatcaccaccttttcttttttctttcttcccctaaagattatatttgcgcgcagctgatgcagtgcactgcagcagggagagcagctgtggcactggcagtggctggctgctgctctttggtttgggtttgcctgcctagacgaacctctgcaccgtcgtggtccacctctgtcttgttaagtactcccttgattctcatacggctcgtttggttggagggagtttttaggagagattgggaatttaaagggatgatgttattaagggcctctttgaatcaaagaatttatgtaggaattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttcccgagtactcttgtctccctccagtctaccaagatacatggaattcattgcctacaggagatgaggcagcccaggctgtagaactaatggagcgcatgataaagctgaaagagcaaggtttgcagggagaacagatcacttggcacttcataaaaagccgattagctccaatcaaagagaggtcccgcacagcttttgagtttgacggcaaacatgatccaaatcgtgaagatccagactctcttaactttaagattatgaaggaaaggatgtacaagatcttctcgaatgctatcgtcgtcagctattcgcacttgctgctagtcatgccattcaatgctttcaatcctcctccaccgatatgtaatcaaacatttcaacttttcacagaatatagtcttgtctttttgttgaatcaattaacaatgaatgatattacgaccaggaatttgctttgatgaaatcggaccccccagtcgtccaatgccgatcaccccaccgccaaaccggtcaagggagcgggggtcccaagacccgttctgaagcccggccaaatacttccaatccagccagatttacgcaaaaggaagttggtgtcaagtgacgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgaccagccagatttacgcaaaaggaagttggtgtcaagtgatgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatattcgtgaaaccttccttgtcatatcgattaaccgaagagcatttcagtgcaagccgccaggatttccgacctagagaggcaggtcgaagctctggagaaggacaaggccgaactagcaaagcagagggacttggccttaaaagatgttgaaggtaatgataactagttccccatgctcttatagccacctgttgatacaaatttattcgtgcaaatcgcaaaatcaagtcccaggcacagtttgatgtcttaatcaataagatcaataggcttgaaggggccagggataaagtcgctaatgccgctaccctactcatccaagccatgttcttcaataacgccggttcgagtacacttgacgcttccgagatcttcgacaagctgagagtcgctccggatacttacttcaagaatattagggaggttggatgtatgggagcaagcatggcgttagctatgaccaaatctttataccccaaaatcgatattgacgccgttgatgggtttgcagacgggacaagcgaagaaacagccctcaacctcatcaatgatgcgcaaaaagccgctgacaagattgctgctgacatagttgagagattccaggatggcgaccttcggccgactgggtctgataattccgacgatgaaaaaactgacactgattgatgttatattgtaattgtgattctgatgatgatgatgacgatgatggaggtacaatttgtacaatactgataaatttatgctgtgcatgatatttcaaacttagctcctgatttcttaaaagtttttgtcaaaccttgttgagcctaaaactcgcaaaagttgttaaaaaactttcagtcctcattgactaagccaaaaaatcaaacagagcaatgataaatcaagtaagcgaattgaattgataaagatcacactccattatcatagtagcccccgactgacaactcaagaaaaggcttgatgttagcagtcgaagaggaaaatacagaagtgatgcctaagcataaaaacaacgaaggtgttcaatattccaagaattgttgacaagagtaccatcttcacgcttgagtcggtaagaacctggccgagtgactttagcgattatgaatggtccttcccataagggagataacttgtgccgatcctatgtagtttgaattctcctcagaaccaggtcgccaactaaaaaggctcgcgatcgaacattccgattatgataacggcgtaacccttgtaaataccgagctgactggattagggctgcttcacgggcttcttccagtcggttgatgtcatccactcgatcctcttcatggcgctcttcccggaagttacgaaatcggagggattcaaactctacctcactcggcagcattgcttctgcgccataaaccaagaagaacggcgactggccagtagcccgactgggggtggtgcgtaaagaccaaagtacagacggcagctgttctacccacttgccagcatagggacgcagtcggtcgaaaactcgtgctttgatcccttgaagtaccatgccattggcgcgttcgacttgcccgttactcatggggtgtgccacagaggcgtaacaaattttaatgccaaagtcttcacaaaaatctttaaatattccgcccgtaaattgagtgccgttatccgtaatgatacgattcggtactccaaaccgatgtacaatattgatgaagaaatctctagctttgtctgcggtgatggtgacgaccggtttggttttaatccacttggaaaacttttccacagctacaaagagatgagtataacccccgactgcctttttgaatggaccgaccatatcaagcccccaaaccacgaacggccaagacaacgggatggtttgtaactcctgagctggtaagtgagtttgtcgggcaaagaattgacaaccttcacatgttcgcacaattttgtcggcgtcggaaacagctgtgggccagaaaaaaccctgccgataagccttgccaacaatggttcgtgcagcagcgtgattaccgcagatgcctgaatgaatgtcttttagcaattgtcttccctcttccaaagatacacagcgttgcaggattcctgatggacttttcttgtacaactcggtctcatgaatgacatagagtctgctgcgcctggagatctgcttggcttcatttttgtcttgagggagttcttgtttggttagaaattttatgagaggttctctccagtcggcttcaatcatgcttacgccttgagtatccatggcttcaattgtttcttttctgggcacggttggttcgtaaagatgttcgacgaacacatctgaaggagccgcttcctgttttgaaccaaaattggccagcctgtctgctgcctcattattatgtcggaggacatgggtgagcttgagtccgtcgaatttatcttccaacttgcgtacctcttgtcgataagcggtcatattgtcatctagacaggaccattctttcatgacttgattaacgaccaactgagaatctcctcggacgattagtcggcgaatgcctaaagagacggcaatccttaatccatggagcaacgcctcgtattccaccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgttttcttgacactcggtccactcggcgaggaagtcagctaaagcttatgacttgatcgaagttcgtggcttgaaagatatgtccaaagatgtcaattctaaggcccacttcgctatccgtccgtttgctttgtggttatgaagtatatccccgagtggaaacaatgtgaccaccggaccgagtgaccttgaaaatagtgagacaatttcctaacggtaattaagacgccatataataaattttgaacctgaggatatctcgtcttggagtcggccaaaacctcgctaacgaagtatattggtcattggactttttgaacatggccttcctcttcacgtttgacaaccaggaccgtgctcacaaccttagaggtcgccgacacgtataacagcagcggctcttgtggatgtggcgaggccaaaactggtgtagtgagaaattttttgaagtcttcaaaggctttttgtgcttcgggtccccactggaaattgtcagttttcttcagcaacttgaagaagggcatcccccgttcaccgagtcgcgaaacgaaccggctgagcgccgccatgcaatcagtcagcttttggacatctttttgtgagcttggcggtttcatgttgagcatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgcgatcaggtcatacttctgcttggtcttgacgactacatcatcaacataagcttcaacaatgcgaccgatctgagttgaaaaacatctttgaatcatgcgttgataggttgctcatgcgttcttcaatccaaaggacatggtgatgtagcagtaggacccaaagggcgttataaacgaggtcttcaagtagtcggattctttcagtcggatctgatgatatcccgaatagcagtccaagaaactgagtagctcgtagccggccattgagtcaaccacctggtcaatgcgaggtaacccgaaaggatctttagggcaagacttgttgaggtcggtgtaatcgacacacatgcgccattgcccagtcttcttccgaaccagaactgggttagccagccagtcgggatggaggacttctttaatgaagcctgctgctaacagtttggctaattcctctttgatcgcatccttcctatcttgtgcaaagcggcggagtcgttgtttgatgggtttggcgtcttccttgacatgtaaagagtgctcaatcacctctctgggaataccaggcatatcggatggtttccacgcaaaaatatctttattattctgaagaaaggtgatgagagcgctttcctatttacaatctaactcagcgcctattacagcagttttggtaggatcggagggatctagtggaatcttcttagttttgtcgtcgccttcttcggtctttgacagcttggtcgtaggcacctctccttcgcttgccgtagtggcagccaatcggatctcttcgcgagcgagagtgatctcgtgggtttgggctatttcgcaactttctttgtcacatgtgacggcttgcttgatgtcgctccgtagtgatatgactcctcgaggaccaggcatcttcatcatcatgtaggtgtaatgtgggacggccatgaatttggctagagccggtcgtccaagtatagcatggtacgttgtctcgaaatcggcaacttcaaaacaaacgttttctgtgcgaaagttttcccgagtgccgaaggtaaccggaagagtgatctggccgagtggtgtagcggataatcctaggatgacaccatggaagggtgcattactcggctttaattccgttcgaggaatctgcatatcgtccagagtcttggcgaaaaggatgttgagtgcactgctaccatcgatgagggttctttggagcttgacgttacgaaccactgggtatagtaccagggggtaccgccccgggtggaccactcggtcgggatgatccgagcggtcgaacttaattgctatctctgaccaccgaaggtattggggcgtgttaggctgaaccgcattgatctcccgttctgttagcttctgctttctcttagattcataagccaggggtccgccaaagatgtgaattagttctttgcgatgatcttgaaaaccaagtgggacatcgtcttcaccatctttcttctttgatgtgccttggtctccgtctgagggcttacgtgcgttcttgacgtattgctctacaaactgtttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagaagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtggcgaatgcctttagtaaaggcggcaatgatgacgtcatcggtgatgtcggagatcttgttgcgttgctcagagaagcgtcgaatgtaatctcgaagagattctccagacttctgaatgatgttgtagagatcgaagtgtgtaccaggccgttcaaaagtgccttggaagttggcgatgaagtggtcgcgtagctctgcccatgatccgatcgtgccgcggggtagcccgtgaagccatgaccgggcagaatccgctagggccacaggtagataattcgccatggctttgctgtctcctcctgctacgcggattgcgagaccatagacggtgagccaagactcagggttggtggtgccgtcatatttctcgattccggtcgacttaaagccagctggccaatccactcgacgcagatcgcttgtgaaggcagcaactccgtccacatcgtcgtcgtagcgatccggtgaatgatggcctcttgctgcgcggtgctggttgatggtgtcacgaagatcgatggggcgccttcgatgtggggagtgtggtcgttcaactcgacgctccctgtatcgttcgggaggcgaacgaacagaccgttcatcatgtcccctgctcctgcgactagatctggcgccgtcaatgctgaggcttggctggtgatagtcctgagatcgaaggtgagggactcggctaccagtcggggtgcgggcgcttgcggagttggctggaaacgaagcaacgatcatggtcttcgtttgattcaagatgtttacaacatgatcagcttgattgagtacgtcttccttgaggagggtgtcgaggagagtgattgctgcaaccgcgttctgctgggggtgcgaaaaaccgctgttccatcgacgtcttgttgcccaatgagctctctcgctcgtcgcccaaattccaaggcgcgctgccgtcgatcttcaccctcctttgcaatccgttcgcgatcttgttgctcacgctgtagtcgttctcgctcctgttgctgtcgctcttcctccagttggcgacgttcagtttcttgccatgcgcgctcttggtccacttctcgggctcggcgttgttcctccgtttcgttgtcagccacgaatacgccgaagaagagaggcgtgtagttatcctcatagctgtcgtcgaagttgtcgaagtcgtcgtggtcgtagtggtagccgaagtcgtcgtagtcgaggatctcggttggtcgagaactgacaccgggggagctaaggtagccatccaactcttccgtcgagactgtcccaaggggttggagtataacgccaacctccctggatctagatcggatcggggccgaagccggagctcgcctagatcttcgagcaggagatgtcttggctgtgaagacagcggccaaatcatcaggaagttttatcaggattgagggataggacccgtcatcttgatctggtcgcggaggagtagattagatctcgtccgagtggtttgaagccgactcgggagagatgatcttggagtaggcctcggccgagttcggaataccgaacggcgcggggacctgatctctccccgactagttcgaatccgagttaggagagagatcttgccgaagtcgttggtgatgaagttgaggctgccgaaccggaacgcctgtccgggagggaaggcgaagtcgtcgatgccagaaacggaacccatcgcacttagccggtaaaaacttgacgctacccctacctggcgcgccaactgtcgaaacaagatttcggcaatactaaaagggggtggctatcaagctaggaaagtggatgggtttggagacgaagaattttatacaggttcaggccttcttattcaagaagtaataccctactcctgtccggggatgattccgccgagtgtattattgattgtataatctaggtcaaaaaaccgtgccccgataagcatccggacccctccttatataggggaaggggtccgctttacaaaatacagtccatatcctaaaagaacatggaattacagataaaatataatcgtaaccgactaggatctcgggtatttccttgacatacaagtttagaatctaacccgagtcctcatgaagatattctgtctttattcggtatcctgtacccagctagaatatgaccgccatgtagatatagggtatccataatctccacatgtttatttaggagacatgagaattttggtgggatggggatggggatgtggaattgaggaaggaactccctccttttcaatacctgggtaggggcaggtgattgggagggaattcctcctttactttgtctatgcaaatctcaactatccatttttattaatgacataatctccaactaaactccctatcagtttccatcactccaaccaaacaagatactgggattaaaaatcaaattcccatcttaatctcatcataaattcccttgtgtaaactctcaatccccttccctcgagttaccaaacaagccgataagacttagaattattttatattttgatttttcaaagtaaatgggtcataccttgtagttttcatgtatatatctgaaatttaaatgatttaccggaacccaaatacacattcaatactcatcgattgcattatatacacttacaccttcatcggttggcttatgttgttgcgtttcagcataagcagactgatgtttatcggtataagcgtttccatcgtttggcttataaagagtaatggctgattagtggatcttctgtggcatggtgatcgttgagaggtagggttcgagagaggggagtggggaatcgaggttggtctcctagcgatgtggccgtagaaaggtgtcgggaaggattggtcccactaccaatggctgatgcataatcagcccaataagctaaccgatggacttttgctgaaaatctgcctctgcaacattgaaccgatgagagtgttctttgatctttgttacattacatgtagttttggtcatggtgataaaagtaatatatctaactcttttggatggatagaatatattactaaattttcatgcgtgtgtgctataattgggatcaaaatgcttataaacgaccagaaacaatattgtttctatgaaaaattagaggatataaattctatgtatatagctaggattcaaatctggcgataatggtaccacttttacagaaaccaatctgaaaattccgtcaccattttcatctcctaggttgctagccagctgcttatggttgatggaccagatgtatagttactgagctctaaattggctatagtattgtattatcctttttaatggtaaatagtctgaaggctgagattttcttttggctgtggtttataggccataatatgtgaccaaagcaatgaaaaataattctacaataggatttttatgcttatactttcagcggtttaaaagtcagggatgaaaagtgaaaaacgatgggaaaaacatcaagagtaatataaaatcgactttgaaaattcaaattagactatgattctcatgtatccatatgcacatttgtggtacccgaattcgaatttcgctgctctaataatggaagattggttcaggatttgatgggtttataagtcatttctattaaaaaaaaacaaggtcgcaagatacggtcttaatatgttggaccttagcaatttaaattcgtactattcgtgaaggtttctttaaataatgtccaaatttggtagaaatttattcaaaaattaatcttgtgaaattttcccttaaatacccaatcgagtctccctctccaaacgacttaaacttgcttcacacactttttcccaattttatatatcatcttaaccttgctgccatattctttactggttaacggataaatggatgaataggcatgttctccgaactaattaacagtacgatttaaagaatgctttctatatataaatgtattgcaaaactgttttaaagtccaattttcaacataattcatacactgatagagaaaccatctttggtcggtcgaccccaatccacaatagtcccggttccattaaaaaccgggacaaaatgatttttagtcccggttaataagaggaagatctttagtcccggttgttgttaccaaccgggactaaaaatcatctttagtcccggttggtttatttttagtcccggttgattccatgtcaggccgtgtcagggccctatgatctttagtcccggttagtaacaccaattagtcccggttggtgttagtttttagtcccggttggtgttactaaccgggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtgcaggcggccggcgcggaggcggttactcgggggccggtctgaaggtggcctgcgcagtggccggccagccggcgaggggggccgcgcgccgacggcggtgggcgtccggcgcgggacggcgggccgggaccgcgggaggcgcggctgtggtggcagaccgctcggcggcgaccggcgcggcgtcggccggccggagcggaggggaggaggggaggcggcagtggctgccggccagatttttttttcttctttttttttgagatgtgaacagtgatgtatttttgtgtgagatgtgaatctgtgatgaattttttagaaccctgtgatgtaatttttttaagagtttgtgatgtatttggagatgatttgtttgaggatttggagatgttctgtaatatgtgatgatttggatatgggaggggatggtgtgaaatcaatattcaatattaaaagcagaaaaaaaaagaaaaaatgttaccaaccgggactaaagattaatttttagtcccggttatttgaaccgggactaaagatagcgatctttagtcccggattcgtagtcccagttggaaaaccgggactacagggggttacgaaccgggactaaaaaacatttctccaccagtgataatagttcactcatttatttggccatcattattacaaatcattctgagattcagccatccagcacaaaagaacaacatgaagatatatgcgccaataagcggcaagcatatattgatatataatggttaatttttttttgatttgatagccagccatcaccaatagcaatgctgcgttgaatgtactcccttgctcacagtccaacaacagcgtcacacatacgtacgtacacgaatgcgtgtgcgcaaatacccttttacaatgtcattcaaatatatataaaaccgtgcctagaccttgagcttcacaacccctgcatgcgtccctgcgtacacacggaatctgattaaaatttactactccctttttgaaatcctcttttcaaataaggattccaactactcgatctaggagcttgctcctccccatggcagcaactctctactaccctctaggacaaacacatcacaatgcacaaaaaacaaaactcagagagagagagagaaggtgatacggagtaataaactgaaagtactgaaaatctgaaatacattccgggtgtgttggcatgtgtgtgtgcacacggttgtttgttttgttttattttgttttgtttgagtccttgcttgtttgtttttaccaatgcttatgaatccattttttttgtttctgtttgcatgcttctcttgaggggtgcaagggcatgtgatgtgtgcccacaatgcaagtttgaactcatcagagagaagggaaaagttaattggatagtgttgctttgatttggggttaattaaactattgagatggtacagagatggataggggtagagatatggcatagtccctagagagaattctctatctaacaagtggcactagctagcttagctttatccaggttatatacagtacatactagaagaatcatctttaattactccctcccggttgataatacttatcgttttggataagggcacggtcttcaaaacgtagctttgacaactattttctattataatatatatagaaatatcaagaaatatatgattttattgaagtacttttcaagactaatctacacatatggttttcatatttttaagataaatattttagaaattatttatagtcaaagattttaaagtttgactttacccttgtttaaaacaactaatattatcatcccgaagggagtagaatattaatatgcgttagtattatgcatcatgcccatgtttaaggaggtaaaaggaatgaaagacactagcatttcatttgaagagaaccttttgtttttttcctcttcaaatacagctccattattaactattcagcttatcaaattgcaaccaaaatttaaattctaaatgttaattttagagttgattgtcatatactttttttgttgcattttattttttacgtcgataagaatatattggggatgttctgagatgttggatgcaacagtggtaatgcgtaatgcgtaaaacttagctatgcaatagaagtaacgatctatagtaattacattatgattgagttgaaataagaaactatagagagtaaattcacgagcaaaatgtagagaagatttttaagtaaatacatttatgaaagtaaattcaataaagtctaaaagtaatttacatcaatcataaaactaacttagcacaaaataaaagtaaattgttacaatattagaagtaaactcattgtagggagaaaaatatggtctatctaaaaattaaattgaaagcccacaaattatagaattgatgactaaaaacaataaatattttatataataatttaatcaaatctaagagtaatttatatatatataacaaaagtaacttacatatataataaaagtaatttacaaacataaatattttttcatcgtaatataatcatgtaagatcttgttgtaaagattttaattgcaacgaacacaatggtgtaatcagattgtagatcggataagtaatttgagagaaaattttataagaaggaaaaaaatacatgcatgtctatatagatgtgtagtatttctctgatgtatgtggtgtctcccgttaagactaaatagataggcctctcagtttagattttacgtttcttttttgttcacaaaaagaatagagctttatttctttttttagaccatggcttggagatgtgtcctgccaagcaccgtaaaatcggcacaaagaattcctagtatagtactactaccaactaccctctccattctataaaaaataaatctaatacatgatatgaatcttattattacgaatctggacagcgactatccaaatatatatgtatctgatcaattattcatatgctaaaagatatttgagatgttctacgagagatgaattgaggagacatgagagacaatttgcttcgtacagttgtccaaagataaaaacaatattaagacgatacgtacgataacgtagcttcatgagataaaagagaactaattaatcatattaactatatttaacaaggggatatataaatacaaacaatatgcatatatattgcagtagcattaatttctgcataaagcactgccacacatgcatgtatatatactaataaaatggaaaatcatccgccctctcgttttcattttccctttctgatcccggcacttagcttagccacacaaagcaagcagaaatcctagctcattaattcgtccaatcacaatcaaattaactatgtaggcagcaacaacatgccaacatgaatgcaacgagaaacacacacatagggactggagagatctctagtgatacatacacgcacatagaaaatgacggtgaagctaagctagtgatcacagccaatcaaaccaaccaaccaatcgatctatcgaattcgaagtcaattacaagcagcccagggcatagtttggtcaaaggacggcagttcataacgcatcaggagtcaatttattagtatccatcatccatggccatgcaaaaatattgcatatcgatcgatcacacacagttgcagactattcgttggcactgacagctcagtctactctcgtagtctgaccaatgacatgtatcaatcgatcatgaggtgtttagatgaggggtgtaaattttggacgtatcacatcaggaattatatagggtatgacatgaggtgctcagacactaataaaatattacctccgtctcaaaatataacaatttttggctacgaatctggacacacagttgtctaaattcataactaaaaacgcttatattttgggacggagggagtaactaattatagaatccgttagtaaactgcgagacgaatttattaagcctaattaatccgtcattagcaaatatttaccgtagcaccatattatcaaatcatggagcaattaggcttaaaaaaatttgtctcgtaaattagttgcaatctgtgcacttagttattttttaagcctatatttaacactttatatagatgcttaaacgttcgatgtgatcaggtgtaaaattttgggatgggacctaaacatccccgaatgcaacgtgcttttactggatggacgacggatccaccggctgctagaagagtaggacgacgtagatttgttttgttaattattctaactttggtcgccgtcgtcttcttcttcctcctcggtccatggcatgtgcttggactacgtttcaaattaagcttgcaagttgcaactccatctatctctctctagatttctctgtgcctctttttgagagtctatcggtgggtctaacaagtcaaagaaaaaccaaaatttaaatatttaaagttaattttaagatatttttcaacataatttctttttaattagcgttggcttttaactcgctacgaacaaatatataaaatttttacctataaattataaattaatttttgtttcctaataagccagcaaccgatgaggctctgaaagtctccaggttggttgcaattgtacagggttcaacatggatgatatatgataatagtattagttacctaaaattgaccactgttatggagttatcgacttatcgttgtgtgtgttggtctcttgcaatcagcagcagttctttaattttttcttgatgcctgctgatatctctagaacaacaatagccgtaacactgacttgttcgactatttttcctgatacctcggcattgaattaggagttgttcaaacaaaattagttgaagttaagagcagatttcacaaaattgcactttgatataaactatggtaaagtcgattcaagcatatagtattacaagactctcgctttattgacaaatctatcacaaaaggttttgtatcaatatttatgccgtatttttccccctagtttttaaatattacaccttaaatccatactaccaccgttttttatatataacgccattgattttttacatcatgtctgaccattcgtcttattagaaaaattaagtaaatatattttcttttgtcgtcacttgatttatcactaaagaaactttaaacactacttataatttttaagatttgtataaaatttttaaacatgacgaatagttataaattgttgcaaaagtcaacgttgtcatataagtattaaaaaaatgaagggagtagtatatttctgtctctagatcaatcctaaacataatggtcaataaaaatgctcacttacggagcaaaagcaacgatattgtatccaatcaattgttttataaacccaaacaacgtctcgactatataaaaaagtcagtagggcagttatataaagcctcactgtttgacacgttttaagatgcattgtaccaactcctaaaatactgatattcttagagtgacattccttattaatttttgcatgccacaaaatgcaaagttgtaggcacaaaagcagtagcaaacagcctctgtggtcagacaatgtggcccatttgggctttggcctaccactacaaggccagagtttttggctggaccagccaacaacaatttgggcttttttggcccattctagcagggctatccagcgaattttttttatttttaatttttttttttaaaagttttacaaaaataattttccattttaaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccatccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgatgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaactattaggcacatcgagaacaaattcaagtacaccataagctatgcaaaggcctggagagccaaacaaaagattattgagatgaggtatggcacatttgaaacttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaatccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatcttggtatggcataatgacaaccaatttggcagaggtgtacaactgggtaatgcgaggagttcggatacttccattggttgctattgttgaattcatccttcacggcacgcaagcgtactttagtgatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatattgatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggactaattactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcatatttcaactcaactttgctttgtgttgtacttatgtttgaagtttgctctatacaggttgcgtgcggcaggccttctaccactttgtaggcttgttgaggcggcggcggacaaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtgctctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctaatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattccagcgtcgttacgctcacgtccaggtgagacgaggttacccggacttcgtgttcgagtttgaccgtctccagccgagcgacgtcatttgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccatgtcgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggcgatcaacgagctcttcccacacacggaggagaactaccgtgactaccttcgctggtaccttcctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgctgcacgggatatcagtgccgatatcaccgcagtccaagtgaggttgaacagaggtttgcacttgactgacgttgagcagaggatgaccttcgaccggatgcaggagaagatgcgtgcggtcatgcgcatcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacaaaaacatcaccccgtcgtaacttgatgttccattctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacaacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcgttcatatggtgctagaacaacttatgctcatgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgatagtggggatagatgcatactcaagtcttccctcatgatacaaactcggggcaggagattcttccaatgcgcgaactttgatcaggtatgcttcatctattcgaagttcaaatggataaaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccatgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacattttgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggtgccgataggttaccgcatgcttgatttgtcgagatcgacaaatttgtaccgtgtatcgatggcacttcttatctattttatcattacaatgtttaattatggtggtgattttttgtatgcgtaagactaagggcctatttggattgctaccaaaaacatgccctaccttaccaaattttgaatagtacttgtttttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaattatttttgtaaaacttttaataaaaaaattaaaaataaaaaaaattcactatcaagctgtgtatacatctgatgagtcctgttactttctcaaatgactcgcaactgagacaaattctgtaagttcatatatattacatctcatgtttctcaaggaaattaacacagtggtcaatcatctggaacttcagctttcatgaaaatacaccatcatcgtcatccagccactgcttaccgctgtatgtcatctcccggtcctagatcgtcgatcgctgggcgttgtttgtggtggtcagtcacagactggtacgccattgccagagctagagcctgctccccaatgcacggatcaaaatgacaggtcatcaactcatcatcactgttcttcatgtcaacacataaaatgtttatgtcctgagacgagaaagaacttacaacgtggtcatggtcaggaggagcgtatatgcccgtcgtcacggtggttcttctccgcgtgccgccttctggtgggttcttgatgctcttcaagcctgtcggcaccacagccaccggcatccccacaaggtttccaagacagacgagctcccagtcggtcacattgccgatgaatgcatcgaccgtgaagctctccctgacttctctgatcagtttaccccgtgctcgttgtgcctgttcatcgatcaaagaacaagaatataagttatggtgactcgcgatcctatagacaggtacactccttcagatatggttagtagagcacctgtatatagtcgactgcggggattaaccgtgcgcggcgaagctccactggccattggtcctgagcttcatagtcgtcgtcgtgtcgctcgcgttgccagttgtcgaaatgcgcaagcatgtcaacatccatggtgatgttcagtatggattggaccgattgaacggtgtagttcagcttgaaaggcactagcttaacacccttagcggaaagaacatgaacaacctgtagcaatgatcaaatcgaaggatcagatcaggaatgggtaacagataaccaggctgatgcacgtaaaaaagctctcaattacctccatctcagcactgtcaagatatccaacagtgagttgtctgatgtcaacatgaaagggatcctcgatagcaacttcacgagatgatggatcgccggcatccttgccgcgaattgcgtcaagtacaactgcgcaatctatcgcgcttctgcagaaaggaccaagtttatcctgccatttagaccaagatactaattgtttaaaagattgatttggatatgactgggaaagcgtaagacttttgaatggaaataccaagctctctgaaatgctcatgacgcccgtccgtgcaactgttccaaatgttgtgcgcaaagcagttactccacatctagcggcaggatatgttatggaacctgcagtttctgaacctattgcaaaaggaaccattcctagtgcaatgaaaaaacttcgctgagtacttgaccatatatacttcatctccttacacatgtaaacatgttgtataaattaacctgcagaggtgctagctgctggccctgctgatgaaccagtagaaaactcctcaatgttccaggggtttcttgttctccccccaaaccatatatcatcataggcgagcgagcctgttacaagttttgctacaaggactgccccagttgacttcaatctgaaggaggacggcatacacataaggagacgtaattagaattgatcacatgactcacacataactgagaagaaacaaaccttttgtagacagaggcttcgacatcaagaatttggttttcaaaagttcttgagccccaggtagttttgtattctggtactgcaattatatccttaaggccatacggaatgccatgtaagggacctaatatcaatatttgtcaatgcaatctttacttttgagcataatgttttatatgtaacacattttcttctagtacgactcacctaaagagtaccctactaatggtataactgagagattttttaaaggcaaacaaaggagagaactccccctttgtaacacacacatggattcaactaaaaaaataccagttgtttaacatttcgttccacaggttctcaggctaataaaagtgattgcatcgcaaaatatgaagcttcaatggtgcataataataaaaaaatgtagggtaatttccacgagcatcaattatgacaggaagctgctatggccataatatattaccaacaaaaggagagaaacaagatcaagactagattgtattgcagtaacagatatatcactgagcatttcaagaagatttactgcataccaagatattttccttgctccagcaagtcatcagcttctttcgcttgtttgtatgctaaatcatcagtgatagtaataacggattcgattataggaccatacctataaacatacaaggagttacatgattaaaaacaatacttctgagcctctcataagtccatctgaaagactgaaacaaatgaggaagacagaaaaaggggtctaacctctttaatctccttaagaacacagcagtaagttcacgcgatgtgacttgctttgtccttataagctccccgagctcaattatctgatatgaagatcagaagtttgaaataaatatatatgaagtttgtaaccaatgtataataacaattgttaaaaaataaactgaccgacataaaagcaatatcttcatctttactagggcgatgtactgaagatgtatggggatattgaaagcttttgttctcactgattttgctttcatcgctccatgatgatttaaagaccaatgcagacgggttatgcaatccaccattctctaacgccaccaatttccggttgtctctaaatgcaggtacattaaattcttttgcaccatcttccatctcccgaagctaacagaacagatagaagtgtagataaaaaagatattaatgcaactacttggttgtgaaaacttcaaataacattttgatagtacttttgaatcgttgaaaaaatcagcatcgaagtacttcatggaagccttcaatgcaatcacaccagtaattggttcttttctggaaacatcttttgcagaaacagcctcctttgtatcctgaaaatgaacagacaaattgctaaaaaaaaaattgtcgcaatgaaaataaactgaatattaaaaggagagcaatcttgccttccagatcttgtggtatttggaaacaagagtatatgaatggctcttcccacaggttggccagggtaaccatgtgcattttgttggccacgcctgtgtttaaaacaaaagcaaataaataaccatagtaataatttgcaacctaataatctatacaattgacatttggcaaagtgaatcccttaagaactaagtaacaggaaaagatgcagagttaagaaaaaaaatcaggagttcatatgaatatgaataactagttctgggcttctggccaaaggccattcctgaacacctctatgccattagtcaaacaatagtctcgaaagatcacacacctagtcagaaattccagcacacaagtgaaattaaataattaatctacttggtaggtaaagccacctatcttagtcagattatcactgtcctcacagcccaccgttttctttgaccgacaggatcatagaggtaaacccaaaactaggacagccaaaagttcagagaagaacactgaataccgatcctcaggtggtggggatgcaaagctagctagaggaatccaagaagagggggaggcgatacggtatacgagcgcgtaccatgtcggcgatgctcctcgcgacgccgccgccgccggttcttggcggtgctcctgctcctgctcccggtgcggcggcagaggaggagaggagagagacgaggaggaggtgggggagggggagggggaggagagggcgacgtggctcccgcatggctgacacctggcgggaaggcggggagggagacaacgagggatttggttgcaggaggagaagagcagagtggagaagacgaaagggtttcatgacttcatgcttggttgatgattgtacatttgtactactactactactccacgagtctctcgctttctccttgtttgtttattttgttggagatttggggtttgattttgtcgcatcttatattgcgtgggtgacagtttgtttatgattcactaagaggcataatcctattgaaaaccatggtcctattgatttttttttgacctttttaatttttaattttattagtattcatttccatttttcaaaaaaaaactgagcgtcgtttagccacgccagcacagagttatttggccacgccaaaaggtttagatttgaaaatatttttttaaatgactattaataaaattaaaaaaattaaaaaaaaaattgatcatattatactttcgatatcctgtaaaacatttttttatagaaagctacaattattttttttgttaaaattatcggctattggctaggcgttttagataactacaaacaatagcatatgattttattataaaacataacttatatcgtttattacaaaagggatccatttgtcctgcacgtatgcaatgtgtcggagggataagctccaactgtcatgggaaaccacgatcttggatcgtggaggggtttaaggcattcaaacatgctcgggagtaaaggacgcgaacaagtactcctatatatgtttatatgtttggacctcctgaaagatgataccctattcctatttgataaaaatgtccatataaagttaggagctctcaagctagcaaacctagttcatgttgattattgaaaaactaaccccttctaatcagttttgattgggcttttatacccaccatctctcactattagccgagagaaatgatatactgttgtaacatattcatgtcgaaaataagtgaaatagtaaggagagagaatatgaacagacgactaaattgtcgtcggccctccaagacgagccaaagctactgcatctaatttctccctgcatgtgacttgtgattggatggtgagcttcccaagacaacatgcagcagcagcaattggattacgcatgcaagcaaaatgtgatcatattatagtagtacatcttattattgtacaaaataattttaactcaaaccgtatttgaggcggcatgttttagagttatcagctggctgtatcattgaacttgctcttagcctattttctaacctttgagcttcgagccagtttcagtcgcctatgcagcctttctatgggactccacaccgaatccacctataaaggctcattgttttcaccgtagtctcaatgacactaacttcgttatctttatggagctttctaaaatagtgtatcgctttgatcaagtaaattagtgcttaaagggcttgttcggttgcttagtacaacggctgctaggcaacccaaggcagctgatcgcaagttgttttgctgcatctacaagcagctgcttggctgctaagaagggcgaacaaaccagtatgtagttttgtacttttgttgacttaaacagcaaagtgattagtattgtgataggttttctactgtttagattattatatacttgtaataaatatgtacttggcttgcacatttttaatatcctttgttctaagaggcaatcacaaatttgccaatggtttgaatcgttattacaatactgccgctagaaaattgcaaaaatatcaccagaactgatactcaagtggcattcttacaaaattaaaaaaaccaatggcaaatttgtaaaatgccctttttttctaaaaatagaagcaaactaaaaatttttaaaacccacaatagaagcaaaataaaaaaattaaaacccacatggaatccacatgacactgaaacaatatattccaccttgtttatctatctctcccatcatttggtcttggtagcggtggttgtggtggaggtgcgcgggtagttaggaggtgaggagacactaactagtgtgcgatgtgcccggctggcggcagaggaggcccagtagtcggcggagacgcgcctacaatccaggagtcgatgtcacccgctcttcccaccatcgtgagggcttgctcatagtgccgcttcttgcaccagcaagcagtagaagacaccacggggagcggtgtagactggcagaagtagtggttgtgccggttgcgaagcggcgcatagatttggaggctaggtggagtatggcaggagcggaggaggcccgcggtaccaaggcaatgccatgctccctagacctccctgctttcatcgagcccgcgcttcccctcatcgcattgctgacgacaatgactcctagcttccatctctctcctttctccccctatctttccctctctgttctctcctatcttcttggtgttgaggcctgaggcactcacgatggtgtgatgacaacctatgaggattggactagcagcgaccgacctgagcttccacatctccaccaccggtcaggctcgatggtgtagccgccaccgccacccaactcctcttcgttggtcgcctcccttctcctcatcagtcgcgtggcttggaggtttggacagagatgggaggagatagggggagagagggaagaagacttgtttcactgatatgtgggatctacatacctttttactttatgtttttattttttcctctggtgctttgggactatatttgtatcggttttaaaagatgaaaggatgcgttatatatatggtattgcggtttaaactcgactttaagataaggaacctaaagtgaacttattcaaagaaaagggaaaacataccgtaacattggggggcgcctagctggcgcgtatgcgccgctagcgcgcaccttccccatctaaccacctatactagtattagttaacattacttaacactaataacaataattaggaaagattttaaagatttttttggagatatttttactaacagattgaaaatttttcaagttagaaactttcgatttaagatttaaattttaaagttaaattttgaagacattcaactcagatttgaaaacattcaactcagatttaaaaacattcaactcagattcgaaaactttcaagtccagatttaaaagttttgaaaactttcaactcagattcgaaaacttttaactcgagattcgaaaacattcaagtccaaattttaaaattttgaaactttcaacttgagatttgaaaattttaaagttaagatttaaaaattacaaaaataggaaactaatataaactaattacgattttttttattcgtacggcaaggaaaaacaaacggtgaaaaaaaaatgaaaaaagaagaaacgcgggcgtaaaaaaaaagaaaaaaaaagagagaagcgcaagcgcacgtgcatgggacttgtgggccggcgtgcgcgccggaaacgctcacacgcgaattagcctttccggtaacattgcagcctatgacaaatcgttcatgggccgattcatcgtaggcccaactgacccattccagtccgggcccacctccactccccgagggataaacaccacgtgttcacactcgccccaccccccgagggacagcctggcacaactccccaccgtccgatccagatccgaccgctcacatcgccccagccacgtcacctccacctccacctccacctccacgcggccacgtgtcccccgcctccccaaactttttgggaagatggcatttgcgagagaagatggcaaatagtaaaaaatccccgcttctcctcctcccatctcgccgcacgccgccgccaataaaacgacgcgacgcggcgcggcgcggcgcgacccgatgcgacgcgacgcggcgaggagagggagacgagctgagcagcggcgacatggcgagggggagcaggaggaaggggtgggcgcgcggggcggtggcgttcgcggcggtggcggcggcggtggcggtggggaggcggtacgggtgggacggggaggcggcggtggcggcgttccgggggcggagggacgcgctgggcccctgggcggcgcccgcgtacgtcgcggcgcacgcgctcacgctggcgctgtgcccgccctacgccatcctgttcgagggcgccgcggcgctcctcttcggcttcctcccgggtgtcgcctgcgtcttctccgccaaggtgctcggcgcctcgctctccttctggatcgggaggtacgggacgagttcctcctcctcctctttcttcgcttccgtttcggttgctcgtagcgctcgtggtggatgttgagcagggatttgtagacgtcgagatctagacataccgtgttcagttcgtgcgtgccctgatttgattcctgtttcgcacgatcgagaagatctgacaagaattgtgatgagagtcgtatgatcggagatgggttggaggaaaaaaaataggctggcatttgtgctttctcgtgtccttcgaggaggaacgttgcgagattctttgcttgtctgtgtagaattgttggaatttttttgctttatatggaatctggttatgatgttagagaaatactgcggccgaaggaagactgatttgtttgcacttttttttggggtgaaaggtggttggtaggttcaagaactgaaaattgcaaataaaattggaaactctcatccttagtctgttaaactgtataagaatatataaattcaggagctgctgggatgaaaagctaatcagctatgcaatcttgtgtgtacaagcgtacttttgtacactggtgatagttaatggagtagtaatgctaagtgaacttgaacatgagattcaggaggacaatttaatggttttgggaacagaaaccaagagtacgctgtaacttagcatatggcccattgattgattctggttgaaatttcctgtttggaacaaaggagttccattgaaatgctaggggatatggcctgttctgttcccaggatacattgtcatttatctttgatatcatacgatatctttgatatcatatgtttagttgcaccttgtttataactacagaacaatactaggttgatactttaatctttgatatcatacatctttggtaagattaaataagaaaatggatcctttgtgatataaacatgtgattgtcacacgtaactttaattagaataaacctttgtggtgaggaggcctctaatttggcagcccaacatctgagagctctcccgatcaacatacttttagcgatgatgctggttacatactgtcacaattatattgttgccatgctatgtataaatgatggatcaatgcttattgtttataatactaactttttagtcatattgcacttgattggtttgtataattgaattttttcataatcaaattctgaatcattgcgctccaatattgcttacatcattccttcaaacaatccaataaacaattacttagaaaacggctccaattgaacatgttaattctgagtaagttaataaactaaccaaacctgaaagttatcttaaccatagatagtagaggtcaggttggttgttgagcagcctgaagagctacaacttcacggaaaggaccttgagaggtataactgcagcttgcctaagaactttcaaatatatgtagtgctggcaaagttccaccttttttggtaactttgtggctgctcatagacatgagagaagcaaactatctctcactaaggcaatgaatgcgattagtatcgaagagccaccctgtcaaggagcaagtcaagcaaaaaaaacaaagggttaaaagtcccaaatgaacaagtttaagacaagaagcggaagaatttttccctgatcaactctacgcggtcatgctgaccatattaaggttgtgtttacaaaaggttacaaataattcgcagaatatgttcccttacaattccaatagcccccttcttgttctgggaaaagttcttacccttatttttcttaaccttgtggtccatctggcacttgtaagccttgttttgcttcacttgctccttggcatctatagctgctgtcatctcagtgatctcttcgatactaatcgcatccattagcttagtgagagatacctgcttctgtcaattggcatctatgagcagccacaaaatcactcaagatggtggcaactttgccaacacaacacatgtatgaatgctctccagaaggctgcagtcatactgtcaaggtcctccccatggagttgtatctcttcaagttgctccaagaccgacctgccctctactaaattatacttaagataactttcagatatggttagtttactatgttcaattgaaccattttaaagagagttgtttggatagttttagaggaatgctgatgaagcaatatttgagcatattaaattcagaatttgattacatacatgaaaaaaaatccaaattgtataaaccaaggaagtaaaagagacaagaacttctgctgccttataaacaaataagcactgatattatttatacaactagcatggcaacaatataattgtgataacacataacaagtattactacaggttatgttgattgggagggctattggtagctaggggaaatcctcgcaggttcctttagctccatgtgtttggcctttgaggccagctcggcccaatggcctaaagcagcccaaagggcctcatgtcagaaatcccgatggatcggtggatagaactttaaacaaacacaaaacacatactatagatgattcgaaaaacaaggatgaatttttctgtttacaaccagaattaaccgcctagagcgattttcacgttgtgcctaatgccacgtccatccccacaacgcatgtcgtttgtctcaatcatggtgagagatgcgggcagccatgagctagcctcgaatgccctccaccaaaactaacatgcacgacatctacacaatctacacatctacgcacgacatctcatcgagatgaatgacgtgcgccatggggatggacgcggcattaagcgtggtttgagaatcactctaggccgttatttccttgtaagaatctggctttaaatgcagcacaaaagttcttccttgttttttggatcatctacagttcgcgtgtgctgtgtttgttcgaagttttatccgtcgatccatcgggatttctgatagggagcaataccacccacatgaagtggctgtagttgtcgacggtcagaaggaagtatatgctgtttgtttattgccataacatttagcactaacatgatttttgcagcaaatccagacattctcatgttttgcgaagtacgtaaactttttcgggttcacttgttcctctgtccatggaagttgaatagcccattatggacatttttgacacttttgctttttatttggatcaataaatgaggtcaaatttcagctaataagaaataataatctctttactctagcccatcctaatcacactatgcaggaatctagacatctagatataaggcccactatatgttgataacttgatattatgatctgctttattttgcagattgatcatcaatatgtcctggatacttttttttttctggttaaacaaagaaagtaaaatcccattttacatgttttgaataagtgaacttggcaactaaaaattagtgttatagtttgctttgtgatgccatgcaagtgggttcttgcagttatgctggttccatattgaatattgatacagttaaaagtggccatgcagtcagcatcttcaattatactgatgctctttcaggcacaataacatcattacgtcaacccgtctagtgtataacgctgtaatgggatttggatgtacatcctattatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatggttttactgatcatattgggttattcaatatagtagtagatacaacatggatgaaattgctagatggatgatgttttctagtttctatctgacgatttcagtcagtttggtgtataacagtgtttgtactatgtgatgcagttgattcatttctctagctgttgtggtcctgagtatgaaagatcagcatctcaccacacaaggattaagaccaaaattttttatatattatccccctacaggtggctaaaacatagatcttatgccttatctctatctgtctgccatctcatttgttcttcacaacttgtgaaggcaattgggcgcgatgggtacaggtagtgcctacccatacccatgcccatgagattatctgtgcccgtgggtatacccattactacatgacaggtaagaatgattgctcatgcccattgcccgcgggcgccttatgcccgcgggcgtgcccgtttacccgccacaacaaaagcagctgacaaaaagtctacaagcttctaagttcgaatcgaacttaaaacatcaaatattctccgcctcggtgtcgtgtctctcctctggcggcgatagagtaaggggagagaaataataagggaaataaaagggaaattgtaaaaaacaaagaacgtggcttatgtttctagtggattttgctcctagcctacatgtaagttcgatttcgcaggtaaatgggcaaagcaggcatgggtagtgattacccatacccatgcccatttacccatcgggcatagcttttgacccaataagatactcatgggtataaaatggagaacaaacccaaccctaatggggtttttacccacgggtaaacggtcaaacgggcacaattgccatcactattcactcacaagcccaattgcagtgtccagtctgatgtcaattgtgacgtgaaaagtgcgtcaagcaacagccaagccatcctccttgcttcatcatcaccaggcaagtttggcatgctctggacaagtagccttcctttgccttttgctttactcggtggaactcaacaccatttgtttagtgtaattagtactgccttttgcttcttgaaagtgaggagcttctctttctttttccatgccttccttttcacccttgaaaactcctctctctgattaagccaggcaacttgggcacctggctagttatatactccatccatctatttcaaaatataaggcatattttatttcgttaggaccaataataactttgttatagtataattttgtgatatgaaatagaatttattatattcgtatttaaaaatatttagttatgtgcttttaataacataaataatatcccaatagagtaataattgttggttaagcctcgtcataacgagataaaatataccttacatttgtaacagaggaagtatatgccacacactgctttgtgagatggtgctgtaactgatgttgttaatcattgagggtcactgtgctatattgctgatttgctgccacacatgaatgtgtggataacttgttaggtgatcaattgtcttgggagatagaagataacatcaattttgagtccctcatgttcttgtcaagcgatttatttttaatttctgtttgatcagttacagtaaaagtgggtcttgtgtggaaggtggtcacctggagaaacttgtggacttcatgtctctgcttttcattttagtagatgacttggttcctccatctttttcagggatgaattcttcatcattgacatcttggggtgcaaattttggaggattttgaaacgtcggttttgcttccaggacatatttcctcgctgatagtgattttccatgattaatggcttttcttgttttcacaagcaaaaaattgaggaagattgaaatgaagaccgtagtattaaataatatatattgatcaagaattaaacaacagaagaccagattattgaagagcttactaattaaatgatggatgagaaacatttctaggcttgaccaactctccaaagatcaaccaaaggtgtgcaattttttttctcttaagtagtaagaatggaaagcacattaaaacataaaatattgaacctaagtgttatttttaataaaaatattttaaataaaaaaatatgattgatgttcaggaactagcagtctccaagttgatcctgcaaacaggaatttgtcagtttatatgtggttctgtcgtaattgctatagaatcatcaacatcgttattaatgtaaatacagtcagagtacgctacttcgcattgcaataatttatttattaaaaatacgcaagatttggattagtcaagtacttggttttcccacaaagtcaagctgaaacttctttatcatgagatttagatggcaaaaggagtatgatactacataatcttgaccaagataactgtatatgaaaaatatgtttcattatctgatctcggtaataaacaactaaaaaattgacatcaagtttggattatccggcacacttggcagaatttgagacaattttttcttgggagaatttgagacaagttcataaccggatcaggatcagatagaatagttgttgaaatagttaaatggaactaaagttaaaaaaaaaagctcagatttttattgttcaacagtgcatttacagccatgaattgcaaaaagtattattttgcgtaatcccctctttatcatgcacttcacagaatacaatggaataaaattgaaggaacagaaagaacagatattccaaaaagtaaaaaccaaagacaactactctagttgctatgtgggccaggagggtaccatcatgctcatcatcttctagaaccctaatatgttggcagtgctcattggttgtggacataggacatgaggttgttcttgtttgttggtcaccaccatgtgcagtgctccaatatcaggtgtgttcttcaggtccgcaattcagtaccagccacaaaaagtgcaatttctttcttgcaatgggcatgatttttcttgttcttggccaaacatttgtgatatttttgacctgattaggcctccatgaaactctctacatgttactagatacaaactgattttatcaaattggctactctaagtattacaaagtattatctgggagaagatctgtacaaaggggggcattggattattcttccagagcaaaaaaccgatgaaattatctggccaagcctggccacaatcaagcaatacctactttgatctaatccctctacatttccaatatgtatgtcatcatacttgtcatatgtatagaactttgtatgtactaaacatggccgtgcgaaaactttggttttgattccagataactagaaattctccttgtggaagtcgaatttcgtgctcgtctttctcgagaaatcttgagcgagctcacgcagttccttcgtcagcaccggcgcgccacagtagaacacccctgtaatgtcaaagaagaatcaaatttagtgtaaaaattcagaattccaatagtgcatgaagacatgataggattggattgagatgatagcatcatgcctgataatgatacagttaggtaagggagcacttcttgaaaacatggcacaggcatatcttgggaatctttttgtgcatatgaactgaactttatgggtgaagaattttaggatacctgactatgtattgtttaatgtatagctcgagcctaaagggactgtatgccaagcggttgtaactatcatcaagtaacaatgattggtcaatccataaattatatagtactaatatgattcctattcaacctaacaaacttctccccaatccacaaactaagtgcataaataaacaaatctcaaaagtctgatgttgctaatgctatgcatgtattgcttgtcaaaagcttcgacgaagaagtatttagtattcctttacttattagctgaaactaccaggaagcactaacttctattttttttagagaaaaaatgttactcaacattcattgcaatctaattatcagtgacaactaacagtgattgatctgtccccattccctaatctcaccagcaggttcctgttcaaccttgataactgctgcacccagtccatcactacttccaattgaacactcaacctcaaaactctgatcatgcttgtccccatcagctagatccccagaagcaacttatgccaaccccaatgcagctcaaaaccagctcagcctactatatcaagaagtctaatttcccaaagcatgtagtatagatttaaaatttcccctactcgctcgaaaaaaaaattatcggttggggattaaaaaataaaaatatcccgacccgacttttcacagtcttcaatatgcaaatttgatttaaaacttgtaaagtctctaacccggcattttacggttttcaagatgcaattttaattgaaacccaattttttacggttttcgagatgcgactctgatcgaaacttaacggaatgttgggagaactagacaacaacaacaacaacgatgatgatgatgacgacgacgatgatggtggtggtggtggagcttaccgacgcgttggtcgcggtggttgagggcgatgcgcttgtagacgttgcgccagttggggcgggcgaagtgggtcttgacgcgggtgccggagacgacgtcgacgccgtgcttggcgtggttgagcgactggagcatagcgatgagcgccgaccgggcgtccccttcctcgtacacgctggtgcagtagttgtgcagctcgatcacccccttcttgtccgtctccgccacctcgtccatcaccccccggaaccactcgaacgacccctgctcccgcgtcacccagtagaagtaggcgcgccgcgtcttgaacgccgccgacgacgacgacaccgagttatcgttgccgtcgccgtcctcgaggtcgccgtccagctgcctcatgttgtttatgatgtccttgatgatggagatcatcggggtggcgccgatcccgaggccgacgaggaggacgatgtcgtactgcttgtagtcctgcgccggtgcgccgtacggcccgtcgataagcaccttggggaagctgcagtaggaaaaaaaattgattttcttaaaattttattaattaagctaaattattaccatattatgatattatctttgattaattttgataaggaaattgaaatggtacggttttgtagacggatacttcactgttgttcagctagaaaaaaaatgggaatctttagtcctacattttacatttctaggatggagatagaacatgagcagagaatatgtgtttgttctctagtcaccaaaaagatttcattgtttttccctacaagacaagaaatattccattcttgttctacaaagagaaaaacaaaatcaatggaatatatggcttggcaaaaacatccccccttcaccttatcctcaactaagggccgtcttccacaacacagaaaaaactctatttatcttctcttccacactcatatcatcattattcagttagttgcaacctacttaacttactagtactaccaccatctcaccaaattaattaccattacaccgactaattaaattatcaccaccctatctacaaatgtcaaagatcatgctctgcagaacagcaaaggtcaacccctactacacaagaactacatatacacacacatgatgaggataacaaacacaagtgtcaccaacagaagggacacaataattaaacaagccatgtgaaagcatgctttgtactactactattactactacattttgctcatgcctgatgcaagagatgatctcattctcacacccagtgcaagcttaggtcagagatcatgcataccatgcatatatacatacacgcacaaaaaaaactatttagacagatattccattgaaaggaacaattattttaggtcagagatggtggctaccaactcatatcacactagcactttacactaatccccatcatgtgtgaatcaaaaacctagtagtggtaattatgtttacacggccactaacacttactaccaaccaccaacctaccctgagccacacaagtgtaaatgtgtgaccaagctgacccgatcgctcggtcgcaaccctgaccggcgacccggtccggtccgacccacctcacctcacctcaccggctgaatcactttccacacgctcgttgtaaggctggaccccatcatgttggaccatgccgactagtttctctttttttttttggtctcttttatgtggttttttgaaaaaaagggggaaaatgtggttgacatttgagggaaatgcggggaattttcgtagcggggaagaagaagaaggggggattgttttgcgttcggggttgtgttctcaccttgggttggtcatggcgccgtcgcggtcgtactccgcccggagcaacccgctcttcccttccgtcggtggccggcagacctgaaaaacataatattgtcatgattaattcttttttactttgcaaaaaaatgtacaagtcatttgttaagctaaaatattagtgatagtaaccgtgacagcgatgataataataatgatgatgaggaggagatttgtaggggcttaaggttggataagattgtgagatttgtgacaaatagatggtgagatgggactagcggagtacccttgagaagacgttcttaagctcccgtgtccagtcaccgagcgtcctgatgtggacgctgacgtagtcgtcctgtggggccgacgtgatggagaatgggtgcctgcaggtggggtcacatggtcagcatcacatccttatcacagattatatatatatacacatatatccagcttatctcctctgctttggcttagccgtcctaataattatataaaagatgatgctcaaagcattcccacttaaggaactttaattgcttaatcaaatcaactagacccacaggtgatttaattaattattagtccaaaaggcatccttatgcactatcctacttccattatatatatatatatatattctgataatccgatcggacggctcaaatcgatcggtgtgcttaccattggaacggcgagacggcggcacagttgacgaagatgtactgcccactcttgtacttgaaaccctgtggcttggagaagtgcagcgacagcacatttccggggtacaccgcaaccttgagtatcttcactggcctcacgctcgaccggagcgccctcgtcagcctctcgcacgcgtacaggaacatcggcaccgccaggtacatccacgtctgcgtccacgtcacccaccatcagcaccgccacgtaggatagagagacgagggcatgtacaatggactaatagataaaggtttagtggtacgtaccgttttcttgtaccaatccttggtaaggaagaggtagtagccgtggacgatgaggagggcgtagacgatgacgaagcagtggtgggagtaccagaaggcgttgaaccccgtgaggcggttgagcgggcgggggaggcggaggcggccgcggcggaaccacggcgtggcgagggtgaacgccaccgccatgagcaccagcatcaccagccccgtccacccctccgtccccttcacgaaccaccagtagttgggcggccgcgtgtcgccgaagaacctcttcatcggctcgtactcggcgtcggtggcatggagcagccgtggaaaatcgcaggtaaggtgagagatgacgtgcagcccggcccccacggtgatccccacggcgatcaccttgtggaagttgaggttgtcgtcgaacggcacgacgcgggcgacggcggcgcggttgcggatccaggtgacggtgttccggcacaccgggaggaggatgagcgccatgttgaacttgagcgtctcggcgccgcccttggcgacgcagacgcagtagcccatgacgtggaacacggcgcggtgccggtactggatgaacttgtaggtgaagaggcccgcgcagatggcgagccacaggaggagcacccagacgcggcgccagttgtcctcgaggaagtaggaggcgcgccgccaccaccgccggagcgggttgggctccgccgtcggccggaggttctggctcagcatctggctcaggttccggctgttcgtcgtcccgatcctcaccgactggctcggcgcttgcagcagcagcatctccaggttgtacagctgcaaaatcataaaattattatcggccatggttgccggcgacattgacggtgacgtcgattctggaccgaaattgtttgagaatttagtgaaatttgactgaattttgaatatatgtacctcgatgtagccgaggttgctggggtcgagctcctccatgatgaggcgagcgtactcctcggactgctcctgcaccttggacagcttgttggccgacgcgctcagcgtgataatctggaaggaagaacacaatagttttaattataattctaattaattagtcaaaaaaaaggattgaatctttctacaaaagaaaacaagaacttgatccaaaaggggagggaaaagaaacacgatctttctctatcaaaatttgatccggtaacaataatcaatttaagaatgcgagtctggttggccattgcgatcgagacacgacacgaggaaaagaacttgaattagaagtcacattaaaaaaaaaagtcaagcaagaactttgctgtcctcaagagagcaggatgtgcagttgtggagaactggtcgatgatgctgatgtgcatgtgccaactaagaaattgagcttcaagctatccaagctactactatcttaactagaacaagaaacagagatcgaaactgatcgaaaaccgcttggaatttcagagaaaatcagcaaatttttctgttcttggagggacaaaaaagctgggtatgtttgaattacctctttaacctcctcttctgtgatcctgccatccgcgttcttgtccaccctggtccattaattaccaaacaagacagttgattaattcagccattgacgagttaattagtcaaaaattaactgttggtttaattggtgattaaacaaataattaatgaagtgtggttgctaaatacttacatgtcgaagaaggtttggagacggctgtcgaagctggtgtcggagatttggtcccagaattccagcagctccgccttgctgatgctgtcgccggagatgttccgccgcctcgccagcgcgtcgaacagctcgccggcgaactccagctccttcatccctgaagccagccagagagagtgattgattagttgatgagaggaagaagacgacgacgatggagaaggtgttcgagatggtaccgatgcactggccgaacttggagcgggggaggaggccgtccttggcgaggtcgtcgaagcgcttctcgacggcgggccagccggcgccgccgtcggcgcggctgatgaacttgaggcccttgagggcgtgggcggcggcggacttggagcggtcgaagcggggaccgccgccgccgccgccgcggcggttgacggaggcgaggcggcggagctcctgcgacacctgcttgatccgcgacgacgcgttccggatcaccgagtggccgaacgacgacgaccgcttctccagcgtccgcgccagcagcgtcacgtccgagtcctcgccgccgccgcccgccggcttcacgctgtgcaccgccaccgagtcgtcgcgcacgtcgagggtgatctccacgtagtcctcctcgtcgtcgtcgttggcgccggcggcggcgngcngcnccnccgccacccccgacggcgcggacagcggcgccgacaccgactccgcgaacctcgcgctcttcctcatcccggacctcttgctcagtggcccgctgtgcggcaccagccgctccctctgcggcggcggcgcctccgccccggcctccacgatgtcctctcctccgccgccggcgccatcggcggcgccagccctggtatggtgcatggcgcaacaacaacaaacacctcaagcgcgctctccaattgaactcccaagaaatgaaaccaagaaacggcagctgctccctccaatggcggtttcgattcgtgtgggtggaggaggaatggaggatggtggggtgggagagggcgtctggcgggtatatataccggaggtgaggtgggtgaggaggggtgtgtggcgtttaccagtcgccatggtcgccatggtcgtcggctcaggccgctcgtcggctcgtggggtaggtgcgtcgcgtgtgtgcgcgtctactgctctgctgctgcgttacactctgcactactcgctccctctttgacgctctggactaatgtttggccactcgttttattaaaaaatttatataaatattaaaaaaaattatgcttaaatcactttagataataataaaataagtaaaaaataaataataattctaaatttaataaaataaatgattaaatagtacaagcaaatattaaaatccatattagggtaggaagggagtagctgctgcgctgcgtttcgttttttttctttttttttttgggtgggaataaaattctgcggtcaagcggcggctgacgcggaaacgaacgacgttaaattaatatatttcttgggctgaatttgggctcgtgttttgttttatctatttacttgccattttttcccttcgctttcgttttttctggactgctctgtttcggaccacagaagagtacgggtagctcaggtttttgtattttgcagcgtcgttgtacagtacagtggtggtatctctggtgtacgtacgtatatacgctttccgtatatacgtttttattgttttttttggaggatgcgttttttttttgttgtcgagcgtttggcggcgcgtgctcctgtgcagtagcattcaggacttttacgtttcggcatagaaaagggaggctccattttgtgccgtttagaaagtgcaagtgtggtttcaacctgatatcctgtcttcattccccgctcgcagtttcttcttaaaaactatttaagaaacaatactcccttgaaatcttatttttcaaattttgttccaattatgatgtagattttattttgatttccgtcactattttcttaaactactgtacaaatgtatctctggtaaaaactttcttatatataaaagtttctttaaaatatcaaataaatttatttcttcaatttgtaataattaaaactcaattaattacgcgctaatgattttttttgttttgcgtgccttgtcttcatattcatcttaatttctatctcaaatactcacttattcccaaatcgacgaaggataatttaaattacatcaatcaaaacaccatacataacattctcttacaatgtatgtatatgatgatcaatttaagaaattttgaattctattatatgattatcaatttgagaaggagctgggagtaccacctaagaatcataattatgacattttggaaataaaattataatcccaataaattttcaaagtaaaggaaccatgttttcttcttctagagccacattgaacgtacaaggacgcgctggtaactctgaaatttcagaagtcgttccgttcaaaaactgtagacatagagacattttttgcatgtagagagagaaatttaattaacttatcatttgtaaggctgtcagataaattgagccaccatcgatcataatcaaacacatactcgtgagagaaaaaaaggatattaagtttcgttaatgtccttaattatacactacgatgttcctcgagcaaaattaatttggaaacggcactgggatatggatgttctcattaccaggtcaatccattcgatcgaggagagtaattgcattcttacctgcattgtacgacttcccgtgtgtgggggcattcactcattcagtactgtccagaggagtatactagtagcagtacaagaatcaccgaacccgcgttttttattctctttgagcacggactaaaaatcttgaggagaacagtacaacgtttcccatcaccactataaaaatccccgtacgtatcgttccataggtgtaggttcatttaaaatcgagtaggtgtaggttcatttaaaatcagtatctataagcttttccttatctttacgtgataaaaaaatactttctctgtttcagaatataaaactttctagcattgcccacatttatatagatgctagaaagtcttacaatcttacaaaggattatatgtgccggttcaataggaaaaaccggcattaatattataggtgtctccatctcaaacataaccactttttctccatgtattatcgtaatattagacgtacatgcatgcatacattatctatcaccattttctcctctaaattcgtgttgttataaatcctctatcatcaaacccccaatcacattacttgcaggtataaggtgattaaattctttgttggctttttcgttagtgatgctttgtgcatgccttatattttaaaataagggagtaaaaaacgaattatttgtttcacacttcaaaaactatattttcttaaaagaaattcttttacttattacttttggatcactttgtaaagctatttatttattaagtataattttcaaaatatataatttctagttataattaaataaataattcgtattaacaatccactcaataatatgttacaaatacattgaaatttcaatcgatctcaggcaaaactgacttgtaatattaacctatacaataaaaacaacggagtatttttttttatatttacgcatacaatctgaaaataaagaatggctcggtttggtaaggggcacctatgatatactataagtacagttttttaattaactggtatctataatatattagaggttctgtttcttttaatgacgtagtgaaaaattagacaaaatgaagttttagtctaaatttctgctatatataaattgcattttgatatggactattcttcctggtacatatttggtaatggcattttttttacaatttttatcattttagttttgtacttagattttatgatattttttgttttactttgtggatcataatgtaatagaatcgttgtttttagtttttccccaaaattttgaattatttccaaactgactcatcttcctgttctttttattttttaagcctactttcatatattttgtggataattgtctgcaaatcaaattgttgagatttcattttatatattctcgattttattaaatctcatatcattttttttgcatgtactctcgtgttaatgtgttttttaatccaaaatttgatatttttaaactatatatatatatatatatatatatatatatatatgtatgtatatgtatgtatatgtatagactcttggagttgtattttggttttattttttttttcgtcgggtgtgggcgggaaagacaagccccgatcaaactttattaatataggaataagtgttaaatattacaacaaacatgattgcgtgttgtgtgtattttgatatttttcatccatatagactccactatttctaaagatttcatcggtcaaaagcttaccagcagagtgtggaaccataccacatagtccatgtacgtctcctgtacgtatcctcaaccaagcacatacatacacgtacgtacaacacatatacgtacgtacgtacaatagtcaat

SEQ ID NO: 81953 - DNA, 46879 bp, Oryza sativa
  unsure (1)..(46879): unsure at all n locations
tcttttctattaacgcaagtctctccattgctagcctttgcgcttcacctttatccttttgggaagcacaagcttctgcacgagctacgtcagccaattccgtggctcgtttagcttcccttcaggtttccttgcacgggctgtttgcttcatcaaacctcttgcactctgttagatacttctcctgaagatggtttttttcttgttccaagatcttcacttccttctcacgtgactgagcttcagttctaaaagactccaagctaacagtcagtgatctgatctcttctttcaaagccagcgaatctgactcatggttcttcaactttgcttcagtagcctgtgtttggtcattccaggaatgagagacataaatatcgcaaaggggagatgatgaaagtgagaaagctactatacctcaagccttgagatcaaatttgtggcatgaatttcggtttggttaatttttgtgtttaatcttgcgatctcctcttcctgttaagaaaacacaataaaaagtaaggtaagcaactgtgagatttaaaaccaatccaccgagattcttaagagaaaggattaccttctcagacagttggctagcaagttctgcccttaaagcgtcttccctttcttgcactttcttattagtgcgttcttgtgctacagctgctctttgcagagctgtttttgcctcacttacagcaacttcatatttccgtttccactccgatgcctcttcttgagcagactcagcctgttctcgcacagcagataatctgccctcactgatatttaccctggattccagagaagcaatttgagactttaacttactttcatctgccttttgctgtaacagattgtggtcgtatttgttcttccaatcaacagattcccgttttgcattgtcaagagcagaagacaagctcacacatcgttcctccaacttgctactcttggtctgaagttcagcaatacgtccggagtaatcccttgaaattttctgtttatcattgatagattcctcatagcgccttaggtactcagccctatgcccctcacttgcttcgagctgcttcctaagtagtgccaacttatcatcatttgaactgcatttcaatcttagggaatttctttctgcatctatatgctctatctgtcttctgaaaagataaagcacggggcccgccaaactgcagttatcatgacagataagattataataagtcaaagcaagagtaagggaaaaggtttcggccctccaaattagtccggttaacagtaggcattgtgcaagggcatcacgtcagaactaaagacattaataaaagaagcggtacataccactgctgtaaaaatgtagctagttttttccatttccctggaccataagattttgactcatactctgtaagtaggccatcaatgagctggaacaaaaaagagattcacataattacattagtatttcattcaaggcaagctaaaacatgaaaatgaaaagacaattctctacaagtgaataatcttaccctgactatgtcatccaactttgcatcaggacggttgcatgctgtccgtatctttgactccatgctctgaattctattcgaacattgcaaatcagcctctagaaaagtattccttttgtagtcctgcatgtatgcgagtactagttaaccttatagctcaaacttaagcattaaattacaccaactattaattgcaaaattgattaatggtagttaagaaagaaaaaacaaacaatagcagacatgatacaatccaagtaacagataagaagagatggagtcacctcaaaggccttcttgagagaagtttgaagaagcttctcaaattttgaacgagctaacccggcaccaacagcagaagcattgaagacactaacagcctttttcaatgcatcttcatgtgcttctctcatggcatcctgcaaacatccatgaattagtgtcttgttccaaataagctcaaataagataccccctctgtcccaaaatataagggattttggacggagcctgtccagattcattatactaagaagtgtcccatccgtccaaaatcccttatattttggggcggagggagtatctaatacaagccattcataagtgatgcctacctcttctgctggttttctccggtcaaaagaagaattgtaggtatcaattgcagaatcatatgcccttcgacattctgcttcctccacactctgcacagctaaaaactattagataaattcctcccaaacagaaaccatataacctgatgacatcaaataatacgagaaacacaggaatagtaaaacaacttgttggtaatcttcaaaactataattgctgtcatagatcagcaaaccggtacagtgctatttcattctctcttttattagttttgcagcccttctaaggctgtgttcttcccccacctttcccaactcacctccctcgtgctccgcgcgcacgcttttcaaactactaaacgtgtgttttttgcaaaaggtttatatacaaaagttgctttaaaaaaccatattaatccatttttcaagtttattttagctaatacttaataaattatgcactaatctccgctccattttgcgtgttgggagtgcgagggttcccaaccctcactcccgaactcaacctaaatatttttccaagtcatcaggtccatagaaagctgaagtccaagcacagcttgcgtgctcaaaaataattgaaacctcaatctttcacatttgatctcaaacagttacttcatggaagctattaactcagaatgctaacttcataactatcattggctacaaaaaatagctgctacaagacctctacaacagcaaactctttatacggttaagtttacatagggaaaaagattaagaagtgatagaaccaaatcatgaatttgcaactcgtttacacgatatatggaaaagatcaggttaaggcatatttctgtctctattttcagtagactcacctgccatgacgaagatatcgtaggtactgcaccagtattgatcgcatcgagaaatgattgtgtcagtccagaaaggacagggcctgtcagggtgctagctccaagttgtttaggccttgttcggtcaaagacaaattttgtcaaagcatccagaccagatctaaactctggacggaagttattcaactgcaaacaaggacacaaactaatcatccagcagaaatagaaatgaatagcataaaaataacagaaatgctttatgaacatcaaccacaaagacaaatgcaatcatgttgaaatatggagtacaactataacttcacaaagctcatcaaagctccaaagacaattgatgtcaactttttttcctccaacaaggtttttttttttttgagggaaagcattgtaggggaaggccccacagttaaattccaacaaggtatatcacagtccatgttgtgaaagcgccagtatttacaacaataaagacacgtgccattgccatgtgcacatattggccaaaaggccgatgtttctggcaggtaccatgattatgtcatcatcatttttcagagatgtgattatgctattatctatgagattatatcataactaccatcctttttttttcaaatattgaaatccaatcagcagtcaagagtccaacatgtgcagcaaagttgcacaagtatgcagctataaactttgacaaaaaaagttatgctagttgatagcagttcaaaggaagtaatgataatacataccggaagttgatcaaggcgctgaagatctttctcattattcacaggtcgcacaagtgtaatgcattctcgatccggaaaaagtgcacggatggactcccgtatcttacagatacattacaacatatgcatcagtttcttatagatatgttaaaaatgatgcatcagaaagattgttgcaccagataattttatgaataatgcactgcaagaaactcatgctgccataccgcattcttagaagatacatcccttcctccaccttgtacaggcctcaaagccagttcgaggtaatctcttggagtaatttttctgttgtcttctgtcaaatccaagtaaaagtcctataggaaacaaataatgactcagtatcaaataagtcacaggctgcgtaaacatcagaacatgcatgtgccaaagagttgatttaagaagagaaaatccacagcgtaccctcagcaaccaaacaaagacaggtgaaaagtgccctagttcagatgcagtggaccttccacctgaggccctgacacgtatatgtttggtcatttctgtcaccagtgaaaggcgatcaagtgcagcttcatctatgcctcccatctgtaagaagcaaaagaagtagagaacaccagtataattccactctatgatgtcttcccaattaacaaaattagaagaacattcagtcagctgctcagcaaattacctggttgtatatgaacatacttgataatagaacagctaaagaaaatatttgaatactgtaagtgccctgccaaagaggaaaagatagaacatgaggcgacaagtcgaaagcagaaacgcaagtatgtacgactgcagaaaattaattgaaaaaataattcacagaaaacggacgataacagacattcgtcgcaattacaattagaaaacgacatatttatctgtttaaatggaatatattacacctactgtcagcaaaatgactgatattaggtagaaaactatttctagggaaatattattttcagatttcactaggtaatcaggtccaaagaggaaaagatgcatgtaagtatcttcatcaaagataaacaccaaatgaacttcgtcagcaagacagcaactactagggatgaaatttctataagtttgcatgcgacgcacagagggtaagagtcataactcataagaacatcataatatgatcgtcccaacaaagagaagctactgaattataaaacttcttcattgaaatccaactactcacaatacaaatagcttcccagtgtcacaagtcacaacatatatcattaacaacaaaaggcagccaacaaaaagttaaagctagaaacataccgtttggtcataagcatcaattccttcagtatccaacaatacaaggttgtattcagtcccatcaagaccagttctcttcaaaggtgcactccacatccaaagtcccttggtacaaggacgatgtgttggcgcaacttgaaaaccactgcttcggcctagaagctacaaaagcaggtaaaattttatcatctaatggtgatacaaattaaaaaaaacataacctaatttgacatttgattcactggttgctcatacacacactaatccaatcaagacatcacaccaattttacaattgaaatataagaaatcactctaatgccaagcagaaatcccaaaagttggtagataacaatatttgaggcgctgttttgctttttatgtcctcacgagaatcccacatattgtataggcacactgcacacaactaactttaccctttaacagttgcacgacacatcgaccaaaccaaccgtattgctaaaatgctgcagggctaacacagtgagcactaatcagagcaccaatccaatgaaatcgagaacaaaaggctccaattccaccagtcaacaaaccctagaggaacgttcatcgaaaggacaactaaaattgaactactctcgagataacacggctgatcaaacattcaaacactacaaacaaaaccaaaaaaaaaaaaccctagccgcaggttgccgattgcaaaaccgaacggaagttcctcaaatctgtacacatggggggggggggggcaagccgcaagcgcacgcatacctggttaagcacgaagctcttgccctggcgcgcgcggccgcagacggaaacgacgccgacggggcccttgacgagctgcagcgccgccaccgcctccgggtccatcacgaacttccccttctcgtcgcagtacaccagccgcagcggccgccccggtccacccccaccctcgccgccgttcctgacgggtgcgtcgccgcccgcatcccccgcgctggggctcccgcgaaggccgagcatctgtagcatcgcgccccccgcgcgccgccggcaagggcacgccgccgccgctcgcctcgctccgttggtttcaaaatgggaagagggaagaaatcgaaaccgaagtggtcgagggttacgctacgcgagcgttggtttgggttgggttcgagtcgagtcggttcctcctcctgccgcgctggaagcgacgcggcggtttcacgattcggatgctttttcccctttggagctggacgtgcggcttggtcggtgcatttttggactttggtccacagttggtcggtgcagcgcacgtcacaaaaaaaaggattatttctacgtgggcctcaatggattgcacatttgtttgtgttgggccaatttggtttgcatggctgggcctattggggccttaaatattgggccttgcatctgatttcgtggcctgtgttacttatcatgtcttgaagtcttcccttcgaaaaagaagggaacatggttgtttgcaatttgtatgtaaccttattgttttgtttttcttttggcagtggtaaaaattggaattgccaaaaaaaaaaaatgtcggcagatttgctaggcatttgtttggtttgctatcaaagttatatagtgtactaaactaaataatttagcgatgctactcccttttctacaaatcaaatatagatgccaatttttcggcttttggctttgtaaaaccatcaccaaagtcaaatagattgaaattccattttttatagattattgacatggattatctactactttataggaataaattaaatatttctagtataaaattaacaaatactccatttgcgataaaataagtggtctaagcaatatactagaaaaaattgatttaatgtaattttagataggttgtcggtgatatgggcccggggtacccacactaaggggaaagggtcattttccctagccacgtggctacgtggccgggcgcgcaggtaataagtagccaaaaggcgcccataacagcctaggggcctcggggtatccagtcgcgcccctcgggcccgagaggctacgtcgccccgaggccctcactcggctgccacgtcaccgctgagtgggcggaggaaagggcgctgccagacgcattgatgggcggcgccccaaccaccatcgtctcatttaatgcggcgtggctggtcgtgcgacgtccaatcgattgacgtgcgtcaatcgcccttgaccgggctgagaccggtcgcaggcggatgggacgggcggcggcgcacccacaccccgcaggcagcgtgggggcaggtatgccccgtcccatcaactcccggagaccgatgtcagaccggtgcaagaacccacagaagtctccaaaaaattaagagggaatgaccggggatgtccctcgcgtcagacaaaggacggcgctgggacccacctgaggacgagtggccaccttacttccggtctaaggcatagttggtagctcgacccgggttgatgtgagccccctccccctcaacagctagaggtgtagaggcggtgcatattgtaaccccttgaactataaaaggaggaccatgccccccgagcaaggggacgactctggagagctcaaatcttaggagaagattagccaatcgtcgctctagggttagaggtctcttgtaatagcacaagcataaatccacacgcaggagtagggtattacgcttcccagcggcccgaacctggataatcccttgtctccctttcgatcgccatccgccacattagcgcaatccatagcgaagatacgctcttgatcatcgcgccctattcccccggccgaactcacaaagggggtctcacgtcctcccgctgcaaaggttcactcctcaacagaggtggagcaaataatttatggtaataatccaacggagtacatctctcagttctataatttaggtaagcaaagagtaacttaagaaaatcatcttaaatgagctcccgaagtggagaaaaagactgggcgtgttgagtaaagtcgtattgacatagactttgctgaatatatgtctatcgactctgcatctggacatgtaaattattctcatgtaaccattattggactattgggataaatacaaagcgagcctgtctgaatcaaagacaagtcccatctttaccagattagcaaaaggatggtttctgaaggctcatgtggccctgccagaattgcactgctgtttttttttccctctttatgtaacgccattttgcgacagaatctttcagacgtcgtctggtcgaatgggtgcccctcaaaatcacagatttgcagtggccggcatgctaattgcgtctcgattaatcatcgcttttcagacaaaaaactgaaggtcgtactgataaatatggctgcatcaccatcagcagtaaaaactaaagagacatggcacccaaactgctccagcacgttgcacttagtacacattttgcagcactaagccggcagcaaaagaagagatttttacagtaaacacatgattcctgaacaagcagagacatgatgccatgagctggattattattgtttttgcaaagagttacactagtgttagattagttgcttctccttataagccgggaaagcgaatgggtgtggtaggccaaacacaaagaaagtgagagcaaagatgctacaagtaccagacaaaaggttgagctgaaaaaagaaaataaaaaggccccaacccaagctgacatttccatggcgttcagcgtacaggctacagcctacaggttccctatctgattgcctaccccctgctaagtgctcaacttgagcacttatcttgctcctcacttcaccaactcagcttgcagattgattaatcaaaagtagtattaggcttcgttcgttactgggcgatctaggggattgagagagaaaagtatctcattttccacgcgcacgcttcccaaactactaaatggtacgttttaaaaaaaaatctatagaaaagttgctttaaaaaatcatattaatccatttttgaagtttaaaatagttaatactcaattaatcatgtgctaatggttcacctcgttttgcgtatcttcccaatctccccagtcctcttctcctcaaacacacccttagagcctagtagatcgcatttgcttcatttttcgtagacagctagcccagtacagtacccctgttaggaaacgatagacaaacaaacgatgaataacaatagatcaatcacagaaaacacgagatttttacgtgaaaaaccctctcaaaacaggagagaaaaaaccacgagctccaaccagcaaaataccttcactatatctggggtgagattacgcacggcggtttacaaaaggtatatatatatatggtggaatctagaagggataacgatccgtttcgcgggggctccgccctcgcacccccggcccaagcctcccggccacgggcttccgctccactacggcagaagctggcgtttattaagtggagatgaatttagatcacaactcaacgcacccccaaactcatagcgtgccggtacgtgtagtcatgttgtgttcaggagcagtgtattggattcagaacttttttggccctgtgaagccaagctagcgttaacaaagtgaggccaaacagatactccacgagcaaaggagtaactttactcaggcagcatgagcatgccagtcagtcaacaaagctcccaaaaagaaccacgaattctgaagcgttcgtcaggtgaatggatccgacgagatcatcagaagcaagaaaacgaaacgcccaggtttttccatcacgggctcctccaaccttccaatcggagagcacaatcacgagccgtccttccatccccacccccatcctgacacgcttacatgtgtgcagcatgaagtggtcactcgtcatgatcgccctgacggccgccggccattcgcgccgccggccagtgctactgctatagtcgtagctccagcgagtggagcgagtggagtcgtacctccatccgcgcgcgcacgttttttaaacagctaaacggtacgtctttttttataaaaaatttatatacgaaagttgtttaaaaaaattatattgatatattttttttaaaaaaagataatcttaattaatcacacgctaatatacaacaccgtttttcgtgcgcagaagatttgttcccgactgcccacaacgaacacagccataatatgtacccctccgtaaaaaaaagactaattctacttacgaatctgtatacatgtgtctagatttgtagttcggattttttttttacggagtagtactactctcctactccaatcaatcaatgagaaggcgcggcgccccccggctggaacgggcgaattcctgcgacctctttcgagcagcggcagcggcagcggcacggcgtagccaccataccgtggtcctggttgccagcagcggttgcgagactctagccggtagatgcagtattgcagcagtaaccagcagtgtcattctcatgaaacctacccctctctctctctctctctctctctcactactactgcgtgtagctaggtagaccatcgatctcgcgcatgcgaattcgcgaagcgagaatgggctttctgcgtgactgtgcacgccccggcatatccggggggttatgggtgctttggagtctgtaggtttgggtgctaaatctgggttagttgggaactgtctggtcttagcttgacaggacacggctattgcttgttcgcccattggcatatttggctggtagcagtagtactactgctattgctttgatctctcatcactttagtttgctgcactgtccaaatgaatgctagctcctctatctagagagagttgccttcgattgtttctttacagaataaagttgtttatatatcgtaaacaagtgaatgccttttttgtcttgtgtttaccaaagctaaagcgacatgcaaaccttttttttttctgcagcggctggagagtaaagtttggcaacagttaatttctatggcctatattaaggtagtgtttagttggtgtgataggatgggatgggatgggacgaaacccatttttagaggtgtttggttgaggggcgagtgggatgggttggtctctagagaagaatattcctcccagatccgagacaaacccatccgacaaaatcggccggacgagctcgtcccacttggacggagcacacagcgtctcctcggcgaccgccggcgctcgtccgcgcctgcgcccaccggcttcttcgtgaccgccgacggtcgtggctcagcgtctcctcggcgaccgccggctctcgtccgcgcccgctgcctcctctgtgaccgccggcgctccgccacgaccgcttgccaccacctctacgaccgccgactcttttccacgaccccctgcctcaacaccggtcgccgccacgagcgagatgctcggcgccatcccaccgctcattgcgatgctcgacgagagcggctgcagtgatgtcgacgcagcgggctcgagtggcggcgaagcttgaaggtaggggggcggcggcggcggatccagaggagggggactcggcggtggcgaaacttggaggtagggagagcagaggcggcggatctagcgcaggggatctcccgatccagccgcggcgacgacggtgggctagcgggttgggtgctccggcggtggtggccgtcctgctgctgccgctgtgcttgatccggttgttccacgcgtggatgcaggtggcgcagtcgacggtcgttgacggtgatggcaaacaacgtccatcccatttctccctcatcccttcaaccaaacaaaaaattaggattgtcccatcctacaaaccaaacatgtgagtgtaatcatcccaaccccaaaatcagggatggtttcatcccatcccatctagttccgaaaccaaacacatgctaagattggtgtagagaaaattaaacctttcgcttgatgaaggttggatcacgtataaaagaggaatttccatgaagcaaaatagcactatttgatttgattcatgatgctccttttagtactactaacatatatctatgttatattcgtatgcatcatcaataagttgatgtgtactaccaccttttgttacaagttaatcctgtctatttgtaggcaatagccaattactagctcgtatagcctcgtaatcatggtttgccacaaactagaagcgaactaattaattcaatcttacttctaattagatggcagcatctatatctcttgcaaagatatgcaagattcatctagagctcttttgttttcctttcttaatttgtcgcaatcccaaaaagatatatcactactaatggtgcagacagcatgcatccatatatcacattcgctagtttgcacagctggtttggatatttcatcgtccatatattcgttgaatcattgaacaccttacatgttactagatgcatacctttggaccctccaaaacaagagaaacatgttggcaataggatggtccgtttggacgactgaaaatcagtgtgtggttgcagcttgtgcatcatctctagcggcctagcttcgtctgtaccctgtgtagtatagtagtatcactttctcttttatagatggacatggagagagatttatggccatgattttggtttggtttgctcgctatcaagccaactgccaacctgaaagcagaacagtagaagtacgcgcaatcctttagcagcaattggtacgtagtaggacccatcttcactgtgcccatttgcagagcgtccccggaaacacaaattaatccggtgtttttattagggatcaatgcatcttgtactagcatttgtctgttccttgtgtaatcttaccaggcaaaaaagtatcgctacaggaagtgttttaaaaggtgtctcactggtacagtataaatccaccggttaatcctgcttttagctcgccgctcaacatcatagtactatgaaatccccatccctctttcttccaaaaaatggagaaaaaatatccatccttcacatgaatagtgatgacaaatccactgtatgcgtaaacttttcagtttatggattatgacgatcatactttgtcctagcctcctactacttccttcaccagtgtatcttatagtacaaatttttaaacgagcttataattttcttatatttccttcattcatttatgttgttgaataatcatcataaacttagttttattcatcacaagaatggatcgcctttccaggaattttccggtatagtaaaaaactgttacttcatcaaaaaatagagtcaccgataactggttttgacatgccatattactacagatctaaacatcaggtcaagtcaggttcataatataaaaatgtgtctaattcaatcatacaatactatattaattttaaaatgaacgaaatacttcgtagcaattatgttatactagtaaaaccgacaactaggatcacacgtaccagatcgacaagtggtagcttgccaggaaacgatctctcggcacaagtgtaccactagacaaacttaagacgttttagctagccagccacccggcgatcaacacgtacgcagacacaggttacttatggaacctttaaacccgagcgctgtatcgagtcaatcggaatcggatgtacgacgctgccgaccgagggcccggggccgctggctacgcgatggagagagagagagagacagatcattgccttcatgccgatcggtgggacacggcaaggcggcaaacgacgatatcgaccggtgcactgcatggccgggacgacgcgcgtcgagaaatcgcgatacgatcgaccagcgtgcagcgcagcagcagcagctggctccaatcgatcggcaatcacagccacgccgcggtgccgggtgcgtgctccggtggacgcccaccacgtgaggccgtcgcccgcaccgcgtacgtacttctcctcggcctcgcacgagctaagccccgcgccggtcggtctccggctttctggaacgggagagccctgcacgactccacccttatttactcatccctttagctttggacattgtacagaccacacgaggagtgtactcctcaccctgcagaaaaacacgttcgcctacagttttagatcgtcaagcaatgccctgaaaggctggacggcgaggatccaatgaacagggacggtttgatcaaaagctctcccgtacctgaacggccgggccccttcttgatgatattgatgatatactatagggctagcttgcacacagctagtagtagactctaaccatcggccgtacagacatggggggaggagggagtacactactcctgcagcgcgcatgtggcgcgtcaacgatttgtctcccatggggatcgacggccccggcgcgtgcgcgggacggtacgggacgcgggcacggaacaacaacgatttgcccccaatcatgcggcgaatcatcacaggcccgggccgcctcgcgccccgcatcactcggtgtcacgtatcaaaacccacgatttcgcgcgtggcgcaggcgggaggtaccgttgggctagtcgattccacggctccacagtccgctcggtgaagcgcgcgccgtgcgtgcagcatccggtaaaacatttggcggagtttgctagaaatatggcgtcatatgctatggtggattttttttcagccacttacacagtagttacaccttatttacaccccacttacatatataattagtatgtaattttcgaatttacatatataattttagtacttacatatgtaattttgagacttacattgtaaatacactaaaattacatatgtactttaggaacttacaatataaatacatgtcgactattttttgataaaaaatatggcgccataaacatagctacaccctttgagcgtagaaaaaagacataagaatcaaaatagagaagtagatataaaatgattctaataggctgaatcttatgttataaatacttcaaaatccatatgatttaagacaatccataggaattttataggattttggtttagttatttatttgtttagtactaggagtagtaggatttaacccgctatttgaaaggccatttatgatttctttttcaaatcgaattgaaatatttcaaaattgctatataattcctatatgaaatgcaagattgaagaaatagataaataggaaaaatacaagattttgatagcaatgtacatgcaacacaaaggattatagaacacacgaataatcgtttgattaagtagcagggaaaatgcaagaatcgggcaagagatacatatattcaaaggaacttttttaagagagttagagtttttgctgatttttcttcgtaatctctatagatcgtatgtcccataggatttttaaagagtggtgggattcgatatatcctttgtctccatggccttcttataatattactttataaactcaaaatacttcaaaatttatttatttatcaacaaattaaccaagagggactaaaacgtcattctaaatatacatgtaggaacattttccatatgatttgaacccccgaaattcctttgttcaaaggaaacctcgagttgcaagttttctggtatgggtgtatgatttgaactcttaactcttgccatgctcacacttaattactttgtgactagtgttgtgcttgtttattataacgggattgggataattacagactgatggttttatatgtttttttctatctattatttctagtggtttgattttctcgtgaagatattagttacagtggtttttcaaaaaaaaattatatggaaaactacgtctcgagagaggataacgactttggttctaaagctgtacttcctccgttcaaaagaataaatgtaagattagatgttcgtcgacgagggatacccatgcaccgtattctgagagtattgtggtacgttgatacaaaaatctgcacgatacgatatcaagtacacaagagatggagattatactgatcgagacctattgtaaggtaatagtcctaatccaatttatgttggattatgaagaaaaccacatagtacaatagagaacaacataatcttgagattaccgacgagatccctgtcaataactactcgatgaccaagtctttcggattgctcctattgttatgggtcttgcactaagattcgatgatctgtacccctaggggactgtatttataccgtgaatcactttagtctccgagtagaactcggagacaatagaccctatacggtacgacaacatcctcatcttttataaataggactctgacacattctattcgtagatattatttccttaaaaactcaccgattttcttaactcaaaagtgtcctttccgtatacttgagggtatactccaaaaatagaatgtactcctccgtatgcttagcagatgtgacttaatctaatacaataaatctgaacaactttctattttattcatatggttaggggtgggcatttggtctgaccggaaatttcagtatcggtcttcggtcttttggttatttcggtctttgaaaagtgaagaccgaatttcaacgcaaaaatatcaggatcgacaaattcggtctcggtcttgaccgaaattcaacaacattttcatatatgcaaataaataatggaaattttcaacctaaaaatcacaaaaaagaaatcgtaagcatgcagtatgagcaaagactcttattaggttgcatgcctaaaagaagtagggatgtgaaaagtacagtttaatcctattgaacttagtggattataggttgtatttagatttttttttgttaattcggtcatttcggtctattcagttaaccgaggagacgaaccgaattaacccaataaaattctatcattcactgcctaggaccgaatttctcggtctcggtcttttcgtttcggtattttttttttgtccacccctacatacatacggtgagagtagtggagatattttaaatcggtgttgcacatattttacgtgagctcctggtacacatcacacctcatcgaacggaagtgcttttctcaacgataactgctggtagctacaggtaacatactagggtggtgtttagaaaggagggaataaactcacaaaagcataagtcgacaaggattttctacacataggtgccatgacacccatcatttacatgtgtcacaaatagttatagaaaaaattgaaaaaatttaataacatcgtttgtgattatacaaatctatacacaaacatgcaagactaaatttgatctacaaatagagaaataaaaataataaaatcagacagtgaatagtacccgtacagtgcggataaaatttgttatttttgtttcttcatatatcgatcgaatttagacttacatgtttgtatagtgtcatatattatcatggtctatctgatcaaattttatgatatttttatataactgtttaaattacatgcatatactttccgacttacgcttttgtgagtttattcgctccttcccaaacaccacctaacaactccaactacaccctccgtcctaaaaaaaaagttcaatcctaactacgaacctggatatatgtgtgtgtccaggttcatagccagagtttgggttttttttgtcagactagtacgttgataggatgattttttttttctttgaacaagctctcaacgataacggcttttctcgcttaaagtttgggcacctgcccagcttgatcaatgtgacattttatagaccaatcagaataacaagagaggatggaggtacacgattgacggtggactgagtctgtcacgtcttgtcgccattaatcagtttttgagagccttggcctgcactgaaaaccatgtgtaaacctacggttacttttatggatgtccccgctcgttccctagtcttgtcacattacgtgtctgtccgtactcctctctagttagtcaaaatcatccaaacaaattaaacaacctggcgaacaagtttaaaagtgttgggttgtaattcaaatttaggctgtatctaaacttcagtccttttccatcacatcaacatgtcatacacacacaatttttcgatcacatcatcttcaatttcaaccaaaattcaaactttgcgttgaactaaagacatccttatttgtactccgtacacatttaacgatcaacttcggacggagtgaagcgaaggcctatcgccggaggtttgaaccggactgaagcgttattcttttagggtttcactttcatatatactccctccgtcccagaaaatgccgattcctggatgcccgaggcaactttagcgatagctgttgaagaccaaaatacccttgcacaaagtacaacattcaattcatctttcaaataaaaaaagcaacaataggcaaagagattccctcgatccctccgtaactacctgcatcccagcacagcgtaccacacgcagcaagtaggagtaccaaaaacatgaagaaccaagaacaaagaaaaagagaaatactagaacatctctccaattgagaaaagaaattctctgaattcacctgtacgaactgctagtactagcaatagcaccgtaagaactagtactactagaaataggaggaacatagcaagaacccaaagcttagaaaaaacgaaatgtggcgttgtttgctggctcgtgcatggagaactgtatcagatccaccgcacatgatagaagaccccgtcgctgacaccgtggccgctcgtcgcctccgccgccgatgacgcccatctccccgtcgcttccgccttctccaacaacacaacaacataccccctcgccttcatcgtcgatccgagccgcatccgctccgctcacaacgctccgtccctgcatccttgtggccgtagcctggtggacgcagagaaggaggagaggtgggagaagcaggaacgaaggggagcggcatggaatagggagggaggtgcgggagagaggggccaagcagggagggagactggagggggaaatcagtagtgcctcgcttccggagacgaacagaatcgatggggattttagatctgtgcgaactcgcgagagaggagcgagagagacggagaaaagaagaaagcccgtgagggaggggataaggttcaagcggtgggaacgtggggagagagatgccgtgggcccatccgagatgacattcttgtttttttgcgcaggagtcgagtttttgtgggacaaactcccccctccagaattcgactttttctgggacggagggagtacttctcgtaaacagtcgttcggtgttataaccaccccaaaatagtaaaaaatatttattgaccggtatccattaaatcttactatgattgatctaatctattattgtttatcgattatttgcctatcattttctaacaacaaaaagaaggagctttattgctcaaattactcccgttggccaggggcacgtagctggtgaagcgtcgcgcacgtacgcgatgcacccggcgacgagaggccgagacgtggacgcagaaagcggaggggggtcaaagaaacaaaaacggtgggtttgcagcagcaggtgggaggagcggaaaggcggaaagccgaggaggaggcgacagcgggggccccgcggctcagagtgcatacaaagcttgcccccgggcgacacgggcccccgagcgcgagagggaggcaggggcaggcaggcgacgcgtcctttaatcgaaagcaaccaacacaaggcaacagggggaagcagcgcaagcaacagcgataacaaacgccatttcctcctctcatctcatcacatttctcgggaaactattctaatcccgtaagaaaatattccctcgtttacttaaaaatcatctaaacggttatgaaaaattctgaaaaatttgacaacattcatacaataaatatatacaactccacaaaatcttaaatccaaactcaactcacatgtcgagatataaaaaagacaaattcagcgtataaatagtagcgtactgtttatatctaaatttgtcctttttgtttctcgatgtgttgatcgaatttgaacttgaattttggtggactagtaggtatcattatacactatattgtcaatttttttttagaatttttcataattatttgcatcgaatttggaagaaaaaggtatacgaggggatataggggttagaatccactcccacatttctctctctcttacttcctccgtcccaaaatatagttatttctagcacagtactttatttcaaaatgaagctatttttctatctaccttcacctctcaaccaatcacaaccattctttttcacctactttctcttttcaaccaattacagaccttatttaattattctcatctaatttcttaatacatgtgccaaccttaaaaatacttatattttagcacggagtaattatctgtgatcggctccggaaaagcagagcggcttctcgcccgggccgtcttgtcctccttgatgtctcgctacagcttcgataggagtatcacccacccattattactactgctaggatagaccactagtagtactcgttgctagcctcccagcacaagccaacaagttcttttgactgttgaagtacgcactgtactcacagtagagtaccactctgatcagctgtccgctgggccccacctaccacgccggatgccggggaaccaaaccaaccatctcacattctactactagtagcagtacaagtacgagtaaaaacggtgcttgtagtgtgtagcacatgaggtgtttagttcacatcaaaattaaaagtttagttgaaattgaaacgatgtaacggaaaagttaaaagtttgtgtgtagaaaagttttgatgtgattgaaaagttagaagtttgaagaaaaaatttataactaaggttgtgtttagttcctgaaattaggtagaagtttaaagttgagagtttatgtgtgtagaaaattttgaatataatgtgatgtgatggaaagttagaagttgagagaagtttggtgtgtaactaaacagggcctaaactcggccacagttacgggagtggagcgaggcgagtcgtgtcgaccgttggtatagcgctcgtgattcttggtgggacgacgacgatgagcgagcgagagagcgggcgggcgcacgggtccccatgggcaaatgcagtgccggcgccgcatgtggagaggagcctctggtggcgctgtccttcctgcgtgcggcagcagcagctgcttcctgcaaacggcagcctctgcggctctgacccacgcccgataaaagcgaggggaaagttgacgtgtgacgtttcactaccttggctcacttgcctacacgccccccttctttttccgcccattcaaccctccccctctacgagtagtatgccgtcaatataaagtttattgccaaaattttgatattctagaccgttgtggtattatcaaaattttgacatgatttattatatatttactgtagtttagcgataaactaaatggatatatatattttacaactctaccagaaactagtatggtttgaaatgacattaatctgaacaagcccagaaacttttcactctgtcacatcgaacatttaacacatgtatggagtattaaatataggctaaaaataacaaattgcacagattgcgactaatttacaacacgaatcttttgagcgtaagtgctccatgatttgacaattgagtgctacagtaaacatttgctaatgatggattaactaggcttaataaatttatctcgcggttttctgacgtataatatttcaaatgtgtatccgtatatccgatgtgacaaccaaacctaaatttttttcctaactaaacaagacctaagagcaagtttaatactatatccaactagtagcttcaaattatctataattaacttaatagctaatttatacaatagttacctataaacatatactattatactattaatacatgatcccacttgtcatatataaattacgtcttaaagtctgtgttacagttggctacaaatctgtagccacctactcttctatcttagtttttatctttttaaaatatgtttatagcttgtgttatagtctgctatggtaactgctctaattgtactcttcattactactccactgttgacgaaaaaatcgaacacactggcctgggagatctgcttagctcctgtgcagatccaaaccttgatgagatgcgggcgtgccagtcagtttgattctgcaaccgatatgatatgcaaatagtagatcaaaacagctgatcggctgacaagccgatggagtagttccaaccgatagccgataccagccgataccgatagggtttaagcaatcggctatatgtccaatgtaaataatgatataaaagcaatcggctgatgatgatgtaatataatgcagtataaaccaatcggcaaataatgatatgataaataagcatcgatccgaaggttaaagcacacatcgcctggaggtccgatgtcacaaaatccccaatattagattaaacagtgaaacctttgttgtcatcggctaaatccaacttatatgtatatgcaatccttatgagccgatgtaacatccagataactcaccggctgaaaccccgatgaaacccttattttggcaatcaagaagcaggttagatattatggttctaagcatgacttagtagatcaaacttaactgatgcagcactaagtatgaaaagaaacataatatctagacaatcaagccgttgactgagttttcagggtggtagatgtctaagctaatctaatctagcaacgcgatttagtcgataccggcagaaaccctaaaatgagaagcaaccgataaagctaaattgatatgttatgactagattaacagagacatatgataaatagttaggcaaatatatcatccaaaccagagcaatccaagaggtcgaatgtactgatgcagtcttgaacgacgctgacgtagacgatacaattgcctggaccggcggaacattggacttatatcttcgccctagatcgaagacgatgcagccccgcgtcgggtgccaagttccgccgaaacgtaaaaacaaaagtagaaataaaagggtggcgatgcgccaaattgtattgatcgtgaggatagattacatagaccccgggtgtacatatttatacacatgggttgatacaagtccttgtcggacaagaaagagagcttcctaaggataaaaggaaaagataaagtccttataggacactaaacacactttcctaaagatacaaggaaactaacaaactattcctaattaatagataacttaccatgccgtattctctttaaactcggtctcttctggataagcttcctttagtagatcaatttccttaaccgaatatagcaagaatccgataaatgacgacttgacaactctcatcggctaatctcaggacttcgaagccgatactgactctaaaccgatgactactccggtcttaccaaatttcactattaacatccactgatcaactattaacgcatgtgaagtgtacagtacggggtaggttaggttagtgaccggcgtaccattgtaccaagtaccaacggattcgattcggcaacaacagcacgagatcttttccatctcttgcacagcaaaatttatccgtgtttcaacatgttttctgtacgcggccttatctcctctcgtgcgttggagtagatgatcgagggggacacgcagctgtagtcctacagagtacagacctgtggctgtgagcgtggagatgagagctgctaccagtagtagtagtagtccatgggtggatgtgtgtgcatgggtatatctggcgtggtgactgtgagctgcttttggttcttttctttccgcactggcctctctctcggagctgtggcagcgacagcaccatcaaatttggcagcagcagcacggagcacagctgcatcaacagtcttgttgccaagcatggggagccatcaattttttgttcctactctaagggccggcctttttgcaccacacaccctgatacgcccctgttttctggaccaatacccgctcctcactaatctactcccacagtacatgattatagtagctcacctcattatgtttctagtgatataaccaatgcactcatgttcaacttcaagtcatacccttgatatagtgcttgttagatttaataccctactaaaatattggtagtgtcgaaacctacgtaaattttggcaccacctaattttttagtagggtagagttgtatttggttggaggccaatttagaaccaaactttaagtagaatatagaaaaatatcaaattggacattggaaatgccaatgatttggcttcaaaccaaaaccttcattaacactgttcaaactacccaaatattggtagggcacgttttggtgctaatcgaaaacagcccatagatacttgtatttacggctaattattatttcaattgtagacgacgtatccctcgacaacaaagtgtccatgataattttaacctagttttctcgagatgcctatagaaatataatacgtgtgtatttataggacgagtatagtatatgcgtgttgtgtcgtgatcatctgcgtttgtatagtacttttaaaaaaggttagtaaatggagtactccacactgtaacggtctcatcagagcccagccacagccagcatcgtggagtacacaggaacgtacatactccaattcattaactgtgtttcagttgcgtgtattcaaccgggtaagggaacaccggcgacgtatacggggggcagcatacgggcgcaataaaaacacgacaaatcgaatccccggccttaaaaccggtgtaatttgggggaccccggccggcgatgcaactctacgcatggaccaccaccaccacccccatcccgaccgcgccaataatgcgcgaggtggcgtgccaacgcaccagatattaacccccctcacgcgtcacacgtcgtcggcaaaaatccatccatcggcagcgcggggaaaaaccgagaaaaaacctcgctctccatccatcgtctccagccgtgacggcaacggggggcacggacacgggcgacgacagcgacacggcgaaatggctacaggggagatgaatgataatgagctgatcggtggcaatgtccttgacacgtttaaatttaacgtcgacagcgagtagtcgtaacggctacagatttgagaagaaacggaggttgcagaaatggcactaatcaggaattcaagcagagcaaaactaaggagtactactacagatcgatgagaaacagtgatcggtaagctcgacggtttcatttttgggaaaatattgggcacccatcttcgtggtcgaactcatgattttactatctgaagaaaaggtgcttgtacttgagatttgctgcttttgataagtttcacttttttccatttctgatttttttaaatgtggatttatcaccggtagaatcattgcgctgccccagccgtcgtgccacgtcggttgatcggaccacaccagtttgatctggccaaaacggcaaaacggtggtcaatgataagagcaggtacaatagcgggttataagctagctgcaaatatattttaaaaagataaatgaggagagagaagagtagtgggctacagatttgtagccagctatagcacggactttaagacgcgatgtgtgtatgacaggtggaaccaggtaataataatgtagtatgtaactattgtatgaataagctattaaattggttataaatgaattgaagcaaatagttggctatattattaaacttgctctaaggcaggaccttctctaattgtatgtgtagcactcctagaatttttcgtaggttggtcggcacaaatcccagtctactcacagtaatccctagtagagcaagtttaatagtatagctaattactaactttaaattatctatagtcaatttaatagccaattcatatacaatagttacctataaacatattaatatccggtcccacctatcatactcacattgtgttttagagtccgtgctgcagctggctacaaatatgtaccctactgctcttttctcttttttattttcttaaaatatgtttatagctggtttatagagtgctattccacgtgctcgtatgcagtttcccttttcttggtattgaggaaatcataacatccgaatggtcttgagtctagtgaaaacaaatatttctccctaaccaagcaatcgtacctgatattataatagcaggtacaatagcatactataagccagctataaacacgtatggagaaaataagagcaagttttatagtatagccaactgctagcttcaaatcatctataatcaacttaatagtcaattcatacaatagttacatataaacatatactacacaatcaatatctggtcccacctatcatacacacatgcgtcttgaaatccgtgctgcagctagctacaaatctatagcctgttgctcttacctctcctcttttatctacttaaaatatatttacatatggcataaagtctgctattgtacctgctctaaaagagaagagatatgagtagtgggctacagacctatagccagctgcagtagggactccaagacacaatgtgcgtgtgacaagtaggaccatatattaatagtgtactatatgtttataactaaatattgtataaattagctattaaattgactataagtaatttggagctactagttgggtatactattaatcttgctctaatacgctgtaactatactttgctatttgcatttatttaaataaagaaaacattattaatgttacacaattatattaaaacaacacaattattctaatatcattttcgacgtctacataactaaggaaaagaaaattgtgtaaaagaaacagacgcatgcctaaaacatgaagaatcaggcatgagtccgtacaactatagggtgatactaattgctttcgtatgtgtaggatttctttgagctactgacacgtgggatatactagattaattccttctctctctcgtttactgtcagccaaacgaacacataacataatcacaaagtacggcaatgtaatgatccccacctgtgtttcaagctcacctgtttttagctgtttactgccgtgtccgcgtccaccccatatttcctgacgcctctccatcaccatgtcctctcctcccacctctgcccgcagccgcagacgcagagctgtctgctctgcaccaccactgtgcgcgtctcccgcctcttgcgctctctttttcacctttcccccatttctttattcccccacgccctcatatcccctttttttacttccccgtgacaccaccagtagagtaaaaaaaatacaggtatagtagcaagtactccttgtacggttgtactacgagtagaagtagaagtattgatttcaactggcacggccagtagcagttatactgggttcacaattccagtgaaatccgatttgaatttcgcgaaatccagttttcttgaaccgggttgaaaaccagatcattccgtttttcgatcaagttaaactttggctgtgtttagtttctgaaattgggaagaaatttaagaaaaattgatagtttgaaaaaaaagttgaaaatttatgtgagtaggaaaatttttggatgtgatgtgatgtaatggaaagttaaaagtttggaggaagtttttgattggatttcacaaaattcgatgatatcggtcgtaagcggatttcgatccggtatacctagaataagcgaaacgacatatttataaatgaaaagtaatttataaataaaatttctatatacgtgttcttataaaatctaaaagtacataatgaaaaatagactttaataaaaaaattttaaaaccagctataaatttaaggttaaaaatttaaattttggctaatatatgtgggcataagcaaaaaagacgaggccccgggctcctctgcttcttttgggcaatagcttcgcgtagcttagctcggcttccccctcattcatggccattaccacgatgtgtcaccccaccccaccaccgcccgctgctccacttctcctcctcctcctcctcctctcctagtagtagcaacctacggacaccacccccacccgcttcatttatcacttgtctccccctctccctcgcctgctccgctgctcttgtgcttcgcgcctcgcctgacctcgctgtcgctgccgccagccatgaccgggatcgacctcaacaccgtcgaggaggaccaagaggaggcggcggaggaagtggcggcgaacggctcgtctccggctccggcgaaggcgggcgcggtgtgcctcgagctgtggcacgcctgcgccgggcccgtggcgccgctgccgaggaaagggggcgtcgtcgtgtacctgccgcaagggcatctcgagcacctcggcgacgcgcccgcggcggcggcggccgcggccgccgtgccgccgcacgttttctgccgcgtcgtcgacgtcaccctcctcgtgcgtcccttctcaatgctcgtatcgtacgtgttctcgtcttcacggcggcgcgaggggattgattggctttgtgttcttctctgcaggcgaacgcggcgaccgacgaggtgtacgcgcagctctcgcttgtcccggagaaggaggtgcgcgcccgcctgcgcgaagcagttggagcatttggtttgatgattccgttttttttttttgttttttgacctgagttttcttctcttctcttccggggattgaaggaggtggcgaggcgggcggaccacggcgagggcgaggacggggacggcatgaagcagcggttcgcgcggatgccgcacatgttctgcaagacgctcacggcgtccgacaccagcacgcacggcggcttctccgtgccgcgccgcgccgccgaggactgcttccctccactggtcggtgtatattggagaaagaaaaagaaaagcttccttttttgaagtaaagattttatctttttttgggggtttgtttagctgatgaaatccttcggattgggaaccttgcaggattacagccagcagcggccgtcgcaggagcttgttgccaaggatttgcacagcactgaatggaggttccgccatatttaccgaggtagagcagaaaaaaaacatggactttgagaacaagtttttttttaacctgttttgatgactgagatgctctacgcagctgtgccatgcatgcattccatcttcattaggcttctgtactgtgcatgcacttcccctggctggaagcctctgcgtcctgaatgattcaatggggattgaatattagtactggatttgtgctttagttgtttctgacgaccagcgcgtcttgttcagatagagcagtaatagcttgtgaatacacacatgcatcaaccgagctcaccgagaacttgcactttgcggttatgatcgacatctgtactttttgcatatccacctgttttatgatgctaaatcatgactgggctgacatgatatgattgtatgcaatgtgttgattctccaaacactctaatatgtgttggctaggctacattatgtttctccatagctccgacattgttagttaatcaatcatgtttaactgtattttacattttttcttctttcttaaaaacctttgtattgtaatgtctggtcccttcttgaggattgcaaaggacaaacataacaagttaagtggtccttgatttctgatagatctacatctgaatatgctacaggccagccacgtcggcaccttttaaccacaggttggagtgcatttgttaacaagaagaagcttgtttctggggatgccgtactatttttgcggtaggccactcgatcattcagataattatcacatgttgacgatcttttctaaagattcttaatcaatctgcagaggtgatgatggggagctaagactgggagttcgccgtgcagctcagcttaaaaatgggtctgcttttccagcactttacaaccagtgttctaatcttggtacacttgccaatgttgcacatgcagtggctacagaaagtgtgttcaacatatactacaatcccaggtaatgaagaacctcgagttattttgttaatgctcccgacagctgatgttctagaactttcttgctgttggctggtggcagccttaaattgtgcccattatttactgcttgtttgagctatttgttgatagtcatacattatgccagctcagcatgtgcaatcacatggttttatctggttgcatttgtagtcttgctgaaattcgaagttaggcgctgttgcaatagcttggaaagttgtatttgtaggttgtaactgttctttttaaaacaaaagattatatgaacagaatcaatagtctcgtttcatatatttatcaatgtagtcgttttgcatttgatgctttacagagctagcgcctacttctgttcttgcaacaaaacagtgtcttatttcaaagctctcttctgaaatattgacaggttaagtcagtccgaattcattgtaccctactggaagttcatgaaaagcctcagccaaccattttctgttgggctgaggttcaaaatgagatatgaaagtgaagatgctactgaaagaaggtagatggacaatagttctacacttgtactagaatggactgaactgcattctagattggtgatgcatatgtgataacttataattttacaggtacaccgggataattactggaagtggtgatacagaccctatgtggcatggttcgaaatggaaatgtttgttggtaaactaccctatctcttgtgcctcgtaatatatgtttatgggcatctgctgtgtattcaattaacattttttttgtagtgttgctgccatttcactaattaaacccttgtttttttcctagtgccgcgtggcatttgcatcatgtggccatcttgacttgtttgtttggattatattttacatataacaagaatttgatgctaatcttggttcccaaatttgctagcatggaacccattcactctattaactgatgtagcagttgagctttagtttacatattactaaaacacagtttagttgtcttgatgcattttgtttcttatccaaactcaagtcagatagtagtgatttttcatgaactcaatctggaaagtaacaggttttcagataattgagcactgcggtactattacacaatgtcagcttacatggttatgttttcagagtgacagttgcactgactagcaagtttggttgctcacaataacagtcttagatttgaagatatcagttaatcttcctggtttgttttcaaaagtggtaatcttaacttgcaatttgacttccactagtagtttttgtagctagtctagagctgtgttctacactcagcctggtttcttcagcgaaatattaggtggatgaagttatggacactgctagcttgatcttcttttgaaattttaccttccaggagtacttaggcatgtgaaagtttttagactatggctctcctgagttaaaatttcaatttttgagcacataattctgttctcatggccacaccataagtcccgtaaaagccattattgcaatcagatcctctttatgaccatatgtatatgatttatcgacctatgtctaccttggtaggtgaggtgggatgacgacgctgagttccgtcgaccaaacagggtctctccttgggagattgagctgactagttcagtgtcaggatcccatttgtccacaccccattcaaagcgattgaaaccatgtcttccccatgttaatccagaatacatggttccacgtatgtctttcttctagctattaccagttaataggatggttctgttggatgcactgtgccgatttaatttatccttttgtcaggtggaggtggttgtcctgattttgcggaatctgcccaattccacaaggtcttgcaaggtcaagaattattgggttttaaatctcatggtggtactgctgctgctacttctcagccatgtgaagcaaggcatttacagtacatcgatgagcggagttgctccagcgatgcgagtaacagtatcctaggggttccaagacttggtgatagagcaccacttggaaacccaggattttcctaccattgctcaggctttggggagtctcacagactccaaaaggtcttgcaaggtcaagaattatttcgtccctaccgaggaactttggttgatgcgtctatgggtagtaatgggtttcatcaacaagatagtcctcgtgcaccaggtgtggtgaataaatggcaggcacaacttcatggccgtgctgcttttcatggaccaccagcactggctcttccatctcaatcatcatctccgccatctgtcctaatgtttcagcaagctaattcaaagatgcccaggttggagtttgggcatggacagttggacaagcacgagaatgataggcgtgttaggtttggtccttctgaaggaattgaaagaagagagcaaagaataccactccagccttatcctacttctggagaagtgatagatggacaggttacagttgagaagtctcactcccctggtcgacatggaaaggatggtccagataacaaagctgttggcacaaatagttgcaaaatatttggcatctctttgactgagaaggttccagcaagagaagaactagatgatggcgacgccaactattcactccagtctttgaagcaagtgccaaaatccctgggcaatagttgtgctaccgtgagtgttttatgatgagtaattttcatgcactcagtaatgtaaactgctttttaactaaaagctctgcaggttcatgagcaaaggcctgttgttggcagggtgattgatatttcaactatggatatgatgatctgatttatgagctggatttgcaaaattatctggaggtgaagtaacactaggattgcttccaaccacatgttagtgatactccaaaggcataaaatcctcacctgtgacagttttacctagaaatgttatgatcattgttttgccgttgttccagattttgctgtggatctccagatggtggccgagtatcagggagatggagggactgatgattctgatatttttatcttagatgtaggcgttggagcacttatcatgtgacatagtacctagctgctcgtctgcatttgttgcctctgcaactttaactgtcagcggcatttgtcgccgctggaaccatctaagtacgtgtttataagctgtaagctatgacaagcgcattagagggtgctggtactgttagaacattaattaatgtcagtagcatgctttgatcttacgtgatgcttttcctatgttgaccggagttcagtataacatgatggtggctttgggagacctcatgttttgaaaccttggtgctgatcgctgatttgtaactataaatttagttgtatttctaccacttagcttattaatttatcatcgtttccatcaactaaataagctcttaaaattatgcgaatcaagcctatgattcatgaagatataatgcggtataagagtttgggtggagtagaagaatacctctttggttttggaccacgtttcattccatcttttcctctgattctttctgcaacataaacgccggtcttcccaaaccacggcccagtttgttctattagctagttctctggctgttgtgattatttgtgtaccaagggtccataaatcatacataagcctgcactggaaacggacaattgaaaatggctcttcagaaactttgtttctccagcactgaatatatgagatttgagagagacagatacaatattggacctttactcacatcttgccgtgggagctgcccatgtttcattggctacaagtagtgcaaataatggttagaggggaacagaatcaacagatgctaagcagggccagatgatcagactgacgtagcaaccacattccccataaaacataccaaatacaacagcaaaagtttaaatttgtccctagctacaataattatccaaaagggcagtcattttctagagcttcattcattgctgtcatcctcgtcgtcagttaaatcctctatgttttcagcgtctggagcagaaggccctgacgagcgtaattcatcgatttcaacctggaggagggaatcacaggtaacccttcctacttgtaagactcttgggcaacctggttgaacatacaatctgaaatgagcatccgtgaaaagaaaataaacaatgaggcagcgaacaaatgacctacctgcgatagggcacttcggaggtttttggtttcttatgtaatgcataattggaactttttcatatatgtgcctacaatccgcactgaacaacacaaatagccttgagttcaacgcaaaaactgaatatctgcaaatatatgttcacactgctttctacatgcaacaacttaggagaaatccatttgactgagaaaaataagcaaattaagtagtaggagtttccgatttgaattcaattatgtgaatagtaaaactgtagaaagaccttacatacaggggaatgattagtttgaatcatgcctaatagtcaaattggctgaaaggattgtactggtagaaaccgcactatttctgcccccagaaagctatacactattatactttgaacacaatgatgattattcagtgacaacagcaaacttgttctactgcatggaattttcacagaaagacaagccattgttaccgcaagatgcaaaccatatggagaaggaaacagatcctgatgatctcaacttgggcagcaaaagaaaattggagaaacataatcctaaggctttgcgacatgttatttgtgccaacaaaaacttggtctttagcaggtgaaatcagattaatgatggatattttttgggacattaagttgtgcttaaaaacaaaatgagagtatgtgttctttgaacaaccatgaaggaaactatctagcatatgtaacatatcataataaaaatttcctagagttacaaaacaaaaccatgccttaacagtttaactgcttaacacttaccaccgaactggctctgtcaattgaattacaggcttcccagttaatgggcacgtgacatttaagatgctagtttgggtactggtcataagaacatcctcctgttcatcaccaggcattggttggccagcatggtgaacattctgtagaagacaacacaattacagagagagaaaataattagaagtaatgcacaaaccttttactttctccaaacatgacctattggagataccatactaaaaattgcagtcatttcaatccatctttaatgtaacattttcagcaatagttcagcaccgagctaactcagtgaatatataggcaaaaaagtacataatccataccgttctcaacagccattagcactaagggagaattaacatttgtaaattcctctaattcctgatctaccgcatagaaaattgccaagtctctcaaaacacaaagggtccacggaacatacccaaactgcctctctgaactgccgaatgagcagatggttctctactgatgttgatgagttccccttgaccttgttaacctcagcctcgatcagcttttcgaaatccgtcatcttgacacaaattcagtgatcaataccaaaacaacaaataaccatttagccgaaattcctccaatacaattcgaataagcccctgaaaccaaaaaaataatcatcgcggctaccagagtccgcacctgattagatggctggtacgccccaggcaccttccggatcgcgtcggcgtagcacgtgcaatcttcgcacgaagcaaccagttccagcgccgccgcctcaagctgcttcacctgcaaaagaggataacgatggtggttatgggtttagggtttccgcggcacaacgccgcgtgaggttaatgtggggggagaggccgcgtgccttgtcggacttgttctccctctcgtaatcgacggcgatggacttcatttcgccgatcgccttgcgaatctcctgtgggttttggggggggattcgatgagattgctagggttttgggggtttagcggagagcgggcagccgagtggggattcttaccgcgataagggtttccgcctccgacgactccctctcggcggcgttagtgagcttgttgaccaccgacgacatctccggcgaccggcggcgatctccgccgcgcccgctttcccgcgatttggttttggttttggttttcgagggaaagagaaagccgtcaggtggatgggtactggaggatttgagcctttatatcttgtggatttgtagcccatgaaatattttgctgggctagagggcccggccagtcaactagcccagctaatggtagaaatactttgagcccaagttagctttctctctttcttttttttgcagggaggctcaagttaaccttcagaaattactttgggagttttttggtagcaccacatcttggattaaatcgtcttttaacaaacagtacaaacgcagatcatagaacgtgcgtacgctcacccttatgaacacgcgcacaacctacctctatgagcatctcctaaagactgaaccggtatatcttgaaatcgacgaagtcatcacgagcgtctcgccatcgatagatacgtcgtctaccactgaaataataattaaccgtaaatcgttgtgatcttcaattcacttacaaactactagtgagcgaaatcatgtgaagttggcattggcaagaagttatatcaactgcaccgtaaaaattatcgaattttggccagtaggaaaatgtttgatccttggcactaatcaaactgtagtagcaacaggattccgcacctataactctgttgcaattcgagatgacaaaaacatcgacaaatctgatggtcaattcaagcaatcctcaatccagtggggcaaacctagccaaaccgagatgctctcttgtataacaagctcagaatatttgatggtaatttaacccagtttgaagtttgaacgagttctagtagatttgtggggctacacttggtgacttggagtaaatttcataaggtgataccgatttcaatttgaaccaggcattagcaaggcaatacgcagcaattcatcatgtgccataataaaattcagcagttctgcctgcctgacctaaagccttggatctgaacgttctgaactgacatgtcattcatgtggccacctgcgactgcatcttgcctgcaggctggacaagcatatggatcccaaccttcctatgcagcaagcgggcgtccatggctaggaattcagagccctccagcatgtggacgaaccacttgtcgatgtagatgtaatcagtatactccaattgcatggcaagcattgaagaacagacagaagccatgggggcgatgaaaattgctgccgcttcacgcattcgaaaaataaacccacggatattgacttcaggtcatacaagatgctcatacttagttcagtatacataatttattagtttacagtgtaactgataagagaaaagaaaaagaaattagtgtgatcaattaacatttctcagtgaagtttgaactgtcgagaaaagaaatcaattgattctagaactttcttgcaaagatcctcttaatttaatcagaacggcaattctgtatttagtgcaacttgtcatatgaaattctgaatgccagccagcaaagagcccaaattgagtggggtccggtcaactaacctaacctacagaacatcaaatgaaactgcaacgaattttttaattaattgtaaacaataccggcctaattacccacgtaaatttcactgcaaatcacgctaccgtttctgtattctgaaggcaacggctactctcagtctcagctcttgtcgtatgctattgcaatctgcaacaagtcgcataatcaacggctgcttctgactgaatccaattcttttactcgtgtaggttcagacttcagaaagcagaatttcatcagcgcagagatgcgtgatcatcgtcgccctgatgctgccacgacgaatccttaggagaaaaaccgcagtgatcgattcgagttagtttacgcaggtcaaggagagatcttacaatcttagaagaaatgaagcccacatgatgatactctcagagactaaagaatggaagattggatttgtgcacagtggtcacccatgtacagtacagaatcccattaacccagtagaacatcgcgttgattttgtggctgcattggagcaccaaaccatcctacaaacacaagtgtttttcttaatagtactactactgtgcctttgaatttttttagtgattttccagttcataaggagatactggtatgtactatatttttcgtgtaaaaatttgatacctctcggtattttcggactaggagatactaaattttacattacctctcaatacctccggtactaagagataccaaattttagagaccttttacagtgtttgcaaggtacttagagatattgagaggtgaaacaatgtgaaccattgattaagaggattaaaagaggggcaagtatggaataaaattttcataactaatagcaatggagtaatcaactactaaacgatgagcattttgagtgaatcgaatacctggatccaatcaccagtattgttaggtagaaaacaaagtaaatctttcgaacaatttaatgcatcgatcgatctgcagttctacatcggaaaaaaaaaagagatcgacgcctcctttcttcgaccctttggcttagttcttgttctagggtttgaattggtccactagaagaggacaaagggagaaatatcagcatagttgagggttcaagatggaccaattgacggctaggcgcaatcgcatcagataagatctactctgctcctatactatttacacaattgattcgttatttacatagttaataaattccttcgtataaggaactaaaatgagatctcctatgtttttcttctagggtttgaataggcgaacatgtaaggagacatggttgagagagagaagctctaatatcttgttggttaatctgacatagcatgttcagatggatgcaatcattaggtatattttctctacagtttatgttttccatgaatgtaaaacttaaatcggcgtaacccttgagttatattttaatgttcttgggaacaaaatataaatctcaaaataactatgcaaataatgtaatggagaattaatgggaagagttctaccatgttcttgggatcaaaatgtaaatctatagaaaaccacgtaaatgagaactttaatactagtaccacacaaacaacttaactggtaccgacacggtaccgatctgaatttgcggacaactctttcctttcctctctactagcaaatttatctttttacttggtacctgagtgcctatgccaatactcaaataccatagtacattttattatggagtgttggatctttactctttttgaatgcaaacaccataaaaggttagtatctcttaaatactataaaatttctttttgttttttgtttttttggaaaatagaatttgccatgcgacaaactttaacatagttttgcatcttgcgcgttacacatcggaaatactagcatggcactaagtacagaggccggagatgtattactcatttttccatcatcttagtgcatttcattttaagaaaagctgtgtgctgctgtgaactagaaagctgaagaaccattatcgaaaaaagaaagctgaagaacacccctagcacctggctttattctgaagtgcgcatgggctcaatagcacacactcatatgatcatatcgtccaaatttcaattcgctggagagattctctccgtcgcaaatgggcaatataataaaaatcacaagaattattcccgtagctggaacggttggctcaaacgaactcctgtctttctcttcagtgtccagctctccatgatgatgagcgagtacatatacatacagttgtatgctgttcctgaaaattacctgctcaatcaatcatggcgcatcatctcgtcgtcgtgctcgctgcgaagcgtacgaacggatgctgacaaggaccaaccattagagtgaccatccccgttttgtgtcggtagatgatgctagctgccgttggagctggaagtttgtctgaaatctagaattgagctcatctcagaattgtgctagttgtcgatttcgaatcgtgcaagcctgaatgtctgaaactctgaaatgcatggctcctgaaacctctgcagttaaccgttgctctgcagacagatgactgacaattagcagtagataaaaacgcatttgctgcttatcctacagtaacacactgatttgcaagttgatgtgttttctgatggatcatgtgagctgcgaaccgttgatctgtgcaaaaaaccgcagactttcctgtgcgagctctgtccaattgccgaccgagcgaattcagtgagctgcatgcgtggcgtgcgtgcagttgaatttgcccaggaaagctcatcgaattcgctcccatgggggcagagaagcatcccatgtgcgatacatctgaaaaaaattgagttcaaaactcgagtggtttgatctgtcatgctaactaagccgatctgcatcttgaaatctgctgcaccttggaggagaaaacaaataccaaaaacagtactgaaaatttgcgattgattcccttcctgatctatgctcctgaccactactatcatctcgtctcgtcagtcaaatcatcatttggtcaacactaatgacagactgttcatccatccacgtcggctcgcacatgccgacagctacaaatgcagctcgatcttgggatataaataacggcatctcgtttgccgttgatctgtcttagctaactacttcacactagtgagaacagagctgagctgagagcaatggcgatggtggcgaggaggttcttggtggcggcggcggctgtgtgcctggcgctggcggcggtgccggcggcgatggggcaggcggcggcgccggcgccgaagggggcggcggcggcggcgctgaacgtgacggcgatcctggagaagggcgggtcgtacacgacgttcatccggctgatgaagagcacgcagcaggacacgcagctgaacagccagctgaacggcacgtccaccggcttcaccgtgttcgcccccaccgacggcgcgttcagcagcctcaagcccggcacgctcaactccctgtcggcgcaggaccaggtgtcgctggtgcaggcgcacatcgtccccaagttctactccatggacgccttcgacacggggagcaacccggtgcgcacccaggcgtccggcggcgacggtccctacacgctcaacatcaccgccacctccaccaaccaggtcaacgtctccaccggcgtcgtcgacaccacgctcggcaccgcgctgcgcgccgaccagccgctcgccgtttactccgtcgacaaggtgctcctcccgtacgcgctgttcggccccaagccgccgccgtccccgccgccggcgcccagcaagaagccggccaagggggacaccagcgcgtccgcggaggcgcccgctggctccgccgaccaccctgccggcgccgcccccgccgccgccagggccgccgggtggggcgtggctgccttgctggccgccgcttgcctcttgtaagatgagaaattcgtgtcggtgcatatgagatcagaggctactactggctgagtgcatgatgcatttcaagagtagttcttgctgcaacttaaactactcctcttcctctccttattcttctctctctccttgtgattgaacaaatttatccagtggttttgaagagtggatgacgaaatgcagtcgaaatgtttttctgtacattttcgtaaaaaatctacgtagatcttcgatctgtaatattttaccagagtaggtgactagatcgaacaagcatttttagcggtccaagcttaccaataaaaatggcatgttgcatttgggccaaaatgggctgcatttggacctgatcatccttaaccagcccaagattatcatgggcccattgggccaaacgaatttagcaaggcctcaaggctctcaactctatcaatctagtgcaaactgggccaagctggatatatgtatcactacggccctgtttagaggagtttttagttgctgcagctttttttagaatctcctaaaacagtctagcttttgattcaggttctaagaagctgtagttgtagaatcaagaaaatgaactagaaaccagaagctgggcttttctaaattctcagaaactggttatcaacttctttgaatcttaaactcctctaaacaggtcctatgtctggctcgtttatttcgtgatttttttgcatggaatgcgattaagaaaagacaaacggatttggtgccaagcacaagcatgttccggtgagcagtcaatttctcgatctctcgctgttcctggtctggaaattgaagcttccccttggctagctagctggaaattcaatttggtttttagttcaagtggcgacgtatgggtgctcgcctgtccatccgacaacaatgcaaattattttattctcgcatctctcgcgccatcaagatctatctatctagcatcagatgttttacgtgcttaaaaagtgaaggaaaacgcatctagcttagctggtgataccttcttaaacactcgtcgtgttccttaaaaaatcatttgtagaacgcctcatctaccaatggaccaatggagcaccggagtcggagaagaagctaaaaatactcaccaaattaatcgacgcggccggatggatggatggatggatggatcgggtgtcgcttccgagccgctgcgccgtcgcagtcgccaatatctcttccttctttctgatcgtctgcatgctggtgattgaccgggttcacgtatgtatctacaagattcggcaataaggccaagaaaagtatagtacttctgctgcaactgcgtgaatgcccgggtgtgtacaaggaggtagaggttctgataaacagctggtgccaaatggcaactacttcccccattctaaaatacactccctgtgttttataatgaaagattttctagcatacccatatttatatagatgttaatgaatctatacgtatatgaatatgagtaatgctagaaagtcttacattgtgaaacggaggaagtaagtgttttttttaacttcgacacaatttttagatgttattttcactaacaatatcttttaaagtaagatgttttaaataaaaagagttattgatctttttatatttttaccattaatagtcaaaataaaaaatggttaacttacactatttctaaaaatatttacattttagaacatatagagtagctagtaagaattatatagttcttactagctagctagctacttatatagttctttcaacttgtcttacatagttctttcatggattctaggatgattttataggagaagttacaaaccagaagctatcttaaacaggattaagtttgctttaatgtggaacagattctggtgatcagatattaaactgctagctagctgcatactgtcttatttgtatgagaactccattgatcaacggcacagtgacagtatacactacacccatcatgttctcatcggttgaaccgctactgatacatataaaaaaaatcagcacagttgcattgattatttgatttgattaattatgtatggttcaactctctcctggaagttgaagtggagtagtttcatattgcaagtctcgcacgtcagaaacgttgcggaggcactgtcaaacgatcaatatttcgacagggacggccagcttgcagtagaactacaactatactgtcggtggcaaacttcttccagttttgtatatatgacactgcatgattagcatacatataaaattctagtgatagattctttgctctctgatgttgaaaattgcagtgataatgtatataatcatggggccaacatgtacatatatgaactgaatgaatgcatgcatgcatgcatggtttgtggcccaacctaactggaatgcacatttcctgaatatacaagatgaacagacgacaaaatgttgagactgatcatatcattcatttgtatgtagtacaggtcacacctaataataatatcaaattgtaggcatcttgggtactttgatacagttggttttgtacatcaaagaagatattcgatcaagtttctggcagttaaaacatcgccctcgagaggtgcctccccggccgagactacttaccacggccgccaaatgcatacacactgcaaaaaaaaaaaaaaaatctcgtagtgcaggggaatgcaaactggtgtgcaatcatccagtgaaatttttgttctggtcgtgtgtgaaatttagatcgaaaggaatcaaagagtttttagcacaaagagacatccgctacgagcctatatattcgcaaaattaaggaggcaaccacatggatgttggcatggaaaaaatggcctactttatggacgtatttttttattttgtcctgtatataactgtattcaataaaatataacaagtcatgtgtgaaatttagaatgcaaggaatcaaagagtttttagcacaaagagacatccactacgagcttatatattcgcaaatttacgaggaggcaaccacatggatgttggcatgaacaaaaatggctttactttgtcctgtatttcactgtattcaatgaaatagaagaatctccaatctctgtcgtattgatttttttaagagaaaagggtatttttttacctggcctttttaaattaagaacttagcttttaaataatccaatctaaaattcgcttctataaagatttgaattcaagatcttggagtgctactcagggtactgtaaccactatgctacatgccatgtaaccactatgctacatgccatagtattgatatctagtgaagaatgtgaaataaacctgcaaatgtgcaatggaatgaaaatgttgtagcatttgctggcttcacttgggttcaggtagctcgcaaatcacatctaagctcacgcaataaactaaaaaaagaaaaagagaagagaagaaaagaaaagttggctatgattatgaaatgagcctcgctgcctttgctgttccaggcccacgtccagctcaccacctcaccttgatcgctcactcacactcgctcacacacacactctccctcgccaccaaccacactataagtctattaaacacgcactgctcccagctctcagatcgccgcctccaccaccgttcgtccgattcctcgccaccacacccacccacccaccaatggcgtcctcccgcctcctcctcctcgccgcgctgctcgccacggcggcggtgctggcggcgtcgcagaagccgaaggccgccacgccgacgaaggccacgccggcgtcgcccggccccgcggcggcggcggccgacggccccgcgccgacgaacgtgacggcagtgctggagaagtccggcaagtacaccaccttcctccggctcctccacgagagccgggtggacacccagatcaacagccagctgatggacagctacaacgggctgaccatgttcgcgcccacggacgccgcgttcgcggcgctcaagccgggcacgctcaactcgctgtcgtcgcaggaccagatccagctgatgctctactgcgtgctcccgcggttctacagcctcgccatgctcaccaccctcggcggccccgtgaacacgcaggcgtccggcgccgacggcccgtacaagtacaagatcaagccgtcgaacaacaacgtcaacatctccaccggcgtcaactgggcgctgctctccaccgtcgtcagcaaggacttccccctcgccgtctactccgtcgacaaggtgccgctcccctacgagctgttcggccccaagccgcccacgcccgcgccggcgccggcgcccgcgccgtccaagtccaagaccaagaagcacaagaagtccgccgggatcgccgagccgcccgtcgccgacgacgcctccgccgacgacaccaccaagaaggccgccgcgcccgccaccgccgtctccaggtgggtcgtcgccgccgccggtgtcttggccggcgccattctcgccgccctttaagctaaggagacgacgacgacgacgaacaaatgcatcgcccatgcatgccgtatgcacgatgactgaactggagtggtgaaccgaatccgaatccgaattgatcgagatcgattgaaccgtgtaccgatattgttgtgctgctctgtagtctagcttttgattcaggttctaagaagctgtagttgtagaatcaagaaaatgaactagaaaccagaagctgggcttttctaaattctcagaaactggttatcaacttctttgaatcttaaannnnnnnnnnnnnnnnnnnnnnnnnnnnnnnnnnnnnnnnnaaggcgctatctcagnnttacaaagcccagtc

SEQ ID NO: 81954 - DNA, 35690 bp, Oryza sativa
tgactattttttcatttcccaaataagtctttatatttgtgagcacaaaatatagagctgctgtataataatttattttattagtcataacacattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatgtaaacagcatttataaatattacatgactttaaatgggaaagccataaacagctaacttgtacagctaatcaagatctacaacttttattttggtcacttcttcatctgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagatcttgatgagaggatcaactttgttgttgaccatatttccatttgaaatcatttagtatttacaaatgttgattatatttgtcatattgtcaaaatcaatttcaagctgttagaaacaaagttatatagataaatgaccgaaataaaagttgtagatcttgataacctctacaattttgttgttgaccatatttcgatttgaaatcatttactatccgaaagtgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcccgtcacagatgagtcatccgtgacgggcctgaatgtcatctcaatcggacattagtatggagcccgtcaccgatgagtcatctgtgacgggctctacgacaaagcccgattgagatgactcatcactctaatataactagggtttctcagatcggatcgaaaatttttctaagtcccgctacagtttcccacctccttagaaccctagcgccaccgtcatcctccctcgccaagcccgccaccgtcgccaccgagcccgccgccgccgcagtcgtcctccctcgccaagcctgccgccgtcaccaccgagcctcctcggccctccattcggacctccaccgccgagcctcctcaccgacgaccccccccccccgagcccgccgccgccgccaccgaggctttacaccgaccggaccggtgttggccttcctcgtcgtcgccgctcgcgtcctcaccgacccatgtcgccgacccccaccgagcatgacgccgcccgcccggtgccgacctgcccaatcggcgtctccaccgaccggcgccgccctccaccgagcccgggcgccgccgccaccgagccccaccggccatcctcaggtgagtcctccatcgcgccgccctctgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtggttcatttaactttatttatatgcaatgcggttcatgttgggatgaaatgtggtttatttatgttgggatgaaatgtggtttattcatgttgggatgaaatgtggtttattcatgttgggatgaaatgtggtttatttatgttgggatgaaatgtggtgcattaatgaaattattgtgaaatatggttaatagattgtaatagattgtagcactcaattgtgttttttttgtttttttggaaaaaagtagacaatgtctcagcaaggcgaaccaatgtcgacgacaactagtgggtcctcaagggcacgtactcctaggacagggaacaaaattcctaaggaacggttccgcataacaacggtggacgccgtagggttgccgacatctccaaggaaaatattgagccgatttatgtctatctgcggggtcatagggaggcagaaattcagtattctgcaagacgacttcaagctcgtgccggccgcagagaaggacattgcttggctaacgttcaaggagagctttgattatcctgcggagcatgaggaccgtctcaggcgggctgctttcaaggttatgggcactgcttggaagaacttcaagactaagctagtcagcgagttcgtctacaacccggcaaatccagatccaagagagaaatttccttggatcacggaacaggtctgggaggaattccatgcgaagaagtcgagccccgagtccagagctagaagcgaggcatatcgcttgctccagaccaggaaccagcatccgcaccggcttggtaccgccggatatgccggtaaggaagaggaatggcagcgtgaggatgaagaagcggaggaatcgtgcaccggcttggtaccgctcgtgtttggcgatatcccacaccctcgggctaggaactgggccagggctaggtaccagaaacatgatgatggcacgatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaaacgttgggcaacaaggaacaccgtggacggacacggggcgttgggtcttctgttctctggaaatatggatttccagactacgcgtggcagtacaagaagcggacttccaacaaggtggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaacacagcagttgcgcatcaactgagttggtggaaaatccaacatcggtcgacatcgccgtcgaccacataacggtaaccgtgaacttactcaatacatgaaagatgtaacgaatccatatgatatataatattctaaaaaaattgattaatctatcgcaggaaccaacgagctgcacctcacagttagggtgatgccgaccttcactgttccagcagccgagggacttgcgtacaagccgaccccagagacaagagtgcatggagcgcaactcagggccgactgtgcaaaagttcaagtcgacttggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcggtcgtccaccaaagagactgtcacgccccgaactagtcccgagcggaactagcccgtgacgctccaaattaacctgttaatcgataccaatcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacaggcacgacttgggaactaggccgaaaccctaaaactcatcgtagccggcttgctcctggaagaactcctcgtcagcgggatccgcttcatcttcttcagcaactaggggggattatttatatagagcaagggtgagtacgggagtactcagcaagccatgggaaataagtgtttaatgcaggcttcaaagaaaggctgttgtttttgcaattgattttatttgaactcttttctgaaacaactaagtgagtgcttctcaaacgacacggatgagatagtgcgtctcgtccggtcggagtatgtgcaatgtatcagtcttttgaattgatcaagattggcacccggccaacagctttcaaacggccacccgggcctggctgatcccattagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggtacactttacccacacgacattactaacccggatcatccagcccgtgcagaacggccacgactagagaccttaaggctttcatgacaaggcatttcgaaagccgacacaggttcaccatatgccaacgagagggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcatgtgttcggatgaaattccaaggaaacggtccttaagtgcaagagcgggaaaccgtacacccgatacgttccccggtccgcgattttggaaattcatttagttcgcaagcaccgactcaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccaccaatctgccttgcagacaggacaagcagattaagtgcgatcctatcaatgcataatatttttcaagcaacataattaagttcaaatataggctcaagatgttcaaaggtggcttgcctcgctcgagatcttgagtttgatcctcgaaatcctcgcactgcgggtcttcgagctccgaaactacacgcgaaacgggacaactcagcaaacggcgaaaataaagccctattattgacctctaagcgtgccattagatagatctcgagatttgagaaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcacggcccgagagaaaggggcggctcggctgagcttaatgggccggccggcccaagaaggcggcccaaggcgcgcgcgcgggcggggaggggagagagaaagccggtgggccgggtccatcccgcgtggtcccgggtgggacccgcttgtcggcgactcggctcaccgtgagcgaggtgcacgcggggcatgctagggtttggggagggaggcgcggcgcatgcgcgcggttcgcggaggacacggtgcggcgggcccacgcgcagcctcacggctcgcggtggaccgcgcgcgcgagggggcggagggaagcagcggaccggggtctgcttgacccggtcgcggccgaggtggcgccgacgtggcgcctacgtggctgccacgcgggccggcgggaggtagacgatgacgccggccggaacggacggcggacgacggcggcgagcggcggagcgaaccatggcaatacaggcgaagacgagcacaccgggatgttgcacaggacgaggggagacgagccaatggctcggattcgccgggggacgctcgacggcggcggattgcggcggcggcaactggcggcgggaggagggggaaacggcgatgaggttacgatgggccgattcccggcggcgagagcatctacgcggctacgggaacccaccccttgcgccggattaggaggaatcgcatcgagggaggccggcgacgagaggcgctttcgagctcgggcggcgacggcggcgagcacacggcgagcgatggcagcagtcggggcggcgtcggctagctacggggaggctacacatgctactaccgaaaactaaggggaagagatggattgaggagggagaacggggagatgcactaccgtgcggacggggagcagtgacgacgggccgacggcacgggagcgatctctccggcctcgggccggggaagaggaaggagagggtgcgtccggagtccccttccgcgtcctaacgcgcaccgactccttcggcacacgtgacggcggcggtcggcgatcggcgagacaaaggggacggcaatggcgcgggcgaaaaacggggaagattgggaggggaaaaggaagggagggcgcctgggtttatagggtggcgatgtcggtttggaaaccgaccttgggcggtcaagggagggagctcgcgctcggcggtcgcggccaaagcggcgacagggggggaaggatgacgccggcgggagggaaaagggaaaaagggggagagaaagggggcttgcctccttgccactttggggaaaaggaggagggagagggggcgatgcggcagagggggggctcagcctccgtcccttggaagccagcgcgcggcggtggcggggctgggttgatgacgacggcgatgacggcggaccggtttggagtggagcggcgacacgggcggcagacgaggggcaggtgcggcaggagctgacggcggcggcgactggccggtcggccaccacggcgcgcgcgcatgcgggcggctcggcgatttgggcggcatcgacgggaatggcagcgagagcgggagggagggctcggcgcggctcacggcagagcagggagagagagagagagagagagagagagagccggggagggagggggagatgggccgagagagattcggcccatcgaacccgagggaggcaaaatagacttttgtggagggatttgatttgggaaggatttggattcgggattgaactcgacgatagatcggggatttgagatctgagatggcacggacactagacaacaagcaaagaaacagatttcgcaactagggtttttaagagatagttttcccgctaggcaccacgacggaacgggcgctacagagacccgcctctgctccttcagcccctcctgctcaagatcgtcatgcacaatcttacgatgtgcagttgcagtacgacacggattttggggaggatcgaacggaggccgacagcaaggcgattcatgaacccccaccgatgaagaagagcaggaaagcacactcttcccctcagagaattactctcgataaacccgaagcaaaggggagaggaaggggaggaaaggtgcaggcctcgcttctagctccaagaaagctagatctaggcaaggaccaggaagagactaagggcaaagaggtcaagaagaaatatgtcgctccacaggagttccaactaggcatgccattggttggagatgacgtgcttgccgctatgggcaccgcttgcaaggaccttcacttatactacatggagaaatctaacgccaggaagccaagtaaagctaccgatatccttggacagcacgatggaaagccattccttggtccaataaattatatcgtggtcgacttcaaggatcttttcgacctctacaggctctgagcggtggacacaagcctccttaagtgctactccttgtaagtattgtcgcccaactcattctggtaataacaatcggtttaacttgcttacaagatcattgatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattagaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgcgacttctgtattgagaaaaggtgaagactttggctgagtttgaggtcagtggtctcaattgtgatagactaactacattttagtacttatatatgatcgatcaactaatctggaattatgacaatgtagggcacaataaccaagtctctgactaccagctttgaggaggttcgcgaggagataaccagcttcatcctccgcgaaataattaaccccaaaggaatgtttaggcttaaactaaaatgatgaacaatgttgaacttctatgtttaggcaatgatgaacacttattatgcaactgtgatgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgtcatttttgcagcgggcatggctagcaaaggcctgaggctagccaaaaaacaaaatttattttttttgtggattatagtcatctgtgacggaccataactaaatgcccgattgagatgaggtcatctgtgacgggctctagcttaggcccgattgaggtcagcagtcatctgtgacgggctctagtttaggcccgattgaggtcagcagtcatctgtgacgggctctagtttaggtccgattgaggtcagcagtcatctgtgacgggctctagtttaggcccgattgaggtcatcagtcatctatgacaggctatagtttaggcccgattgagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagttaactcttcacatcagtgacttctagcctgtgacggacgctgtgcccgattgagatggggcttaccgcccgattgagatgagggtatccgttctagtgagccaaaattgagtgatggtgaaaacaatgaacattaaacctataaatcagttttaaaattcagaattagctgcaacttgtaagcctcaggttaaacaagccctcaagttttataaacaatagatcagatgaggaagaaagctccgaagttaattattaagttaaagtagatcttagcatcacaaaaaattgaggcttttggaatacatgttaggaaaaacgtagagacatttaaaaaaaaacaagaattgaaatcatatccaagacgttgaactccttgtttatttttccatgaaatcgagctataggaacgtgcaatcctacaactttttttcctttcctttcccacgagctactgggatcagtaggaaaattctttcgaaagttgaatcctataaaaaaatttatgccaatcctctattcacttgaggctccgtggacagaagatatatactcccttcgattgcataggtaagggcatccacaatgtgcatttaaagtgggtagtaagcaataaaatactactactaacaggttgtatatattgtaagagtagtaagtaactaataccaggtaatatgcttactacctagtcataaggaataaacaaataatttctctcatctttctctcatggctagtgatggtggggtccagcttactacccacttttgttctttcaccattgtggctacaacaacagctaatacccactgatgcagggctcactcttatacacaaagtaggtagtaaacattggtgatgccctaagtcgtattaggagtttaggacttatacacctgtagatgcaagcatacagtacagaaacgacacagctggtgattctcagcctaatagctcgcttgcacgtgtgtcggtgcctgtacggagaggctgtgctgttccatcgtacgtacggaaacgtactgccggtgccagctcgactaggcccagtttgaagattattcactattactggtacattattatggccgattggcgattatctatctatctaattatgtggataaattaaattcttttttttagtaatggaatagaatccgcggcctttgcttaacgtgttacagccaattattataacaattcatccaaacacaaacatacctcaacaagtcataaagaacacgctttaataaacagaagcacacaccaactcctaaacaccaacacaagagcaagaccacattattattgaatcctatttttaacctccatccaaagttggcgagaaactgcatagctgttgactcaagattataacatgcagctttaagaaaatattttagaaaatggtaacaaacagttaagaaaaatggtttaaacaatactccctttgtccctaataaaatcaaaccctagaatctcaagaaactattaaggaaagaaacaaaaaaccaaattacccttaattaatgtaaaatttgtattggttgatgagcaggtgaggggtattgaagtaataaaatttctcgatttgcatattagtggcaggtaagaaggtaggagttggtttattttgggacaaatcaaaccgtagaagttggtttattttgggacagagggagtatagtagaagatttttttagggatgctatataacgcgggatgataccagttaggtatcaagtccggtattgggtgatacctattaggtatcaagtgattctaccacgtttcaggtgatacttgcgaggtatcaggtgatacctatcagttatcatgcaattcttgccacatagaaggtgatacttgtgaggtatcaggtgatacctatcaggtattaggcgatacctatcaggtgatacttgcgatgtatcattaggtatcacgcgttacatacctgacatcgacgccgacgaccactgccgccccagcgccccttcctccctagctccggccaccgccgccgatccctcctccgccggctccggcgccgcaccaccgccaccccctccttcccccggatccggctccggccaccgtcgctgctcccttcactggctccggccaccgtcgccgctccctcccctgtctccggccaccggcgcgctccctccctcggctcgggccaccgccgccgttctctccctcggctccggcaaccaccaccgccctcttcctcgactctctggctccggccaccgccgccgccccatccccctactctctagctccagccactggcgcctcagctccggccactgccgtcgctctctccctcagctccggctaccaccaccgccccctcccccagctctctggcttcggccaccgccgccactctccccccgccaccggctcggccattgtgccacgtgctcttgcggctgatggaggtgaaggggaagctatcctgttggggcaacggtatcctgtccccttgcatttcagtttttttttaagaaaacgtacttttagaaatgtcgagtaaataaaccgtggtaataatctagtgaagtggtcgaaaacaacaccttaattagtagctagccggcaagctggcggtgctaattgaatatagcccatcacctcctctgtgtccccttgaccaacagcaccatgcatcatcatcaccttctctgtatttttcaactcaaacaagatcgagttgtaaaaccgcaaagtctggactattaatgttatattagggaggcaacaggaagaaattaatacacacagagagagagatcatgccatgtcttatctagggatcttgtgtttttcagatgtcaccatccaattgttatggacaaaagctttgatgggacaaatcaaaatggtgtcataaatcactttcaagagatcatcttgtacctcaaggttaactggctgataatatatagtagtatgaagaaatggtcatggagagagaggaggaagagttgttgttgttgcaaccttttcttgatctcctttattacctaagctaagctaggagttcttctagcttgcacatggcaagagattgttgcccttggccctacacaaaagattcaaccgccaacagatggtgatctctccttctgtcaccgatgcagacctggataaaataatgttggggatcagacgatctcggttagcccaaatgcctctccttgatgtgaagtgtcggcaaaatgcttttgcaagagtgtttgataacataaaacttttgcaagcaacagtgtgcaaaaaatgccagctaggtaaaagaaaacatagatttcaaacataaataattcctttaacgtaatatgtgtggatggcaggatgggattagttccaataggacagtaaagagcacatattggaaacacccgtaatttttttattaagcatgggattagttaccgggcaatattggagaatactatcgcaaagatttttaagttggaaaataccattgcatatgttaatgacacgtgggtccaacttatacatctttgcgatggtacttttaaatttttttaccacctgaagagggaataaacaaactagaggcaaaagtcagaatagaccagccatcggttggcaccacatctctctctctctaagggcctgttcactttgatgccaaaaaaaaccttaccaaattttggcattgccaaaatttcgacaagttgccaaaattttgacaactataccaaaattttagcaggatttcttattaagttaccaaaatttgatagcaaactaaatgtagccacttttttagcaactttaccaaaatttgataaggttgaaaatggcatcaaagtgaacaggccctaaattccttcggaatgcttcaaggatgactagtgtgaattgtgaaagcttcttaatccatgcttgcatgtcataagctcatagctagtaatctaaatgttgttatatataaatacaatttttaactcaccgaaattgtcagtgaccttttttttccatttgacaccactgggatggccccaagttttgctttgttatttataggcttgaggagatttgaggcaagctgccctcagctcttgcaacctttccttccttctattctatggctatggccctatttatgtttggctgctcctgaatctcctcctattgcccttctgtctcacatccctgtctcataattaaagtcataattaaggagcttctctaaggtgattgggacttgttgcagggatcaggaggaaaacaacaaggtagagctctctgttcttgattcttgttgtcttttgtttttctgttcatatgttgtgcagattataacattctatatgttgagggggaaaaaagaagggaaagagatgattggtgcattttgggaacaggtttggtgctttcatgaagaaacaagaaattggatgtgtgaatgtgttcttgcttagtttttttatgctctctttcccttgattttcttcagttcttgcatgattgcatcttgttatgttgctcatttgtcctatcatgggatgttttcttgaacaaatatatactatcaagaaagaatgaaaaggtgttcttcaaaaaaaaaatgaatgaacaaggaacatgaaatttgttctgaaaatgtcaaattctttccctggaacttacatttgatgcccattaaaaattagctttgatctgcacaggataacttaaattttggattaacaacaagaggaagtggatcaaccagacaagaggaaaacgtgcaaacaagacaggcttgcaacatcaccttgagtccaaagccaagaaagatggggctgtcaatctcatacccaccagacgactacctgccagcaatggaggacaacatgggcaggctgttcatccggtccctcagcttcgacgacgacatggaggccgccgccgatgactcgccgtcgacatcaccgatgccatcaccgtcggcgacattgctgccggcattcggctccggggggaagctgatcatagagggctccctgagcttcaagagaagagaggctgacccggttcagatggagaccatgatatccatcaggagtcccaagtctgacaaggagagctgcagcagcaagccaaatgctactgctggtgcatcgagatttgcgcttgccggagaccagacaccggaggattctccggtgatcgccggagttgccagccccaagcaccaggcagcggctgtcaggctgcagaaggtgtacaagagcttcaggacaagaaggcagctcgcagattgcgccgttcttgtcgagcagagctggtatgattctcatgcaaaatgcaaatatttgtgcatttttgtcgtagaatattactagcggagatcaccgtaaaagtattctttgtcttttgggtcatagtgtttgaattgtttgatgcttgaattcaggtggaaattgctcgatttcgcactgctcaagcggaattcggtgtcgttcttcgacattgagaagcccgaaacggccatctcgagatggtctcgggcaagaatgagggctgccaaggtagagttcattggcatcatcccttatccaccaccctatgtctcactgacatgtgggcctataaccctggacccacctcgtcggtgagacgaggtgggggatttgcaaaatcagtggcataggagggattaatctctgaactttttaacagagccaccattgttctttcagtaagcatggaatttatactgcattactgacataggtgtagtgttgctatcaccttaggttggcaaaggtctgtccaaagatgagaaggcccagaaacttgctctacagcattggcttgaggcggtacatgcttcaaacattgatctcaacagtattttcatgattgaaatgtgcaatgaaaactgagatttcatctcatgtctgattatcagatcgatcctcgacatcggtatgggcacaatctgcactactactaccaccgttggctccattgtgagatcaaccagccattcttctactggtgcgaatgcgcgaatctccgaagaccgtttcacatctccgaacccagttgacagacaaggcttactgacaaatatgtgattctgaaacacaggttggatgttggtgaagggaaagatgtcaacttggaagagcattgccctagatggaagctgcataagcaatgcatcaagtaccttggccctgtaagttccatcactattcttctgatctgaaaatctgaaccaaccatttagaaactgctcagttgtagaaattgcatctgattaacagcatatgtttgttcttgttctgggattgtagaaagagagggaatcctatgaagtgatcgtcgaggattcgaggctgatatacaaactgagccgtcagatcgtcaacacgaccaaaagccgaaagggctcaaaatggatctttgtgctgagcacatgcaagactctgtatattggtcaggtagatgactactctgcatccatggcacttcttcattggcaaattgctgctacatcttttcatcttgcaaacattctgggaactgatgagatgctggtttttcaacacgattacagaaacagaagggcacattccagcactccagcttccttgcagggggagctacatcagctgcagggagactgattgtagaggatggaattttgaaggtatgttggggatgtgtcgatttctacgagcaacactggatttgctctctctgactcttgaaatttgtttgtttcaggcagtctggcctcacagtgggcattaccggccaacagagcagaactttcaggagttcatgaatttcctgaaggagagaaatgtggatctgactgatgttatggtgagaaccgaagtgtgaataatatcacaattcatctgcaggaaattatagatactgaatagagttttcctttgaactgattggtgtgccgtgtttcggttttgctacagttgaacccttcggaaggtgaagatgatgccgaattcagcctcaagagcagccattctaggcaggacttgaccgaactctgtgaacctgacatgcaagaacatgaggaacaagtcacacaacaccatggcgctgacgaaaccaagaccagcagtgatgcacccaccatgacatccaccgaaaccatggcgagcacaccggcaatcaggaaatccacctcagccaacaagctgcaagggaagcggcctccgaggctgctgatcagttccaacaacacagaactacccgcaacacattgcaacggaaggccatcaccggttcacaaggacatcgacgaggattccaccatgttcggagagtgcctcgccttctgcaagaagaacctgtttgcagaggaaggcaatgaagaagatgagctggtggaagtaccagaggagatgatcatgaaccgtatcaactgcaagaaggccacgaagtcataccagctggggaagcaactgtccttccaatggagcactggagcaggtcctcggatcgggtgcgttcgcgactacccatcggagctccagttccgagcattggaggaggtcagcctgtcaccccggggaactaggtcgacgaggttttcgtcgccgaggcgaaagcccttgacaccaaatagcattccagttgcaagatttggttgtagccctacagcccaaggtgacaacatggggctgaagccaaggcagaggtgtgctacttggactgctttctaatgttgatatggcatgcaaattgcaaaggcaatgctgcttttcttctccttaactggaggacgatgcaaagtgtatagtgagtgagggaaacatgagaatgtcattctttggttttgtagatgtgtagagcaaacacaccatggcttccaaggaacaagcaataagatgtaccttccgaagaagtaataacaagtaataagatgtatttttagatatgacacatttgacactcgcaaggtgcaagcaaaaatagagattacaggttttcagggaggaaaagaaacagatgccagaatttgtaccacaaaagatgatcaagctaaggaatttgatgtctccaatcaataatctgtagtatgagcaagcatttgatgtgtcatgcaggttcatcacatgcacatgcatttatcgatcactttacaaacctaaagcaacaaagccagagagcgacgtagaagggaatcaggcaatcacaaactcaaacaaataaggacatttaccaagcagatttgtgctgatttgtaacattgacagccatgtcacactcgtagtaaattgaagatagcattcatctaatcagttcatgttgcccaaagccagtagagcataaccatgtctcacaacaatggaactttagttataggcaacagaccaaaactgcaaccagacaagtacccattacatttccattgctcttaactcataacatataaggcctactcagaaagacaaaccattgttcaagaactggaccggaaaagcagtacacgaaataaggcgacaatatggcattttactttcaaaaggcaggaaccacgaaataacacaaccgccacagcttcagcgcagcctcctggcctccctctcagactcgagcagggtgaggatgtcgccctcacggaccgggcccttgacgttcctcatgatgagacggttctggtcgtcgaggaacttcactctgacctgggtcacctgacccctggagccggtgcggcccatcaccttcaccacgacggcaagtttgacctgggtatccatgctgcacaagcaggaagcatatacagtcaggcaaaactgatgttctatacaaaccagcagcaggtaattcaatcgcagtcatttcaatattacagttcgtgaatttatgtatcagatcagatttcaatattgctttcaaaggataaaaatgttcaggcagtttatctacaactcaaaattacagtaacaaatgttaacatctggaattcaaacaaaaacagttcctaaatatcagctattgttaatttcagtcacagcaactacttaccccaaataatcacggtcatagtcatactactctacccaagcaaaagataatttaagaatcgatgcaaatatttcagtcacaacggatcagaaatttcatgaagacgtatatatctattaacgattcactcatcctagaaacaaatccgacgaatcgattaacaaaacaataaaccgaaccacgaccacaagaccaatccatctatctaccggctttgctacccaacgcggatggatcatcgcgacgccgctgacgcaacgatctagcatgccgttacccccgcacagcgcggcgacgcggatggatcatcgcgacgccgctgacgcaacgatctagcatgccgttacccccgcacagcgccgccgcgcgcgtcccaaggatcacggtgaatacatcgcgaaggaagcaaagagggaaggggggaggaagcacgacgacgcaccttctcttctccggctgctagcgacggcggacggcgaaggagggcacggatgcggcggcggcgacggcgcgaggaggaaggagtggaggcgagggtgaaaaccctagggttcgtctcgggtggtttatatagagggagctgagctgagtgggttggtggcctgttaggccgggccaggccggctgactcggcccatcagataagctacttttctttagtttcattttctttttacctatcgatctttcgataaatttatagtttcaaatcttgcgaaaatttcaaagaatggatataacaaattataagtaaaataaaaaagaaaagagacaaacatgtctaaaatcgtaaatctagaaaaaaaacatgtttctaaaattttttttgatgcactgtaactaagtgtaagtgcaaaacaactgaatgtaaggcggagtttctttgcatgagttccctactcactcttctcgtttttatgggcacgcttttcaaactactaaacagtctattttttgcaaaaaattttccatacgaaagttgcttaaaaatcattttgatccatttttcaaaaagaattagctaatatttaattaagagtaaattgcatcgtcggtacacgaacatgtcagatgggtgcaatctagtgcacgaacttgtaaaatgctcgttttggtgcatgaacttgtttaatgcatgcggatgaaggcgaaaaggacattatatggctaatcttattgattcatggactaattaggatactatgtaaacatatatctgagaagattgctattagacatacacctctccaataaaaaatagaatatgacatagtgatagtagaaaaaagatgaaaaaaaaacgagcaatgatattttggtcctcgttcgcacgaactaggcaagttcgtatactaaaacgggcattttacaagtttatatactaaattgtaccattctaacaagtttgtgtaccagcaatgcaatttactctttaattaatcatgctctaatggatcgctccattttccgtgcaagagggatttgatcccaacaagaagtagcgaaagtgtaagttggatatacagcaacatgaatcttgatgcaagatcctacaaagtaaaaataaaatctgtcacaagtaaaatagcaaaacctttgaaaaaggggagtacctattgatctttggataaattggagcttcaaatcttacagaacttttaatcaatggatataacccattttgaatgaaaaatgacaaaaatgtaaaaaaaaaccgtatatctagagataaaaaaaaacacttgtaaaatctaattttagtaaattgtaactaagtacaaattctctatagccaagtataagtgctctgtaatcgagggtaactataaattggatatacatgagcatgaatctggatgcaagatcttactgacgaaaaatcgaaagacgggaaccaaaaatctatcacaagtgaaatagcaaaaccgtttgaaaaaatcattaagtgatggaaaacctgcagtctaaatgtctgaattctggttagcattggatgaacaccacatttctatttgataacttctcgatttagcatgatcactgtttggatgggtttagataggttagtttgggtttgcagtcgaaaatgttttagggttaatcctctgtcctgattccgactcagtttcaactccaagcttttgatggtctaaatcaacggtaaacatttcatttttcttaaaaaaaaattctattggatttgatagtaaaatcgtcgatgctaaagaggcttcaaccatgttaacccacgctaattattaatatattggtgttgcagatttaaattctaaaccccaactcttagcttccttgaagcgagcatgtcacacaatatacaagtctgctagtctgaaatcatccgtagtattcatcattagtgtcatattgttgaagagatctgacacaatggaatacacagcgcagtgagttcttgcatgtcccaactacccatcactagctagatatcacaaatttgaagttgaaaaaacaaaaaccaaaatgcagcacccaatcttccttctgacctttaggggctaactggacttaacatgctatacagacaagaaatcaatcggctgtgagcagaggaggtcatgagctgcgatgctgggcattggagatttgcagactcagcgccatgccaccagagggaagcccagttgtaattcagggctgtttttgtgactcaaggttcggattcacataatcaattcaccgtcctggagatgaattatcctgtaaataacaagtgaagtgaacacacataaggaccaacttcagggcatagcagtagacaacgaaggagtgtgttttgtgtttttaccatgtcaatatcttcggatccatgtaggcagtcagctgtttcggcatttgcatttgctggctctggagacggcaaagcagaatgctgcattcatgtggagaaatcacttaagactatgaaaatgggagaatagtagcattgccagaaaatcgatataatcatatgtatacttgccataagggatgactggctttgtacttgttttctgcctgggtcaatttccgactgaccttctatgttcggagtagttgctgttgatgatatacaaactcagtgatcgagaagatttatgttcacaaacagaaacctcaaaaatgagaggttaatggaagatgtgacaatggtacagtggtatatatttgactaaagaaataaccatgttattgttatctccaaggataatgcacaaagtaatcgagtaactaactatgtaattgaaaaaaaaaatagtaaacattgaaggaacagagttcagaaattctggaaggaaatataaaattaacagacatgccagaacaggttattaatatcttatattcttacgacaatggagccaccaaggaacttgtaagaaatattaaaaagctctctaagaaatgatagtacctgcttcatcaaaaacaggtatcacggtatgctcattagctggttcacactgactacctggaatgctgtttgcacatgataaattaatagcattaagactgtaattcatataactttcttgatgagaattgaaagtattgaatggagcatcacctttctagtttttctctattcacatcttctgttacatcctgactattagaaacaggtgagcttctttttattacctggtatacagatagtttagagagatacttggttttaaataaaagaagccaaacaaattatatattaggaagaacaatcctgcaagcaggacttgtaccaagaaatgcacacaggagataatgcaaatatgcaattgaagctttcaatatttgcatctcatatggtctcacctcatgcccaatactgtcaaatatgtcttgaaatttatgtaaagcaatctccatgttgtgaagctccataagcattgcctaaataaagaaaaacagtaaatatcaacttagatttttggagtttcagagaaattggaaaggcgttatgctataactgaataacctgcttctctgaagtcagtctctcaataatctcatccttcaccaataaagatttcctaaggtaacatcgttaaggagacgcaaccaaccaaatgagatcaatagaaactaagattgactgcaatgacttttaactcagtagaaatggatatttcttctagtttgggctgaaatttggtgttgagtttctcagcctcaaggcgttccctcaattcatatatcaacctcgccctattccggagttcaagctggtaatcattaattttttcttcgaaaaacctaagtttttctgcataagtgaaaaatcacatttagaacagcagattttaatgaaaaatcacatttagaacagcagattttaatgaaaaatcacatttagaacagcagatcttaaaaaggatatcaacttatatatggtcatcattatcaacatatggaaattgcaatctgactacaagaagcaacataccaacaaaatctttctcaagcacagaaatcttctctactttacccttcaagtcagaaactgaaattgcaacataacacagataagtatctaaagaatgcacattagtgcaataaaaaataaaaagacaatcatttggtaaaacaatagtagaataagatgtttcagccatttgcatacctacattttccttgtcgccaactagacatttcacattaccgagtacttgtttcaccgcagcgacttcctttcctactgaactaaataaagccagatgagcattcagcttttctgaaatcacagcaatctgtttatccttcatctggatagtccattgcagagaacaagcagagtcctgcctatcaaacatggtatcatgagccgataatcagtttgattccacatacaggtaattcataattaatgcaaatgtcagaagcaagaacagggcagaattatatgacagattagacaatgtacaataaagcagactccagatacactctagtcttacaaatgcatagcaattgttaaggaaaaactatgatattaatggcaagtagcctcacataaatatgcaattattacaaagaccaaaagtttagcatggagagaaaacataaaaaatgagttcagctccatataaactactacagaaggaagggggaaaataaaggtaaacacctgcctcgtaatgttttatgaaagcctcctttgattgaagcagtccctccatgttatcttttaactccttttcgtttttctccagctgctcattttcattttcaaggcattttatctgtaaaaaaaggtattgcaatgaacctctgttgaataggtacaaaccaagcactaggggaagaatgaagcatccacggtgtgatgtgacataacatgcatatcaaaaatcaagtgctgcttctacctaatcaaccaagcaccaggactagtcattgttacgattcggtagtaaaagtacaaatctacactatgatagacaactggcccaaacagccccaaatgttggtataatcgccacgaaacacaacatggcaaacaccagcatgatcacaatgtgtttaagttagggactgtaatttagttaggcattaaactgtaacataatccaacacatgagctctacccaaatccatgagacgagaacacaagctacttggcgaaattgagagttgtgaaggggctaagcagaacgaaccctggactcgagccgacggagcgcgtcgtccctcgccgccacctccgcacgcagctcccgcgtctcccgacggtgcccctcctccgcctccttccatctctgctcaaattccacaccaaaacccccaccacgcatcagcaaattcgacccaaaaccctaatccccagcaaacagagaatccaatcacagtccgtagagtaagagagagagagacttggctggcggcgtggagctcctcgcgcgccgcacgctcccgctcctgcgaaaccgtaaaatggaagaggaatcagcactacgagaggaagaggaagatccgacaaggcattggatgatcggcaagcaaagctcacgcggaggagccggtgctcggagacgagcgagagaagctgcagctgcagctgcggcagcgccgccgcctccgcctccgccgccatcgccgccgcgccggtgagctcccgcttcctcttcctctccactcgacgagccaaaaaaaaaaaaaactcccacggggccatatactgggccttgccagcccaaacccttccggcccaaaaggcccatccgcggaagccgaatctccatcgaacgaactcgaccgtcgattcagatccgacggctgagatcccacccaaaccctagcccccactccgccgcctcccttataaatagctcctctctccctcctcccccaaaacctctgccctaatccaccctcgccgccgccgccgccgcaagtagccacccgcgccgccgccgccgccgtcgccggagaaggagaggagcagccatgggtcgcgtgcggaccaagacggtgaagaagacctcgaggcaggtgatcgagaagtactactcgcggatgacgctcgacttccacaccaacaagaaggtgctcgaggaggtgtccatcctgccgtcgaagcggctgcgcaacaaggtggccgggttcaccacccacctgatgcgccgcatccagcgcgggcccgtgcggggcatctcgctgaagctgcaggaggaggagcgcgagcgccgcatggacttcgtcccggagaagtcggcgctcgaggtggaggagatccgcgtcgacaaggagaccatggagatgctcgccgcgctcggcatggccgacctccccggcgtcgagcgccagcaagaggtctccgcgccgacctactcccgcccgccgtacggtggcccccgccgcgaccgcgtctagatcgtcgtcgcctcttcgccgccgtcgtcgccatggctcgcctagctctgcgtactactgagttctatgttttgtctttagatctatggttgctttcaagattttgaacttagccgtgatgatgatgctttaagttaccatgtgttttggtggacatgattatctttttctatcgcactggtgaaatcttgagtgattcgatatattaccatgaaattcccatatgctccttgtgttgtaattgcttgttcatgtgttcttcaaattgatgtcttggtatgagttatataccttgctctgtatatcgcgtagaaaatgtttgattggtttgttaaagttgttgataattagtgttactatagactatataacccaatgaaccttaacataggatttcgtttcattgagtgtaacatatgggagagcttagagttggttttattgtctgtggaatagggtagaattctattaactcaatgaaccttaatataggagaattggtttcattgttgtctctagaatagggtagaaattggtgaacaattatgcaggttgtgattctttgatcatttgagttggtacagtgctatccatctatgactgcaattgccttgcgaaattctatactctgatgttcttgattttcctgatctaaaatgcttttggatttggagtagctaggtctccttagtttgcacctatcatacttatattttccttctttggaggaactaaactgtcatatctgttgaattctcgtgccaaaatctgtagaattctaagagcatttttgttctgaattgctggtctttggtatggtagggtctgtttggttccattgcccagctagcctagctgggtaagggcaagccaactcgttgccagcttgccaggcttgccatataccctttgtttggttggtgtgctttctatggcaagaattagtggctagccgtttggttgcttcaacgaatcatctttctctttagagtattttgtgccgcttcttttcatattgagcaaaataatattgcacacagatcaaatttttttaacttatggctttgtcacaagaacactatagattcttccacagttaacttggccacaagaataatacggatagaagtagtaaaaagggcaaagctatatgctaaaagaattccttgaaacaatcaaacatctttttgaactactttattacaagttcgaactaaagcatatcaattatttaaataatatctaaagtgcatgtttcattcttaaactatttagcttgaatgcatagtaattattcaaacatctcagcaaagaaattacatagcagctggatagttttgtattatccattgggtcacatattccttaatagaatccagtggcctacccttcaacatggcagctatattctcatgggtcgcgagataagtctgcagctcaagtcgaaccatgacagggtattccgtcatctcatcaattatcttgaatagggattcatttggatgtgttatatgtgtgaaacacatggtttcagacatattatctgtagcccctgttatctcataaaccacattatcatcagttctaactcttttacctttatcagattttctaccttttgcacgcctagaagatgagctacttccagtattgttctcttgatctggaagacaatctgagtcataatttgatgaagggtcaacatcaccaggactgccatttttatcaccaataaaatcatcatcttcagtcattggatggtcatatggtgtttgcagaacattaaattcccctgttgcatgcttgtcttgaaaaataaactccatttcatcataccaacgtatggggacgttaatgaatttagcccttttatctttggcctacacatgacaagaaaaatgtcagaaaaatagacatccatattatatgtaaacacgatagttatttgcaaggaaagaatagttagaacactcacattagtcattcgaacaacttcaatctcatcatataggattttttttctcaacatcatcaaagttggccccgctcaaattctttgcctccataatcaccttccactgagccttcaacttgtgataaacttgtcgacttgtgaagtttgtgtgatacttgccattaatttgctttgcacattcctcatgatggacttctttaaatacaagttgtcttccatcatgcttggtgccgacggccagaaagttcctagctactacagcccataccatcgacaatccccattaatgcaaaatcagaatccagcaccaaaggcccaaagcaagattactggatgtggaaatagtacatgaagcaacatagacagctcgtatacatccatccatggcaggaagatggagagctttaataaaagaaaaaaagtcctcgtacctgcaaatctagatagacgaggcgccatcggcggaagaaatcaaatctgggagcttctcagttctcaccacgagcaatcttgtgtccagtagcaatcttctgcaagaacatgctctcctcaaatcgagttggccttgctctccgatttactgcgtggaggccggaggctctactgcatttatatatgggcacgggattactgcagatgaatcgaggatgcttgaaagttcggcaaggggaggagggtgattgcaaattgaccggatctatgagccctatagttcagccaagagtgggggaagagagcgacgagatctgcaagcccgattctttggcgaagagtggaggagtaggacgaaattggggggctggttgttgaagaaggtaacaacttttgagaaaaatcgcttcatccttatcaacaacttttttcacgcgaggagcttgccgtcggaggcgagccgattcggctctcccttgtgagctatccttttctcgctcctatgggctagctcgcccccatgggctaggatttttttctgattccaaacgactgtccttgccaggccaggctaggcccctgctagccttggatccaaacgcacccttgataaccagaggggaaaaaaggggagcataccttgtaaaccactccatacccacccctgccaagctcttgttcctttgagaagtcacatgtaatggttttcaagaattccattggcagatacattggcgtcgcagttggatcttgtatgttgttctccagtataccaaaatccacatgtttttgcaccagggaatcatgtttactagttgatccttccattcctgattacataaaaggaacccttagagataacaagaaaaatcctcaaaaccccatacaccaaattaaacacaagttgcttgggtatcctgtgtgggttcggccggttttccttcaattagccgtgtaactgtatggtatttatgctcggtttctctcttctcaatgaaaaacaagaactcactaccactaccctttcggaggtttgcttcggaaaataataataataataataaagaactgctttcacaatgcaaacggggaactgacagtgagccctgcaagagaagcagatcaagtcggcttttccacaaacaccttgcatgcacgatgcacatttgataccgtcgtaatcccaaggaattgattcatccattgtctaaaacgtcatttagaccggaggtagcaatgtgttccctgctcctaagaactaatcgtgcatgcaaagaaagagagagagagaggactcacaggatgatccgatgaacaacaaaaaagaaaatgaaaaaagaaaggcaagagagctgcaggaggaggtagtcagatggtagctcgcacgcagaaagaaacatcgacgaactaaccggcgcgagttcgctgacggccggcgcttggtatatataaagccatcgatcggctagctcaggaacctactgtcaattatctactctctcgcgtatcaaaatataagaacctatgttatgtgtgatgtagtactgttaatttggacggagatatttgaagtattaggatatgtcctatccaggactacgttctcataatttaggtgctgtgccccaacacacaattactcacacgctatatgatatactacctgtcctaaattataagaacatatgatcggcatagctagattcgtaatactatgaaatttgctccatccgataataagttcaactagaaaataggcgtgccagttgacacgccgattaataaagcctgtggtggtattgttggtcctagtcgagatacatatgatcatttttattttttatttttggagattcgaagactctgtacaaacggaagcaaagagaccaataaaaaagaaaatattagaatgaaaaaaattcacctcgagaacacatattgatagtacccacatggatagttagacatattccacaaagtcaagttagaaagtcaagttagagggagtagtgtaagataagtcaattggtcacatggatagaccaatgtacgtgaaattcatatacttaagagctagggagatcaaatgtacggggttatctaaaaaatagttttatttttattgattaattctaaaagatatatgaaatggaatatttgtgatattcctatttgaaaaaataatatggaaatgtataattctcaacaatatatatgttataaagtggcaacaaatcctaagtggtttctacagttggatcactcttccaaataaaaacagcttagggtctataagtaaatacctctatatgcaaattttaagtggatcagcatatgtgggagtacatccttttgatcacatctaatcgaactgttctagatgttgtatcgttaagttactactttttctttaaaaaactgttaaggtactacatgcttctagaattatcacataacacttttgttctctatttttcttgatcttctgcattttttttccttagacgaaatccatgatttatttgataagccaggggcgccatggggaatcgtataatattatggtatgtttgagagaaggggaaaataaaaagatcttaaaagatatgaaaagatactaaaataaggtgagtcattacaacatgattaattaagtactatttttttaaattttagaaaataaattaatatgaatttttaagcaactttcttttagagtttttttttattgtttagcacttcaaaaaacgtacatatgagcggagaacaagcatctatagcatgaaattattttagaatactcggtccataattgtccactcatgccgaacagaagcctgtccataattaatttatataaagacataacagcatctatagcatgaaattaattttattaaatttatcatagaatactcggtatattttaaaatgcacttatttgattttacattttctataaacttattagggtgtgttctttgtcacctcttcccaacttctactctctatttttcatggtacactttccaaaatgctaaatgatgtgttttttcaaaaaaaaaagaaagttgtttataaatatcatattaatctattttttaagtttattttagctaaagcttaattaatcatactctaggatcatgccttagagtatattgtgacaaaagtacccatacactaatctagctacgaatttaagattgtgtcatgaaactacacaattaatatcaaatttatcataaaagtatataccacaaaattagtcatgcggttatcaaacaactacattaaaagcttcaagaaaatattcatcccattttaatgaaagggagacagtgaatcatatttttttcaatgttagaaagctgtagtttttgataaaagatgtaaatatatcgaaaattagtagttttaggatacattgagcaaaacatacatagcctagcgcgatttacttaacttattacagacattatatttatgcatatatgtttgataacttgtgtcctattaaaaatttagtgtagataataagtcatttttcaagtgataaaacaatcaagtcgtgacaaaagtaaataatatttacgtcaaattttgaaacaagataattataaaaatgcaatagatatgtttaaaaactactacctccatatttcaatgtatgacgccattgactttttgtctaacatttgaccattcgtcttatttaaaaagttatgtaattattatttattttattatgacttgattcgttatcaaatgttctttaagcatgacataaatatttttatatttgcacaaaaattttgaataaaacgaatggtcaaatattggttgaaaaatcaacggcgtcatacattcaaatacggagggagtagtagcgttattatattatttgaagacggagagagcatagcaaattaagaaaataccgtcgctagcttctcggcgtgaagtacggtgtctctgggtgacggggttttaattgctgcggcagcgaaggctcaaacaaagaacaaaaactacttgaagttgtagtggtagaacgaggctgaagttgccacgtaggagtacagaaagtcaggagtggggcccaccggaataatctgtctcgtcactagaatgttgtttggagaaaaataactgaggaagatagcactagaaaaataatctgtctcgtcactagaatgttgtttggagtggtccggcaggattcaaccgattcttttgccaaaagagagtatataatctgtaacttgtattgtatttggatcacaatctgcattcataatatcgttgtaattagtctctaatttgtgttgtgaacattttctcgattgttgctgggtgaacccattttttccgaaggaagatcgccggctgattttattaacgaaaaacaaatggatagcactccactgctccaattttaggtggagctaaaattgtttgactgggctcgagctgcaaccgtgcaaaacataccctacaacaactatagcaactactttctgtcttaaataagtttatttttttacctattccacacatattaataaaaaatagaaaaatagaatacatccactttatccaataccaatatagttattcctcagtttatatattgctaatacatttactcctattttcataaactcagatatataattattgaaaattgaatttaatttgagataaatgggaggaaaaaaatgaatttattttaaacggaaggagtaaaaatgaaaatatgggataccaaaaaagaaatacaaggagtaacttagtatttatgatagtataaataattttaaactaattaaagatgcacgaattatactcgtggatatcataatttgaaaactagtgatgaagccgtgtatctactgctccacaccgcacattgatggtgcttcctcgtaaacttcgacacgaatattagggaatgacgtaatatcaaataattagaaagagtggggctttaaacccaggtcatctagtccaccacattgtgaagctagctggaaaatccctaggagtttctcggttcctcgttaacttagtactgaatcccgaagttaataagaaagacctgattatgtttctttctagaactagaatgttaaagctgaagcgaaatgagcgtagttcaactggttagattttatatggtggaccaaattcctctaggtgtaagttctagatttgatacgggtgttcacatttatagttaattattctttcagtgatatgcagtaaacctatcgacagcgagatgtccgtgtgagcgtgtcaagggagcaacgcgaatcgagcaccatgatggatgttctagccatctgtgtttatctttgttatgggttagcaattagaactactcacttcgtcccaaaatataaaaccctaggaccgagtgtgacatttcctagtgctgtacagattcgtagtactaggaaatatcacatccggtcgtaggttcttatattttggaatggctgtccagattcatagaattaggaaatgtcacatccggtcctatgttcttatattttggaacagagtgagtatttgtttgggatgcttagggtcatgatccatgagttggacaattagggcttgtttggcacagctccagatccacctcttctggaactggagctcagcctaacagttttagcttcacctaaaatgggagcagagctgggtagagctctctcacaaaatgaactagagaggtagagctgggtttaggcaactccacactccattccagacccaactcctggagctaaatttaggagttggggctctacccaaacaggccctaaacaggagttggagctatcattttctcactcttatgggctagctcgcccccatgggctaggatttttttctgattccaaacgactgtccttgccaggccaggctaggcccctgctagccttggatccaaacgcacccgtagttcacaatttgttttagaattatcataggtagttaacaatttccttgatcttctatttgtagtgggaatcgttgtgcttcggtaatgttgcttcacattgtatttgtacgtttatgagtttaattctttgatctgggcgtgtttgatctttataactattctacatttgatagacacaggacgatcttatgaagtactcgtaattcttcctccactattcagtgcgagtgttttgtacaacttatgttcaagtgctagtgttagaacttgtgataattgagtttgccaggctaggataattcgatacattgcgttgtagaatattgtcaatattcaggattgatgaaggcaaaccaggctcctacatttgccgaatctcccgggtcggaatcaaacctagcttatgcaatatccgaatcacctgtagaatggcaactcataaggctgaaaagttgccctctttaatttctcttgtcttaactgaattggatttctcaaaaattggtacaattacttcttgagttatgaaaaagttgattgggtcatgtagaagaagtaaatactagctacgaacctgaacaagcattgttgacttttttttattgggacagaggaggtaagtttcaaaccctaaattttgatcaatagattaaaaatcaaaccaatttcttggattatgaatgtctactcccttcaatcctaaccataaatcttaatatgaatgtgtccaaatccgtcgctagtattggatcctataaaaagtctaatcctaattactatatcttataaaaagtctaatcctaactactaacctctatacgtatatgtccagattcgtagttaggattgagttttctattgaacggatggtgtaagttttaaaccctaaatttaggattgagttttctattgaacggatggtgtaagttttaaaccctaaattttgatcaacgattggtttgatttttttctcccacctgcagaaaagtgaagcataggatcgaatagatcgaataggtagtttttgtaagaaaaaaatagtctctctctctctctcttcattcagataacggaaagagaaaaaggaaccgtgtaacagatatgccggtatataatatagaaactcacaggggtgtaaggtgtgcatgtgtatttttggtggatgctcatagaggtgtaatacgtgtgtttgctcatagagttaaatgtacatgaaataaacggagtaagagagaaccgtactcattccattgatatatttcattctatttctattgctccaagcaaaagcttctacgaccacgccaaatataactgtactagtacatgtattcatcaaaacattgtgatttaaaaagtaaatttcacaaaactacatatacttccgatcaagttatcacaaaactacgtatttaaaggcatgtattataaaactatagatttagcattaaattttttacagaactatagatttaaagcatcgtatcacaaaactatatatttagtgatgaagttatcacataactacaaactttaaagtttatatccatagaatattgaggttacaaaagttgtatttttatgataaaactaatgttaaatctgtagtttttctgatacgacacttcaatatgtagtcttgtgcaaaatacgatgttaactctgtagttttgtgttacagttcttaacaaatcctatggctcgccaagtacatgtaattttgtaaaatttcccctaatttaaaagatttgctcatcaatgataaaatctaaaatcacattagccaccaatattaattattagtaaaagggaacaaagggagtataaattatttagggcttattcggtgaaaag

SEQ ID NO: 81955 - DNA, 20493 bp, Oryza sativa
ttgtatgtaatcaatggctgccatgccttccaagcaccctagaagatctctttagaaacatagggcatgagttatgcttacatctctcttgggaaaaagttcttttttttttacaggatagcctgacagttggtagatgtgagaaatatctgaacagtcaaaatccatttgattttggctagaggattgcctagcaactttagccaaagtgtctgccaccttgttcatttccctagaaatccgttgtattttgatctcccttccctgcaaaatagcatgaattttggacagagttgggtctcaaagaccagtgccttggagtaaatgcatggagtatctgcttctttgttgctgcagcaagaacatctattcagccagtggctctgcagctagtcaccattcccaattcgcacctcgcaagacaggggccaaggaagaaatccactccaggaaggagaagcagtgcggttgccggcagagccttccagttggcttgtggctgtggcaaagcaatgccctatcgctccgtatgtataacttgaatttcagttccctttgcctccaattcctgttgcacttcaccggttcaaaccatgaatacaagacaatagtgatattttgagaaagggcatggttaattactagcagctaaaatttttatcataccgctggctttgctacatatgtgtagcctagatggtcaggaacacacatttgtatcatttgtcactggagcacagacaagtcatcaactatatactgtatacctagctagatgtcctctccaagctttatagggggggggggggggggtttcaaattaatctcgtcatacttggtcatagactctgagactcataattcaatattcagttattttttcattatagaaaaccaaaattattgcacttggcagtctgaccaaaccaaaaatattattttcccttggcagtctgacttgtattactctgtcatgacattcactttactgattgcaaaaaataattaagcggtttatttatttttagacaatgaaataaattccaacctttgctcgagtagctacagccaattattaaaaaaatatgttcaacgacgagcacaaaccactaagtccaaactagcataataaaaagaagcgatgcacaaactaatgaccattaacactagacaaagatcccgtaattacggtatcctacttgtaaatcttaatccgtagttggcaaaattttacacaactgttgcctctaggtaacaacatgcagtatacataagtttgttgtcctcatcacacatttatggttgtgctgcttaaaactagagccaacacgttgccctgaaaagtactacctttgtcctataaaatttgaaattctagctaatttaggacaaattaggaggatagataaatgaccgcaataaccttatttaatgaacctcatatatgcatacattccatatcgaaaattgattaaaaggaattttgagataattaaccccacataattagcattcttaaattacttgttggatcccacgtgattagaaatacattttttttggacaaagcctcaaagctagaatttcaatttttatgggacggaggtagtacctgcgagatttatatggtgatttgttaaaaaccaaatcatttctactaaatcatagagcccaacattagcagatgctactacaaggataagtttcttagtttttacatcaatacccacaagccaatttccaaagatatgaaatatactatgtggagtatttagaccaaaagaaatttgtatcgatctccagagattcacatgcttgttgtggccaatttgaaacttaaatacttaatacttttgttactctaatatgtttatgtcacttcagaatagatgctgaagccacagagttgttggaaaaactaaatgagaaggagacctgtagagttcatgctcaagaccatgcaaaaattatagaaaggacttctgctgcaaaccgttgaggtgttacttctattgaattgtattcaaattgagtaattgatttgttttgctcattaattttaccaatgagatgttcacatagactttctcgacttagctcagtcatttacatacagtctcatgcacatataagattgttcaggcttaatttcaattattttatttgcagctttgttgatcctagtcttattaagcaaatgctgagttgctgaccatgatagttcacgaatctgaacacaacattttagtacgaaggaagtagatatcctaaaaagaaaaaaaattctttcacacatcctaacaacaacaagattagtgcaataccatctaatcctcctgccatgtcttcctttacaatctgctcaggaattggaaacatgttcatctttcgtgctgcttcaaactcaaatgaggattccaggctcaaatgttcaatccgtcacagctactaacccagctccatgggtagccttggacgacaacgccaccaaggttagatcattcatgctgcgagagaaaacacacatttttcactactgcatcaacatgattgcgtgtacgtacagaatcggatcgaggtgttactgcgtgtgtctcgattgatttctcatgtctcccaatagctcgtgttccttgcatttgattcggtccatgtattaaaaaagaaaaaataataagaaaaaattgttctttttggtcgcattttgatctatacgtgaaaataaactaaaattattatttccggtcacgttttgatctgtacgtggaaaaaaaagttgaccgttttcttaatgattttaatacggtatcgattaattgttctctcacgtgtgagcctggcctgccgcgtgcaactactatggaaggccatttgagacattttttatcactgtttgtttttctatagaattcacgtcgtcctttttctgtttttatgttctcgagaaatatacacacgcttagatttttctgtttctcgcgtatgttctttatcgtgaaaataatgtttacttttataaaaaaataaactgtacacgttaaaaggtgaaacggttgattttcgacctatagtgtttgggacttttttcccccagatcatagttttcataaaatattttagaaagaaaattatgaaccactattttagttttgacaaatggacacatatgatattaaaaaacatttatatatgtatgtataaatgatttatttattatgtagaaaaacatatttgtttaaaaaatataaaacctttatgccatgttaagtaaaagtataaaatttaatgtgtcattttatacataattttttaaaaaatccaaacaagtaaagtaaattttgagatttatcaaaattaattagtttaaatatattttcttttggatttgaatatttgaaagatcaattatttagtatatttagagttgtttttaacatatcatgtgtaacaaaaatataattttggctcaggaggtattaatgatcctattccatgacataagaaagcaaggtttctttctttatttctttgttttggattttctttgtataatagtttcagatttactgtatattctagagttataggagtagtactgagtagcgtggtatatttaaagaaggaaaataaatgcaaattcgttgttttagatttattttttgcttaacaattttgggtttactatatactctagttataaaagtagtaccgagtaggcgtggtatatttatagaaggcaaatgagtagaagttcgtgtgattggaaaaggaagatagttttggaaacctctagaatccatatgtgatatttttctctagatttttcctcacatatgattgttaggttttttttctctagtataaatttatgatttccttcaaaataagaggtaccacgtgtaccaattgaaagctagcaaaagagccagttttagattattagataggacgtgctaatgagcgttattgggctaggtcgctaggaggacagatcttgggttttctttcttttggctcttttttttcgccacgtggccacttctagtcacctctactaagccacatattttctctaccattataaaagttgaagtttatctcactttggaacgttcgactcctacatggtgttcgcctcttcccattcctatatacgtgcatcgtcttccatcacctccgttcgttgtcgccctttgcgattctgaaaccggacggtattgtaacgttatgatggcaatgtctccgcgaagtttcccatgtcccattgcatgtccgacgtcttctccagtactcccacttccccaacaaccaccctcactcctatccaatcgatcgaacccacgagcttagtatagggagatcactaccatagtagagctgatttcatgtcgaacccggtaaacataaacacggggtaccgcatcttgacaaaggggaaggtggcgtgcacacaaccctgccgggtgggggcaatgatgaccatccctctttcctttcacattgtcttcccactcagtcatttactggtcatactttctcttcctctttaccttttttacagccagagaaagtgcatgtgcgttgcaacggaaagaaaaactaatttgaaattgtaccaccatgcataaataaataatattcggtcacaacgaattgtgacgccgacttgtgtagctggctattacatcacccatcacccgatcatagaaattgttagtttcacgcttcatgattgaaaaaaaatcctaaattagaatcacatcactttatgatagggaaaataatgacacgaaatcataacccactttggtccaagcaaggatattaggattttacttttcctccttgatttcagcccgacactaagcctggcagacactccggccggtgagagatgacacgctcctccctcgtcggcggctccatcgtcgtgtggccaggaaccatggctccgcacatccccttgcggctgtcgcgaccgagaaaatttgcattttcctgaacgctagtatattaatctccgtcctagaaaaagctagggtacaccacacaaacatgatataaaagacacatctttattatatcgataatacttacattattacaaaggcgcttcaggcctgacaataaaaaaaaataaaaaaataaacagcagcggactagcgggcctacggctccatcttcacaggcgctcaactggggtataagccagggctccacctaagacttcttctccaaagcttctcttactgaaggggggaaagatagagcaagaatgagtacaaccacagtactcagcaagccacaccggcagatgcatgattaatgcaagagggtacaaggggaaataatataggggttaagctttgtagaaaacagcatttaaaagtcacttagttgcccaaagctattttataaagacgatcctagagctacacaatattattaatcaaggccgtgaacccacacgaacctgccttaacccaaggcctacgatgattcagaccgaacttgcaacccgacctgggccccagctcgtcccaagccaatcaggccaaccattccacattttagttgttaaacaagttttaagaattaaaccactaacttaggtacattgctaggcttgcccaaatccgagggcgcggctattcgaatagattgtactctgatcagaggtgtacatctttacccacaagacacatctttactccgcattccatggccgtggaacccgtcgtaaaggatgtgacataacccctttacccatcctagccgtgacaaaagcaccgacccaacctcgcctacggccggaatcccgagacaggtaggtaagattgagcccctagcagcaggacaccggccctgtgccatgacatctcgactaccgagccgcagcccgtgtagccttcatttgccctagagatgtccatctagccccgacttcgtccatctccatctgtgtactcttgccaggactagactgagcaccgggttaagccttacccattagacatgtggttagtacggtagtgctttgcaacagaggcccgaagactggtccttatagtggccgaggtgctactagcagaacaatgcacctcgagcccagcctaaaaccattttgagagttttgaatagagggggggaggtgtgtgttcaattccatcacaagccaaccattccacagtgtccaaatgatatgagaactcccacagtctaaagttataaaaccacctagtgttgcctaattaatcagcgaagcatctatctaaattcatactagtggaaccattaatagagtacccactagttggggttttgtttatcctagggtggagaaggtaataataacaatagcaataataataaggtcataacaaaggtaaataggcatagctaaataaaacaatgataacgcgggaatttaagtaaagcggtaatgcaataatttaaattaaaataattttataaactaggattcaatatgctcaagagtgatgcgacttgcctttctcagagagaacggccttccgaaccttcggcgatcaccgcgaaccacgcttcgagaacctccagaacgacagaagctacgcgaagtacacaagcaaagttacaagcctataaagaagcaataaaaatacataaaaaaataagcacatggttctttagattataacaaacattaagagacttgaacgggtcgattcgggattcgtatgaccaagacatggtcattcgaagtttaatgctgtcacgtggagatttacggattattgtaattaggttttgcaattataaaacatgtgtaagcgcttgcctggaaaagacaggaaggctgcgcttgttgacatgcggaccccacatgtcaacctaagggaccacggtacaccgagtacacagagacggtccacgggtcgacggaagcggaccccgtgtgtcaaccgaggcgagtggccgacaaacggactccactagacaccacgcggactacacacgtggacaccacgtggctaccgagcgggcacacaaacacggtcaccacacgcacccacgaacgactaccgacaccggtacacgggcaccggggtcgacaaccgcacaacgggcgcggggcgacaccgaaaggacgaggacgggggcagcgagaggaggcacccttaccaccacgcaacgaggcgtgggaacaacgacgacgaacgggcgcggcggagacggcttggggacgacggaggcgaacggcgagggaacgacttcggcggcgatccttggacgaaggcgagacgcggccagcacaacgcttgacgacgcggagccaaggacgaagacgacgacggggctgcagcaaccttgacgaaaggcgggcgacgaacagcacggcttgacggagggacgaacaccacgactaccgggaatgacgggaggacgacgatgggaaccggcgaggaggcgacgatgaacgccggcgggttcagctgaaggggaggcgaagccaaagacgacatcgccggctcgccgctgtgatgccggaggtggtggtggcgcggccgacggcgcacgggtggaggaagggccgaccggggaaattccgacgaggcggatggagaggccagcgcggcacggcggtgttccggcgaaattcgggcaacgtggtggcctggccggggaagaggatggcgctgttgtgccgggagaggaggcgacgacgacagccgacgcactggcgaggtggcacaggcggctggggcggtacagtgccggcaacgccaccaaacgtcgacgaggacaccgatccggcgagtttccggcgaggatacggggaggccggggaggaggatggcgtcgcagtgccggggaaggcgatggcgacatcagacgccgcacgggcgaggcggcacaggcggctggagggtggctggcaccgaggaaagagaaggaggaggcggggagaggtggtgtggccacgggggagctcgggaaggggctaaaacgatagaacggagcgagggggttccattttataggatggtggagggagccgggcatgggagaggtgggaacggcggcagaaaagttggccggcggccatggaaagcggccaagattggcgcgggcgttccgggtgattaaaagcacgaatcaagaggtaattaagggggaaagagaggggagggaaaggggattaattccccctaatcaattttggaattagtcatttgaatcgagcggatttgagggagaagaaactagggttcacgggagagagagaggagctgtgcgggaggaggacgacgacccgggtggtggggcccacgcaggcgcgccgtcagcgcgcgtgcgacgcgcgtgcgcacggctggctcggctcggcctggtttgggccgggcggctgggccgagagggaaggagggaggggaggggcaacccacaaagaggaggagaggaaggaatgggccgggaggggaagggtaagcccaagagaaggagggagagaaagagagggagagaaagagagggaaaaagggaggacttttggccgcggcccggagagagtgggaggacttcggactcggcccaaaggaggaaggaggatttatttttatgttttctttttagtaaactctgataattgtttttgttgcttaataatattttcggtgctctgaaaattcaagtaaaatttgagggctctttttagaccacgggaatttaacaaaaaatctccggacaacattcgaatttttcttgtacgtattttagtgtttgccaatttcttttcgaattttaattaattctattatttcttttagagaatgatttttatttcaggatgaatttatcacgggcatgacagcggcttctgtctgctgaaaaaaatttagaaatatacattttttccgtggaatttgtaagaaagtactgaacatgagaagatttgtgaaaatataccaccgtcgcggtttggtttagcgagagcgcggcgtcgcacgcgggatgcgtgagaacgagagcggtatcgctgtttagataagcgaggacgaagtgccggccgtctcgcggcttggagtaacgagagcgtcagcactctcgcagtatgcgttagcgagtgcgatggggcccagcgttgctaccagtttcctggcgccgaaacgtgagagcggcggcggtctcgcgcctgggaagtgcgagagcgagcgggtgccgcgggtctaggaaagcagcgacgggacgcgcagtcttgcacgaaggtaatgcgagagcgccgggcggtctcgcgcggtgggaatgcgatagcgccacacggcggtctcgcggagtgggaatgcgatagtgcacagcacaggctcgccactgcgccgaacacgagcgatgtgacagcgctgtcgcttgtctgatttgcgagaccgcgctttgctttccaaattagccagacggaaacagtaatgtactgattattaagttaattacttgtatatttgcatgaattaacaacatgtgataatagcattagtttttaaggctcattagtaaatatatatgagaaaccttctgtatatgtactacaaatagaacttccattatttaaactttgttatatcaaataaaaaatcacattagctacaaattaattgtaacatacaattagtacaaattaattgtaacttaaaattactacaaattaattgtaactttaatttaattttttaccgtataaaataattatgtctatctaatttttaaacccgaactgactctaagtcatataacagaaactacctccattatcattatcctacttaataataatatactatacattattaatattttatatttattaacttcatatttttatatttattgtttgccctaaggaccatgtagctttgcttcacggaagaggctgttgtcttgttcgaaatataaaatttaccggtctcgcaattctaacaaacgagatcgccggtcccatgcacgctgtcgcattgctaatgtgcgataccgtgtcggactaagcgccaaccagaaaatcaccatgggacccactccacagttgctcttgctctatgaaagcgcggtaccgagtccactctcgcgcttcaggtgtgcgagaccgcgggtcccacgcacatctcccgctcgccagtaatgccacaccacgggccccacaacactacggctctcgcgcgttgaaaaagcgataccgattccggtctcgcgagggcaatcagtgagaccgatgggcccattcctgctctgtctcccaaatcgcaagaccggattgggtcatctctacgtggcgctctcgctcaacggaaaaacgataccgatgcggtatcgcttacccaataagtgataccggagctgacgtcacgcttttgcttattgatattgcgataccgtgtcgatttcgctcagtcccgttgcgaacctcggtatcgcgctttcctcccgcgatttcgatagtatatttgtgcaaatcgatcggcatcaggtatatttatgaaaaaaatattcatgaacagtatattttcaaaattttttctctgtctgccgtccacttcccgaggtgtgcatcggagggccggcgcactggctgacggcgaaggcatcccacctccctaagacagccaccgcagtggcgtcccgagtcgacgacaacgacgtcactgaggtcatcttaacaagaccatgatcgattggtgctgtaacttaatttgttcctccatgcaggtatactcccttcgtactcatattaaaagtgagtcggttagaataatatttaagtcaaatcttgggaaaatgtaaaattatatgaacagatttgtcttgaaaaatactttcataaaagtatacatatataactttttaataaatatttttatagaaacaagaagtcaaagttatgttttagagaccgtgttgctgtccaaaacgacttcctttactagtacggagggagtatacatctgtatgaaaacttgctctctttttgtttggatatataaattccatgttatacccagttttagctgacatgacactgtgttagggtgaacccacatgtgagcagccggtctacctactcctctctcctcttgctctctattcgccatccctcccaggcttctcactaggtgacggtgggtggtgagcaacagggagaagagtgatagctgacaggacaggagctaggtggtagcacgtcaccgagttggaccagtcgccgaactggaaggtgacggatggcaaacaagaatgggcggcaggcttttggggtggaccatctcaccctcctcccccttcccctcccacggcaccttcggttccccatctctcttaggaaacaagcggcggccaaaaagagaggagcaaagcgcccctctttgccatgactcatcatctttgccgcctttgggtggatcattagtgcaaagacaaatggtggttcgtcgacatggtgagcggtgccatccgcgcgaaccaacgctcttctatgcccaacaaccactagttcacctcctctatgtccacatgccgacaggcaacgtagccaccggtgcctcctcggcgcaaagggtagagatggctgtctgccacctaggtggaagccgacgactagggtaaggatcactgcaacgggagctcgccttcgacgcctcttcccatgggaactacgtctccattgctgcttcaagacaacggtgggcgtcacaccggcttatgccgcaccctcgccttcctctgtgctcgagcccacgcttcggcctcgttggctccccgtctagacaatctttcctgatgtctagggatgggtaattcaatggttttgacatcctttaagtaacctatacaacattcgaattctttagtagtgtattcctctattatcgatctctataggtgagcacgattccgtacatagccattcataatagacatgtagcgctcgtatcccatatttgatgtaagtataaaggaccaagttcaataatctgagagacaatctaaacaattagatgcactatcatattgaaaaataatggagcaaaatacatctcaagctggcatacggtctctttcacaaatttctacaatggccccaactccaaagtatcaaataatttctgtgaaattcaatttaaaaagtaacatatatttgtgatcaccaccttaatctaaggtggtttgattgcccttatagtattagggagaaagacctgttagcatcacatgacagtcatgaaagttgtatctggatatggtcaaatctttcatcaagactagcttcctaatgtttgatgagaaaccagtagacaatatcaccgcatgtaaccatttgcataatgcattcttctcttctgatgttgtaaatggcaggaggagctcaatctttgcatcaggtagttcattaggttgaagttctattcttatagccaatttcgtcacagtctatctttcgtcttaccatgttaatctttactactataattcatgaacctgtttccgcagaattttggacagtcatacatgttcgtcttaccatgttaatctctactactataattctgcatgggtccaaactttcctgaataagacaatattttccaaccttttcttcactattgttgtttgagcctcctcgattctactaactgagctgactaagcttgatgcattgatcactgtagcacgtaccatcctcctgatgctttccaagctcaaatccaccatcatgagaaacaaaatcaattctaggtaattctttgttttggagaattgtgatgcatgcctactatgactgtaatagaatggaaaaggcacaaatggcgagacatatatatatatatatatatatatatatatatatatatatatatatatatatatatatatatatatatatatatatatatatatatatatatatatacacatatatatgtatgtatatatatatatataatatatgtatacatatatgtgtatatacatatacatatatatatacatatacatatacatacatatacatatacatatacatatatatacatatattcgcaggcggacgttggctagtccggtccgcctacgaaaataggaatcggccgcctgcaaaaaaaaatatccgcctgcgaagataggtagaaatttttgaaatttaataataatttgcccgtaaatttaataataatttgcccgttaatagaaattcttgcaggtagattattatgtacatatattggaagattatcaagcattaggtactgagaaatctacatatattgcataactcaaaagtgttgccaatatatatatatatatatatatatatatatatatatatatatatatatatatatatatatatatatatatattactatatttttttatattgtcacttcaaatacgccatctagttacattatggcatagaagtgttccactcccgaagatccttgaattcgtcacttgtcactagggcaccctctgggtcaaagaaatctcctttcacatgacagcactcatggtggatgaagtggcacagatcacgctggacatttgtgatgcctgtatcgtcaaagcttgttcgacgttttaatcttggcaactgcatgcattgaagataaacaatatattagtatcataaatatgtgaagctgtctagtacatagtacagggacttacatcctctgcgttaaccctgtacctcttattaaccctaaggaattcgcacgggtaatacccgcaaaggaccgttcctcgcggttgcttgtgacacttcaggacatatcatacaaaaaaatagttaaaatttgcaattagtgaaacaattggaatacattaagtgagtggagtattaccggccaataggtacgtactagtagcttctcccttgttcgggtctgttctccacccttgaacttgtagtattggtacgcactgtacggatgtcgtacgtttcacattaagaaggatatttatttataatacattcatataaaaatgcaagagtcataatcacttactactgtaagattgttagaaattctttgtatgactggtgtctgttatcgagagggtccaagactaccacagttccgtctttaaggtagatgagtaaacagatataatgatcgctacatattaacaatatcatagttagttagtaccagctaaaataagacatatgtgtagaagataaatgtaccgaacttacttaaaattataagtggctatgactactctcttatttggaaagtgcaagaaggcttgtccaatatactgtgcgacaataatcaatttctccttgtgcaagcccttcttgtattcagctatctcttttggagtcttgcccttcagctggtctgaccctggtgctagcctcacggtatgctgtggttgacagatccgagttggatccaagaagccgataggttcttttttcttcttagcatccatgtattgcatcctacagaagaagtttgttagtaacaatcacatggatttgtattgtacatatttttcatataattaattaaaactcatactcacatgcacaaaacaccgacatagttgacgtccatcttatcccgacgatatatggcgtggagatctgagaaatctagccatacgtaaccttcggcgccgaagcaatctaccggtgatcgagctgttatatttcccaaccctttcttgctgacctccatgtagaaggtatgtaaccttctcatctcccatggtccttcatttagtgcccaatccggtaagagtgctttcccatgttcgtacttttccgggcaatcatcagttgccaagtttgttggcccggctagttcagtggccttctggggggtcatcatctctgagtttggcacgttccttaccacctctgaagacggttaccatgaacttctctttgttctcatctttggacttgaagtcgtggctcctaagcactctaggcacctcagaactggtagtggccttctcagggacaatggtctcttgcacctcggcgtcttttgtaggaaaagggtcttcaaatatttctggctctgtagtttgtccctcaggtaagtataggtctcgcaaccaatctatgaagagatgcttgtgttctttcattatccactcggtggtgtgacccttattgttagctcgtagtagttcgatatgttgatcgatgtagggctcaacgatagcaaactgatgaagtacgctgaagtgagcttcttgaaatgatttgtgatcatgggcgatgaatctcttctttcctatcgttcccctgccactctatctgccctcgtgtcggggcacaggtactccaattgcatatccatctttgagctaatcgatacagcactcgacaacctcttcagtactataaccctcaaccattgatccctctggatgtgtacgatttcggacgtaacccttcaaaaccgccatgtaacgctcgtatgaccacatttgatggaggtacaatgggccaagcacaaccatttgcggcactatgtgaacaatgaggtgctccatcatatcaaaaaatgacggagggaaacacatctcaagttggcactgtgtctcatgtgcgaatgtatggagatttcctaactcttcgagactaatgaccttctgtgacactgcgttgaaaaagtagcacaaccttgtgataacaacctttaaatgctccggttttatggcccttattgcaattgcaagaaacacggtgagcaagacatgacagtcgtgtgaattataaccagataccgagaaatctttcatggaaactagtcgactgttgtttgatgagaaacctatgggcactctgacatcacggagtgacttgcaaaatgacttcttctcctcagatgtcagtgtgaaacaggctggtggaagatatactttgccattcttctctccttcttgagggtgtaactcttccctgattcccatctcgactaggttcatccttgattgcagaccatctttagtcttcttcggcatgtccaacaatgtttcaactatattgtcaaacacattcttctccagatgcatgatgtctatggcatgccgaacctccagatctttccagtacgggaggtacttaaagaatatagaatgcttcttgaatgggggagggagtttatcatctggcttcgaactatcatcttgcttcttactatcctctggtttcgtagtcttctcgggtttcttgcactttgtcccctttgatagtttcttagtcacttttccaaactcgcaaacaattttctgtcattgcacacactttttcccccgatgtaggttttggtgtaggatcagtctcttcagttccatcgaactctgccttcatcttgtggtacttgtgatttgtgcgtaggaaccgccggtgccgcatgtacacaagcttgttggaacccgggagatacctatagtacgttccattcgagcagatcacacatcctgttttacctttaatttgatctaaaactgaaaacattgctggataatcgttaatggtcacgaagatgatggccttcactgtgaagtattctcttaagtactcgtcccacactttcaatccctctttccataaatcagccatatcttccaacaatggttcaagaaatacgtcaatatcaataccagactgacggggtccctgtatgaggatacagagtagtacgtattttcacttttgacaaagccaggtaggaagattatatatggtgagaagcactggccaagtaatatgtgagctgctcatgtctctaaaaggattaactccatcagtactcagggcaaatctaatgttccgtgggtctttagcaaactctctatactgagcatcaaagtttatccactgacgagcatctgtcgggtgtcgaatcatcccatccttcttgcgcccttcttcatgccagcgcattagttccgcatctcgcggatttgagtatatccgtttaatgcggtctttgacaggaaggtaccacatcacaagtgtcagacggttctaggcccgtattgctattcgatttgtaccagctagcatcgcatgttggacattcatctaaacaagcatactctttcctgtacagtatgcagtgattaacgcacgcatgaatcttttccacaccaagtgaaaggggacatatgagtttcttcgcttgatatgtgctggatggtagtgagttaggcatcgggagcattttctgcagaagttctaacagacagtcgaaactggtatcagactatcaatgtctcgcctttaacctcataagttcaagaactgaccgtagtgttgtgaactcactgtcacagcccttcgactcatcatacaaaacttccttagctgcctttagtaaagcttcaaagttatttaaacctctagccgaccccatcagcacctcgggttctgcatgacgtaacatttcctctagatcgattttgtcctcaacagaaccatcgtcgtgcaccaggtcttcaacttgtgtcggaactacatttttaggcccgtccacttgttcttcgccatgacgtgtccatatttcgtacttgtccataaatccacgagttactaagtgctccttcactttagaagcatcttcctaggctatttcattcttacagtcagcacatggacaaattatcttcctcatattgttcttctcagcgtgtgccttcgcaataccaataaatttagacacttcatttctacatggagacaaaaacctcggccaatgatacatccattcccgactttccatatctctaaaaaaaatgaacataaaatatttgcactattaatactaaaattgtagggtttattgaaaaaaaacatatcgccattaaagcaaagtttattttaatttttttacacagacatgccaaattaatatattaggaaaatctaacaaaatcatatcatcggcatattacaaactaatataattattttttgattgcaccaaataaatagacattaaaaattttattctctctctatatgtatgacaagatctagatctagatctagaactaggaggtgaatatgatagcaaaataaaaaaaattgagaatttatgttaccacactaaatcactacaacaagagtcatcaaatattacacatacatctagcatcaacatatcaaaagaaagtaaattaaaaaacatggagcttttccttcacaattttgcatgcataaatacatcacaaattgaggtctaaaagcttaaaaaatgtatacctagggtggaaatgagtagatctaagcaccgtagaaaacctcccccctatatttaagacactttaggagagagaaacttctgggagaatgaacggggctcaggaaggaataagactacataggggcatctttgcagacgggccatataagcgacgcctgcgaagatcgcctgcaaagatcgatcttcataggcggaccaccccctccaccccgggtatcgtcttcgccggtggggttttggctccgaagaccatacccgcctgtgaaaatggaacccctacgacatcgaaaatgtgttttctagaagtgcattctactaccaagaaatgatcctactcaccaatttaaaagggggaaatagtattttccttatattttacgtgccgcatttttatcattaatttacatgtttgtagcatctgcttgtccccaccattgtcgtgcacacgtccctgccaacgcagtccttcaacggccgccgcgtttcaattaaacttttactccctctgtctcaggttaagatattctgattttcgtcaatgtcaaactgttttaagtttgaataagtttgtagaaaaaagtaataatattttcaacccaatgcaaaattattatgaaaatatattcaattattaatttgatgaaagtaatttagtattataaatattattatatttataatctataaacatagtcaaatttgaaacagtttgactttaaccaaagataaaacgtcttgtaacatgaaacagagggagtaatatatttcctttgaatgtatagcacagtccgacgacgaccatattagtaaaacaaaagatgagggaaattttttttgtttctaatagttgcgtaaattataattttaccgcttcatgtcatcacttccttgtatgattataccctcctattttcagattttttttaaatatactttacttttgaacattttacaattatccacatatttttaaaagatttgcggaaatatacacgtacagtgggtaggcgcgcgcgatcgatttgtcagcgcggcgttgacgcgtgggaccgacgactgggataaccccgtgccacgatagcccgccaccgtatcgctcccgcggcccatttgcgtccaccaccgcgtggtcgtgcggtctggctgcacgccacagcgtgctgcgcgccttcataccttctaggtgcatgcgtgcatgcggatgccaccggtggctcgctgcagggccgcgggaccggaacggtggcgcgggattgttccggtcatcggtcccacgtgtccgcgctgcgtgaatgaatcggtcgcgcgccctcacaccacagtatatgtatatttttaaaaatctttcaaaaacaagtgtatagaaaaatgaatattatatgatcatttttgctattctactataccattacagattatagtaaaaggtctctaacaaaatgaatattatacgatcattttcacaatattttaatatatttatccataatttttataatacttaaaacatatacctgtcattatattacgcatcaaagtacatatatcatttgtttattccatcattagttccactgccaataaaccatgatttttttcgatctccttcttgagatgcaaatcttgtccaacaatctaatatttcatatactttcttctataaaatttactgaacttatttccctctaagcatggattggtaaaccagtttaatatgttattaataactaatatcatttttactccgagctagattgttgaaaacaatattgaagattgatttataattcctacagcaaagcgcggagaatcacctagtctataaagttcatccctactaagtataattaatgctaattctctctcctctcattaagccacattatcttaattgtttttagcacttggataatttatcaaggatgcaaattgcatctcatcccttgaaaagtcacaccatataaccaaatgatttgtaacctttgtataactgatcgaggtatgaaatatataagtacgtacatgaaagaaaatcaaaaaaattgtacagtaaataagaaataaaattttataacttatatttttattttgttacataattcttccatagtaacacgggaggtacatatctagttagctagtctagcgaccgagcacctgcagaaaaataaaccatttttacttgatcatgctctaggactctacttttgtatattctgagtacgtgtag

SEQ ID NO: 81956 - DNA, 650 bp, Oryza sativa
ttgcctagcatagatccttttgttccaagtacagtttctgggaagagaaagtccatgacaggaagttcttcccatcttggttcacgggcagttcgtgaataccaatttattcctgaacagtcaagtgatatatatgagaggacgacccagtcacgatactatgatgttttaactgaagcttcggattcaaggatgtcgacaggatcacgattcctccatggtgttgaaaaggcacctggctatacattccatggacaaatttctggttctagccatttatctctacatggcaggccaccagttttttcatcgggatcaacagattatgagatggatccatctaatatcaattctagttctgttccaaatgaaagccagtatggaattcctcaggttgctggatttgaaaactccgttgcaccctcagacagaatggtttatcatgatgacgatgcttttcgaatggaaagaaagcgcaaagtactgagagatcccctcataatttccccaaaacgtaaccatgtgtgaataaattttgagctagtagggttgcagccacgagtgagtcttcccttgttattgggtaaccagaatgccgcaaaacttccatgcctaagcgaactgttgagagtacgtttcgatttctgact

SEQ ID NO: 81957 - DNA, 26293 bp, Oryza sativa
ttgctacccttactttttattgtgttttcttaacaggaagaggagatcgcaagattaaacacaaaaattaaccaaaccgaaattcatgccacaaatttgatctcaaggcttgaggtatagtagctttctcactttcatcatctcccctttgcgatatttatgtctctcattcctggaatgaccaaacacaggctactgaagcaaagttgaagaaccatgagtcagattcgctggctttgaaagaagagatcagatcactgactgttagcttggagtcttttagaactgaagctcagtcacgtgagaaggaagtgaagatcttggaacaagaaaaaaaccatcttcaggagaagtatctaacagagtgcaagaggtttgatgaggcagacagccggtgcaaggaagctgaaagggaggctaaacgagcaacggaattggctgacgtagctcgtgcagaagctgttgcttcccagaaggataagggtgaagcgcagaggctagcaatggagagacttgcgttaatagaaagaatggagagacaggttgaaggtctggagagagagaagaataagatgctggaagaaattgagcgagttggtcagtctgagaaggatgctgtatgtaaggtttcatcgcttgaacaaagggttgacgagcgggaaaaggaaattgatgagatgatgcaacggagcaaccagcaaaggtccagtacagttcaagttcttgagagtctactggagacagaacgagaagcctgcgctgaggccaataggagagctgaggctctgtcactgcagttgcaggcaactcaaagcaagttagatatgctccaacaagagctgacatctgttcggttcaatgaaaccgcactggacagcaagcttaaggcctcacatgcaaggcgcctgaggggtgaagctactgagtctgtccatgatatggatatcgacgatgacaacactggcaggcgaaggaaacgatcaaaaagcacgacgagcccgtttaagagcaatcacaccgaggacggtggctctgtatttgtaggagaagacactaacaacgggagccagcaagcgcaggagacggagactgaagactacaccaagttcactgtgctgaagctgaagcaggagctcactaagcatgggtttggtgctcaactcctgcaactgaagaatcccaacaagaaggacatcgtcgccttatatgagaagcacgtagttggcaagtagcggttttctatttatgcgtgctagattttccctgttgcgatgaacgttgttgtcacggttgaggtgagagcgcgaaataactaatgtaacttagcctgaaactccagtttgtgttattgttaacttggtgcagtttattttgcatgcatcattggcaagtgtttgtagtacctgtgtggctgtgtttagttattactcactctgtctcaaaataaactcagcgtgtagttcaacttattttgggtcggagggcgtagaaatttggtttgcaaacccttcattatatctggcttccgtgtttgtactaacgaaataatcctatatgttggggactacgaaacagagatcaaggttaatttctctagctataatgttagaaccatccatccgagacatctaaagatatatatgaagtgatgcatcatcaggacctcttccgtgtgcatgtatacatgtacaaactgatacattaattgacattttcgagttagaacggcgtgtagtaataatctttgcacagtatagcatcggaaacgatataacaactttgaacaaaactgcaaataactgatggatgaatgtaaggttaagaatgtaatataatggcacctatgtgaatcatatcggtataaacggtaatgtttagattttgtgtaattttggtttttccttcaagggccaccaaagctgttccttgccgcgtgcaccgcgaagtttggcgcgaagtgcgcagcaggagcaggtggccggtaacccatcgttgctgccgggtcgtagaactcgtgcacaacgtttgcctccttgagaaagctaccaccaccaccaccttgatggccatggacgatggagtagttgctgttcaccacggcggcggcgacggcggcggaggcctccttggcggcggcggcggcggcggtggagccgcactgcctgggctgcgtctggaagaagaccttggagacgacgagctcgccgtcccgctcctcctcgtcggagccgaggtggtactggtgcatcacccagttggtcttctccggcttgcgctgcttgccgtagttggtgtagaggacgaggatcttcttgtagcccctgggccggccgttggccatcaccggtctcgtcttgccggtcttgtgccaccgcgtctcgccgccgtcgacctcgtcgctgtgcaccttccgccgcttcctcgtccccgtcgtgtacgccttcgacggccggtggaagaagtgcctcaccagcccgtccttgctcacacctgaattaatttttcaaatttatttacacccacaaatgcacgcaacgatcaactcatttatcaagaattttaagctaccgattctgattccactgtaagaaaaaagaatttacacccaccgggaagcctctcgggatgggtgtagcagatgccattctcgccctcgatggtggggatgaactcgtcgacgagagggtggagcttcctcgagtccggcctcgccttcccttccaaatgctcaagaagctcctggtccgtcggatcgaacttcactccggccggcagccccggcaggtcctggatcgtcgtcgtctcctgcaataattcatcttaattaatttgttgatttgcatctcaaccaaaagaagaattaatgtagtactacgcagtatatatgatcagttatcacttgctgaatttatagctgttggctgttgcattcagaaaaaaagaagaagaagaaggcatgatcttgatcacgcagtatatatacctgttcataccgcgcgcggtggccgcaggaggggcacatcttgacgaggacggcgagcgacgccgccgccttcttccccgcggcggcggccacggcggcggccggcgacaagctgctgtccacggcggtgcggacgtcgctgaagctgttgcaccacgtcatcgatctctccggccaaccccctttctcctcctcctccacaccaatatatacacacgccttatattattaattaacctagtattttaccactaactccatacatgacagccaaaaactaagaccagcagccaagaacaatgccggattaaaagaagaagcctactagctagttagcttagctagagacacatctctagctgctaattaagctatctatctagctaggagagatcgagagagacctgagctgatagggaagaaacaacttaaggccggggtcctgatgagagagagatcgtcgagagggggaaaaaagaagaaggaaagcttgcaggcaacagctagcttgtccctgttaaaagctacttgtaatcacacacacccgtactatccctctctctgatttctctatcctcatctggtaccaatgagcaggaggaatgcaatactgtgcacaattcaaccttttccccgtgtggttcattccccaataagagatccattacatatacacctttttctccttttcttttctttaattatgtccaagtgtgtgtgtgcgcatatgtatatatacaaacatgtacgcaatattcctagcaagtagtagtaggcggctaactaatacgtagttgagatggcaatggcatgtagtacgttgcttcgctctcacgtataggcatgcaaaaaccgatctgtgcccaatacgttcaaggtttgttaaaatcttgatcgtgaatcaaaatcgaaagttctaagggtatgtttggtagagtttcaacttctaaatttaacttcaggagttgagtctggagtagagttgtagagctgcctaaactcaattccacttctctagttcattttgtgaaaacgctacacccagccccgcttccattttaagtagagctgaaattgtttagctgagcttcaacttcaggagaggtgaagctagagctaaaattgtgccaagcatgcttaggattgttgtgatcgtagaatcgtacatataaaaattgttaaattgtagattttactcatatgtagtcgtagaatctttactcataaaattgtacgagagaactaattgagattttaaccttagaatacgtgagaaaggaaacgccggagattgatcgatcgaacagctaggtgcatgcatagtgcgacatggtaactgtccacgatccgatcgaccaacaacgcccggcatatcctgttccatttttcaacagaagttagcaaggagctagcagtacaccctgcagctaagctagctgaaattaaagcataatattgccaaggagagaagcatatgcaggtgctctgtgtggatgcatgagatcgatatcgatctaagttgcatgctgcatatatgcacgaccaacattattctctctcgatctgtacgttgttggagaggccgtacgtgcaggtgcacaatgttgattgaaatatcttatactagggcctggttggttgctttggccaggagatatattcccttccattaatgaaaccacgtttcagatatacgcacgcatgcaccagctgcagtagctgggccaccgatcgatctatccatcagataactaattaactaacgcatttgtgtgcagttatgtaatgagcaagtacaatcaggcgaatgaattcaaatactcgcaccaaaaactcttgttccgatctggggcaatgatacataccaaaactttcttattggcatttcctaaaatacttttaaatagggactgtctactcgtcatttgacagaaaacccctcctaatatcttgtaaatttgtgaccattggattgatttgagattcgtgcaaaccccaccaaaccctaaccacttttcctttttccttcctgccgccgcacaacgctcgagcgctcctctcagcaccgcgcgcctcctgcatcgccaccgtcgccgctgccgccccaccgtgccgccacccggcctcgccagctggccgaaaagtgtcaacggcgtcggcgaggccccgccgactggccccctccccctctccttctttgcctcaagccggcggcggcgtgctgtccgtcatcttccccatcgccagcggcggggcgccaccaccggccgcctacaccgggccaccggccgctcccaaccccgcggcttcgacggagccgccgccgcctagccgcccgcccaatccgccgcccgccgccgggctactgcctcccatggccatccctttaaagccagcgaactccccctttttccccctccttccttccccccacccctaccccaccccaccccgggaccctaattcgtcggccctctgccagagtttgggttcgccggcgccggagaagaagaggtggttgccggagttggagaagaagagcacgaatcgtgaagcacatccagtgatccaaaatttgcaagatttgaggttgtgttttctgtcgatagaaatttcgcatttccgttttaaatattaggcttttcaaccttccaacatttagttcattttttttacctcgaaaaagtatcatgtaaactcagtttcatccattatgatatatgtatatttcactgttctgatagatatgagttgtgcgagaatttattactacgtaattcaaaacagtgccatgaatatatatactgaaactttgtgcagtacgtactgtctcagcttccactaaaaatccagctgcaacaatacgtatatcggtatatgtgtggtcatggagacggaaggagtcaataataactgaaggaaagcttagaaggtcaccaactcgccatggcatttttgtgcatgcgcgatagacgatggttggatggggatggatggagtaggtggagtggagatggggcaacccgattcgccgggggacgttccaacgaacaggcccagcagagaagctctttggaaagggtgcactgcatattgcgcatatgctattgctctctcgctagtcgctagctaggagatcgaccgagtccagttggctttagataccaggtcgccgtggagtgtcttgcaagacaaattaaacaccccacacatcacaaacacaaacacatacaaatgagcagggctgtccctagcaatttggggggccttatgccaaatttaaaatgaggctttgtgtttaaaaatactaattatatgatagattaaggctatatattttttacaatacgtcgggacgtgtctttattaagattgtctttttacttgatctgcatcacagccattggcccttcaaccacatcaggaaagttagatcaatttaatgctcgtttcttaagctatgtttcaagtgcggtcgctcacctcatacttgctcagggacgagcttgcaaaccagaagaaactaataaaaaagatgagctatgtttttcctctcgtacatgtacatattgccccttctttaatctctattccataaaattggcaccgtctatatttttttcttaaaaaaagtaataaactttttctttttgaagaaaaaaagagagcggattagctatttatttaagaactagtaaggtagcccgcgcattcgcgcggggatgtattgtacacagggttaaacttttcggtttagccaatttgatcgggcatcaccgaaataccaaaatttccgaaatttcagtctgaaatttccaaaattttaaacaaaatttagttaaatttaaacaaatattaccaaaattcatgaaaaaataaaaaaatgaaaaattcggccgaaataatatcgtatctgaggggttagaaatgatcgaaatttccaaccttgatttgtatattgcgtttgaaatttatcgttttacttgtcttttcccgtatagtcacaatagatattaaaaatacaaacactacaatctaataatgttattttgaattattctaatgttataataggggagtagttttttaaagcattcctcagagttaggttcattttacttttatccatatagatataatttaattatttcgaagtcatatatggtgataaaatctatatcattatccttatataattttataattgtttgaatggcatacaaaaaacagaaaatatagccccaaagtgacatatttcttctcaaagtcgatattatggtagatatgtgtctttaaatgtaaaataatctaaagacgtaagttcatcaaatgttagtagagtgagttagatgttatagttgcttattttgttgcataagttttgctttctaactacatattttgtaaacattactcatagtatattcattttacttttatgattgtagacctaatttaattattataaagttatgcatgatgataaaatctatattattatcattattttatatgtttttaattgcttgaatggcacgcaaaaatcagaaatataaaccaaaatgacatttttttcaaagctaaattacagtgaaatatggtcctcaactgtaaatttagttataaataatctaaagatttacgcagatcaagaattagttgtatgatttagaagcttaattgtttaacacaaaattattacttatctaactaataaggcatgaaaataggagaagtaataggtgaaaaagtggagaaatgaattgaaggaagaggaggcgtacatacgtatgttcggttttgtaaaaaaaagtaacttatacatataggtgttaacaaccaaatttggtaacatcggcatttgggaaagaagattagatcgaagcaaagtcggaggcggagatcgagttcgaaaacagaacaggaatcggctgaagtccagatcggctgagtctgagttgggctaggtaagctgatgtacccgatcccgacaatacaacttgatgtgtgatgtcgggttagattgaggtgctttaagatgattgccgcacatggatagagtcctgagggggcaattatatctattgattaggatgttttatgtaatttccttagagatatgtttgggcaaaagtctgccgtaaagacttatggtatcttagagtttgttagagatagtagtcgtgtccgttatggacatatcttgtaattctcgggtataaatagacctgagccctatgtaacttttaacacacacgttcaatacaatttcggcgcatcgccacccttttgctttagttttgtttcgacgagttcttgctttcgggttgagctgcatcggtttcgatcttcaacaagaggtaaaacttgttatgtcggctcgcattcttgagattagtgcttccatcttcatgatactctaatcttgtttatgtaattcgtcgagttatcatgtatcttatataatctctggcaatatcaccatctaacatacaatcggctaacatctattgaggaagacagccgattaggttagattctgacgttgactcagattatataagatatctaccattctatgaaactttcagcggcttgattgtctagatttggttcttcttttcatacttaatactgcatcagttgagtttgatctattaagtcgtgcttagaataccaatctctagcctgcctcctggttgccgaatagagtagtatcggagtatcagccgatcttacctgatttaactatatttgctttatatgcttcattgatatgttaaatctgtcctttatgtcaagatatcgttgtatttaagtatattaggcttttgtttgttatattatacctgttttaatatcctgacataaagtagtatcggagtattagccgatacatgctaggtctatctgatcggctatgctataaacatatatagtcctgttattaacatatatttcgatctaagtgatttatactatctcggcatggtgaccgatctatcccaatcacttgatttaagtatatatcgatataagaactatatgttggaaatatctacagctgatcgaatagatttatttctttattgtttatttacaactgccgatcgattcatatatgacatcggctcagagataaatgatatgtcatcggcacctagccgatcggctatcatttatagatttaaccgcggtttctttgcttctatttcttgttgattacatgatcaaatcaactggcatgctagtacacccgaaggcgagctttggacatgcactggagttaagcagatctcccaggcctcgtgttttctgtcaacaataggcttaggtgggcccgggtttaggagagaaatttttttattgaaaattaatctaagggttgtaaataatgggtccaccaaattcaataaaaatatgttttgttattttagaattttaagaatttcactaatttattaaagcatcatatggcaacttagaagcgttggtaggatgtcatatggtaaattaggagcatttttgggaagtttaatggacttttagatatctaatctaatgttctaaaacaccaataaggtccaccaatttaaatgaaaatcgaccgtgatatttatgtaaatttatagagtaatatgttttatctttacataatagaaaatcctattttaaatatcatcaattttttccaatagtactaagggcacgcgcaatgtttatttcacaagtgagcaataacgtgggcccattgattaggtagtagtagttgttactaagctccacaatgtatataagcctatgaaggataaaataaggtgggtccatgcacaaaaggtacatctgttagcttgtgacggactacaattcattttttatttgcttgttgccggtagaaacgctatgaccaggtaacaactaataccagctttcacagtgtatataaccaggttagaaggaggaattcaatgcctattacctgcttttgtcccacattgtggatgctctaagtacatatgtttttttttgtttattgattttatgataattctgtgcgtagttttttttttcttctgacgagaacagtaggtacgtaagctttattggtttcttcagttatacttacgtaggtttttcctgtatacataaatacgtaacagagtaagggaattagattgttaaaaataaattacatataatctaatagcctaaaatatcgggtccactgacagtggcggatctaggatttagaatataggtagtccgacctaattttttcctaaacatactaaatctaacgatggtaatatataccatgcaagtatagataatagaatagaccaaaagtgtatcatgctatattaataaagcatcttaaaacatataaaattagtaattacctaaatttttgaagaaaattaccatactaatttttcttcttatcgggtctacgccttctaatggccatgaaagtggtcgttatatcttcttccttcacttttaagaaaacatcccgcttaatgaatgtgactatacaatcatccaaaagctcatcacctatcttttttctcaaccatcattagtaaatgcatcaattctactataatttaatatcacaatgcacaggagtaaagagttcaaaatttcaaaactgaaaattgaaaaaaagtaaaaaaaatagaaaacctatttttttttttggcttggtgcaggactgcatcactgcgggcgggcgttggcggcacacgctgcaggtctgcagcagtgcgctagtgcggcactgcggctgcagctgcggcggcagccggccaaggtgtcgacgcgcgcgcgtggcccggtggcgctcgctctcacgatctgatcagatcgctgatcgcgtcggcgtcgcgactcgcgagggcgaggaggagagatacagagagtcctgtgacggcgcgacgcttcggtttcttaattccgatcgattagatacaccatacacgcgcgtgtagggtggggcctgtggtaatctaatggtttaaaatattaggtacaccaatttaagtgaaaatcgacggttagatttgatagagctacgtggcagcctaagaacgtttgtaggagtcccacgtggcagcttgagtgcgtttgtaggaagtttaatggacttttagtatataatagatagatagataatagatagatgatgttgagatctaatccatccgtcctaaaaaaaagacaaaccctggtttccgtgcccatctattaaccgtccgtcttatttaaaaaaaatatgaaaaaaataaaaagacaagtcacacataaaatattaatcatgttttatcatctaacatcaatgaaaatacgaattataaaaaaatttcatataagacggacaattaaaattggacacggaaactcagggtttgccttttttttgagacggagggagtaacatcatagcaccagaggacttgacgatgatacccctactgtctgacaccctagatgagttgtagggccaacgtggcaagagattagtaccaaaatatctgacactaaactcccaacctcaacgtcaatggacctagcgctgtggtaggggacttatcaatgaagcagtggcgcctagctcagtgacgccaccgcagtctcgacttccaatggcgttggactctcatgctggtaccggttcctttctcttccatgccactgctgtctacgatgagctccatcaactccagtgccgccacgggctcgccaagcttcggagcttctaatcaagtcctataccttagcactaggcccattggcgcttaggttgagaggttagcatccacatgctgagaaagtattttctacacctaggtgctatggcacttaggtatatgcatgcaatttaaacaattatataaaaagtttatataatttaataagataggccatgataattaagacactatacaaaaatgcaagtctaaattcgatcgatatatgaagaaacaaaaataacaaattttatctgcgttgtatgagtactattcaatgtctgattttattatttttgtttctctaattgtagattaaatttagtcctgtatgtttgtgtatagacttatatcatcacaatcgattttactaatttttttataactatttaagtcgtatgcaaatgataggtgccgtcacacctaggtgtataaaatccttgtcctccacatgctgctatgtcgtgcctccaactagtctacggttggggtttcaatgcccaatcatatttcatgttaaaatgatattggacctctgcattattagatttggtgttaagatcacggtttattttagaaatatgttttttgcacagcacattcttaaaacaagtttttcaaaaaaaaaactaaattgtcaattgatccggcttgaagcttaagttaaaccaacagttatgtgttccagttttggtcacatagccgatagccttttcgagcttaggtgtgcatcatgtcagaaaaggattaatcatgcaagagagcttatagaagtttggtaggtggtggtgttggcgcgcgtgtgtgtggcaggaagtggattgcaccaactcgatcaatctgttgcattcttcagtttgcagccacagacagagctgcccatactgtagcttttaggtgaggtgaactgctactacactacgagtctactactgctacagatggtcttgatcagtagggcttattaagatcctctaatcgtggcgatttctgaaaccaacgatcagaatacatgattaagagagtggtcaattaatttgcagaggcaataaaaacatctagcttgttaattaggatcaatcgggagaaagctagcacgcctctatcagaaaatgatttggtaccccaattgtatggcagcgtcgaaggagccaaaaaatcaatatatattatttctaatttctttgctactatgtactccctccgtcccactttaaatacagttgtgtgtttccgtgttcaacatttgatcgcccatcttattggatatttttttatgattattatttttgttgttattagacggtaaaatatgaacaatactttatacgcgacttatttttaaaaaatattataaaatttttaaataaaatgaacgtgcaaatgttgaacacgaaaccctcaactgctttaaaatgggaaggaggagggagtactagtgtgctataagctctctcggtgaatgatgacatgtctaaatcagcagaagttttttttttatataagaaaaatcaacttttctctgcgtactagatggacctacaaagtactacaaattaattaagatatcgcactaggtcatatctggagtactatacgttgccgttgagatgtagcatttgacgcagatgtatgtaaaactttgcattagattgctgatagtacaaagagaataatttcttgccaagtgtcgactgactgtctcatctacgtacaatacaggcttaattgcagtcgatcgttcaattcactcctactattttacttgatatggaagttcttctgtttattagcagttggtagactacctagctagctatatgttaattaagctgctaacaatggcgtttatacgagctaatctattactaatcgaggagtacaattgatctaaaccaactgtttaagtggcttctgggtgaagctcaagttttctccatagattggcgagtaagtacttttgattggaaattatattggcattgattggatgttttgtgcgttgatgttcatctgtcaacgcatgattgttcaacttttagtgagaagggtacttaacgtggatgaaatcgcactcgttcgcttcaattcttgcatatatggttcgtctacatgatgtcaaggctatgttataccacttcgtttcctaaaatgtgtaacgttgattagttcaatttcgagctaaccaacacaattaaaaagaaaaatagatggagtactaattaagatgaactagatgatagtacctcacgcgttgctgcggaggttttagaacaaatttgatagagcagttggatatgatcgactctcaaatttgcatgtacaattgttctattcaactccctaaatgcatgcatgaagcataaagaggcaaatactaaattgttttattcttttgtaccacggcaaaataaataccatcaagaaaaaaacactgggtaatggatatcgatatcgtttaatttcacaacatagaagtttgttagctgtatcctatctagatgtaaatatcaaatcattaggtactcatatgccactacagagaagtacatatcaggaagaatgaacaggttctctttttccaattaatgtcttcatgtattagcttgttgtcgttcttgaagaacgaactaaaacaaataaaacaaaatctgcatcaaatgatatacatagagggatcacaatagttttccattgatatatcagacatcgattgtagatctaatggccgaattaatttaaggtgatgtggcacgttgtgaaaggagaaaattaaagtttgtggggataaattgtataagtatataggataagtacattgtatgatctgtgggtcataattaatttacacgtactgcttaggatactttgatgcagctgcatgaaggtagggcaatactaggctaaagcttacagacatccgaatcgagcatgttaatgattgatggccgaaaaaggataatcacatgattaaagccttgtgctgtcttatagctttgcaatgtttgttctccaagacctcaggtggagcatgcattctacactgttacaacatgcaatgtgtaggaatctgttttgccagaaagaaaggccatggagtactggcagaggttaaaggagcatgcatgtatttggaccactgcatcaggaggtttttgtcttggcacccaaaagcttattcttatcttgcccaagctatcctgttcatgttatgctacttttgattgcattgcgtctgtgtctctgtgatagctaggctggtatagctgcttcagaatgacggcgaacatatcagagcctgactcatgtaagtttgcattgggcatctgggcctttcttgtatcagcttgggattagattgggctacctgtaattttgcaggctactggacctgtccatctctatgggcttttttcataggctaaatccccagcctccaaccgaacatctctagcagccagcacaagcaacaggcagcctatcagcctatcagctcaagcaacggcaacacaacaattcgtgatcacttatcagccatcaccaaaaagaaaagaacacaaaagattttaaaaataccagcaagatatctacgatgatttcatgaatctcaacaaatgacagcacaatcttttcgaatatgcttatagaggtaaagcggtgtatttgtagaatgagtatgcacgtgttatgatcgcatacgtttatctttaaaaaaacacacacacaaaagcgagataccacacttgcccaataatgcttagtcgactacatgacacgtactttagccatctccacaaggcaaatccactaccggcccaagccacagtagaggtatcaccaacaaactcacctaatccgctccgtgccaaagctgcctttttagttttgatccatcaatccttgcaccaaaaacgctcacgaccaaaaaaaacgtagctggacgaaggccggcactgcaaatttgcaatgccattccgttactcaaccgtgtgcggcaaccccgaaagttaactcaacgccgaagcgccagaaaccacacctcgtctccaggctccagcgatcacttgcaagcaacaacggaaaaactgcccgatttgcttcgatttttggttgtttttccttgcaagccaagtgccaaccatccgcaaacgcgcaggccggcttcgctcgaccgccaccacgcctcgtgcgtgcatgcgtttgcacgctttaaatcctcatcaattcccttccgttttcgcagtagcaacattggcagagacgaggaagagaatgcgagcaagtgccagggcatcatcatcatcatcggcgtcaatggcggcggcggcgcagcgcgacgacgtggagtcacggcgtgatggtggtgagaatgagaagcggccgctgctggagaagcgatccgccggcgacggcggcggcggcagcggcggaaatggcatgagcccggtgcagagggcgatcagccagacgtaccagagcacggcgcacctggcgaagctgctgccgacgggcaccgtgctggcgttccagctgctgtcgccgatcgtcaccaaccaggggcactgcgacgtcgaggccaaccgcgccatggcgggcgcgctcatcgcgctctgcgcgctctcatgcttcgtcctcagcttcacggacagcttccgcgacgccgccacggccggcgccgtgcggtacgggttcgccacgccggcggggctctgggtcatcgacggcggcgcgccgctcgacccgcaggccgccgcggcgtaccggttgcggctactcgacctggtgcacgccgtcgtctccgtgatggtgttcgccgccgtcgcgctgttcgaccagaacgtggtgtcgtgcttctacccggtgccatccgagggcacgaggcaggtgctcacggcgctgccgatcgccatcggcgtcgtcgggagcatgctgttcgtgagcttcccgaccacacgccatggcatcgggttcccactctcgccgcgctaatatttagtagaattctgcctgcacgtacgcctatatgtgcatatcctcgtcttagttctttggaccattaattgcatgtaattaaattgtgacacgaacgaacacactgtaaagctgatcacggccccaatgggctcgcaaggagtcgatgcttacaagtttaacttaatctacgctttgtttgagtacggcatgacgatatgatgaacttgtgggtgcaaacgggcgggaaattagctagcattacctcgtactagaaatgcgtgcaagcttggatgatgacaaacttgtgaggaataccaagctcacaagtcacaggtcaaaccggggagtgacgcgatctccaactccaacccgtcgtcctctcgcgccggcaccgtgaaggcgtgaagcgagggcagcgggtgtgtggactgtggagtgggaagtgtgtggtgttttctcgtcgcgtcgcgctcgatcggaggctgtgcagcggggttgcacgccgtggacgatgatacttttggttgggcctattgatgatattgtcgagagaattggcccgtggagagcaggacggggttcggaccgcggttctcatggcccatatgcattatgatgacatcgtgtactatactactgctgttgactttgattgtgacttcttgtattgacttccaccgaggaaacatgtactatccccgtctcaatcagtccaccactactattttttcattggtaaataacaaggcacttatttcgtctacctccgttttttaacagatgacgccgttgactttttctcatctgtttgaccattcgtcttattcaaaaaatttatgcaaatgtataagatataaatcacacttaaagtactatgagtgataaaacaactcataacaaaataaattataattacgtaaattttttgaataagacgaatgatcaaacatgtgagaaaaagttaacggcgtcatatattaaaaaacggagggagtactggatttcatacacgcgtgggaaagaacggctctgatcagctgaacctaatccgatataccaaaacgacgaggggttttctgtaaaagttgaaaacgtggcatggcggcgaacccagcacgtttaagatatatagtataccggtttattctttaaaaatatttttagaggtagagtatacacttatacggatgtgcgtgtatccaacaatctgctttcgtagaaagagagttagagcaggtacaataagctgactgagcaggctccaaaaatatccagctcatcaaattcctacgtggaagagagaggagagaacaaagcgagcgactaatctatagctgggcgatagcacgggttcgcatgcgctttgtgggtcccacggcgagccatccgatcccgtgtgacatgcagcgctattccctccccctccgcagcccatcttgtttctctcctcacgggagtgtcgcagatcgatctttgccagccatcgcctcgcagttgtcttccgcgtcgattccccgcccaatcttcccggcgtgtcttcgccggccgccgcttgcgattatcttccacccggacgcctagcccaatctcgctcaaaagcctgaccaagaagggtctgttgatgtcgtcggcgcccgtggtggcggcgatgacaagggcgttcttcttggcgactcggccgctggcatcgacgaacgcagcgctcgcggcgcagcagatcgtgaacgtggcggcagcggcgggcgccgacgacaactgcgggctggcgctgctgctggccatcgcgtcaagaaggggcagatgcatctacgagcagaacaaacggatctcatcgttgatggagcagcgaatagctttctaatttgagttattgtcatctaatctcttcctaattcttttgttcttctcgtctatttgctgtctgtgacttgtattttccttttatgtatatagcactcctgagtattgcacaacaacgaccacagggattgagttcactttcgatcatgtatatcaatatatgcgtataaaataaatttttgatggatgagatgcagtcaacacaatagccactatgttgtacaaattagctttaacatcaactataaaatgacatggatacgagtggagccatcagctggctatactattgaccttgctcttaggggggtgtttagatccaggggtaaaattttgacgtttcacatcggattttatataggatgtcgcaaggggtgttcgggcactaataaaaaaactaattacagaatccatcagtaaaccatgagacgaatttattaagtctaattaatccatcattagtaaatatttaccgtggcaccacattgtcaaatcatggcgtaattaggctcaaaatatttatcttgcaaattaatcgcaatatgtgcaattagttattttttagcctatatttaatacttaatgcaggggttcaaacgttcgatgtgacggggtgtaaaagttttttttacgttggatctaaaatttttagtggtagtcttcaattcaaaacacgtccaatcacaagaacagtttaaccatcacatcgaaggtacagaacacaaacatcgacggatccaaactcatcaacctgaccccgaatcccactgccacacgggccccaaatcccacggcccacatccccccacccacaccacaggccgcggatacttcactggattcccaatccgacccaacccaactggcacgccaggcacaccaagtaccccaccaccaaccagggccccacactcccaaactcctcccacccgcacgccgccgttgccacagaagatccacgcccagttctacgccacctatgaacacgcgcgcacacacgccgcgcacatacatgatcaaatctcattcgctcgccaacgccgcaagatcgagcgaaccccagcgaatccgagcgcccacgcagccacatcccatcattattccgcacctttcctcgctttccttcgcacactcccggactcctctcctctcctctccccatcgcgaagagaaaaaaaaaggatagcaccaacaacaacaacaaacacagcggaaggaagcagaggcggcagaagagtcaggcaggcaggcaggagcagcgaataataaaggggggtttttattaggagagtagtagtagtaacaccacgatggaacgagcgatccaaatcctgaccagttcggatcgagcggtggaagaacaggtttggagtggcctcccgtgttgctcctcctcatcctcctcctcttttctttctattcctcttcttccccgcggtctctttcccctctcgcacgcaccctccttctcctcatcatcctgctcctcccctcgttttgttgttgttgttgctgctgctgctgcggatcgaggtcgtcgccggattcggttcgggtcgtcgttggcccgtgggctatatatcgaggggatttaggtttgctggattttggagtttgtgtgttgaatcgatcgtgttggcggcgggcggaatcggcgaatctagggtttgggattctcgatttgattgatcgggtggggggatggattcgtccggcgatggaggggacgagggagcgggagctgcgccggctggggtggaggaggagagccctgccccggcgtcggctccggctccggctccggcttccgcttccgctcccgttcccgccgccgttggtggtggagcaggcgcctctggatccagcgggaaggtgaagcgcgtgatgaagacgccctatcagttggaggttctcgagaggacatacacaggttcgtggatgatggcctatgggggactggggattctggaaatttttagggctatttcgtgtttgatttgtcgatttttcgatcgaaacagccctgtgatttctgtgcttacttggttttgtctgtgttgctgcagaggatccgtatccaaatgagacgatgagagcggagttgtctgtgaagttagggctgacggacaggcagctgcagatgtggttctgccaccggcggttgaaggaccgtaagccaccgccgaagcggcagcagctggaggaggaggttcctgtgccggttatggcgccgcctcctgttctgccaccaccactgccacacagcgagctaacaatgggtactggtgggatgtatggcgagccgttgctgtccccctcttcccggagaggaactggcagaccatcggctgttccgaggatttctgcatcagaggttgcgcggagatattatgagccaccacaagttatgctacctccgttggcaccaatgcagctcacacgagctgagcaccgggtgattgattctgtggaacgactgataggggagccgctccgggaggatgggccagtgcttggtgtcgagtttgatcctctccctcctggcgcatttggggcgcctattggtatgtttttcatgcccatgatgcttccatcctgcattttataggtgctgcaatatgaatgtttcacttatttagaaagaatcctttgcactgttctaatacatatacatgattctaaaaaccaacatgttggatcgatctttatagttcattttctgtcatcacccactgttcgacaggtaaactccgtggttacctacataactgagaattgtgacagatattagacttgcatttcatcttttatgtgtttaggaaagcgttagcaagtttaaatgatgattgcattgtttcagcgttgatactgataatatgttcatttcatacttccaatctgctgatttcaattgtgctgttattttgctatgtttggagcagttccagagcaacagagacagcctttccgatcttatgaggccaaaatgttttctgggcatgatacaaagcacattaaggtatgttacattagcacttagcttgctgcatgcatgcatgctgtcttttgatagttgacttccagtaaagggtctatttatcaatcctggttatcagccttcacaggttataataatgtaaatagtgtaaaaatattcatgttatactactgatgttggatgcatcataattctgcaatatctataagctaatgtggtccaaagagaattaataattaatacttataaaacaaaactttagactaccgatgttatattgtagttgtactagatatttacctaaacccatgaccattcacatccacttttaaatacttcaccgtccttatatttgattacgtctcctgttctgttcatcttcaagtttagctgcttttagtatagtcttttgtttctttacttatcaatgtattcaatctatgttttcccctttcaggcatctgcattcttgcctagcatagatccttttgttccaagtacagtttctgggaagagaaagtccatgacaggaagttcttcccatcttggttcacgggcagttcgtgaataccaatttattcctgaacagtcaagtgatatatatgagaggacgacccagtcacgatactatgatgttttaactgaagcttcggattcaaggatgtcgacaggatcacgattcctccatggtgttgaaaaggcacctggctatacattccatggacaaatttctggttctagccatttatctctacatggcaggccaccagttttttcatcgggatcaacagattatgagatggatccatctaatatcaattctagttctgttccaaatgaaagccagtatggaattcctcaggttgctggatttgaaaactccgttgcaccctcagacagaatggtttatcatgatgacgatgcttttcgaatggaaagaaagcgcaaagtatggtttttcactgactttatgtaaacttgctcattattccggatatgcactagttgctgatgtgtgatcattttcttaaaacagcatagcgaggaagtgaagattgcaaaggaagttgaggctcatgaaaaacgaatcagaaaggagctcgagaagcaagatatgttgaacagaaaggtattccttattcatgttacagaggatcatgcatttgttcttggtatgagatttatatccccctgtttgcagagagaagaacaagtgcggagggaaatggagagaaatgatcgtgaaagaaggaaagaagaggagaggttgttgcgtgaaaagcagaaggaagaagagagattccaaagggaacaaaggcgtgaacacaagcgaatggaaaaatatttgctgaagcagtccttaagagtgagttctctagttctaggacttttaatgtgacaagtatagagttcagattattgctactatgtagtttacaatcttttgtatgtgcaggctgaaaaaataagacaaaaggaggagcttcgtaaggagaaagaagccgcaaggcagaaggctgccaatgaaagggctacagcacgtagaattgcacgggagtatatggagctcatggaagatgagcgcctagaactaatggaactggtttcacgaagcaaagggttgccctctatgctatctcttgatagcgacacgttgcagcagcttgattcattcagaggtacgttcaacactcctagatctagtcttctagtcagtgtacgctgcagaatttatcagcttactttgttttcatttcagaaagaaactacatttgctgattgaataaagaacttttcttttctcaattgggtagatgcaattgttatggctttaaaggcacttcattttaaggatgaaaaatatagttatatgtttacaaaaataatagacctgatactcgaatttatgatagttcttttgttaggttcaccctttatctgatatggcagtgtgaaatctaatttcaccccttcgtagttttatatctttgtaaagagtagtgcttggtatttaagccgaaatcagtgtacctctctgtacgaaaaactgaaataccttgtaacgcacttccacattctcaaattcaggatgagaaaaaatagaataggttatgcaatcattatctacagcctacttgctgctaggtcatcaaaaatactttctttggtttggatcgaatagtcacactatgggttatcttggtgtgttatgacaattttgttcactcatgttacctagtattcagtgacaatttcttctaggtgacaattttaaaccaaaaggcatgacaccccagacccaacttttattaaaaagagccagcaaagttcttagcattttacagcgcgcatacaaaacacttcacctcacatgatcactacacaaacatctctggctgcataatataggggatctaaagttttgtctgcccttttacaggaatgctgagacaatttcctagtgaaattgtgagattgaaggtgccattttcaataaaaccatggacaagctctgaagataatattggaaaccttttgatggtactttcttgttatgaattttcttctattcaaagtgcattatatgctagaagcctatagagttgttgtaagttgtaaaaattgctgctgtttaatgatatccacaggtgtggaagttcttcattacctttgcggatgttcttgggattccgtcattcacgcttgatgagtttgtgcagtctcttcatgattatgtaagttaattgcccattccatcatgctaaaagtgaatcctggtatggtgcaaacacaaatgtgtgagttgatggcatggtgttgcttctctgttttatcctagtaatatgaataagaaccacaacatgacatggatgttttgacatttgtactgtacatgatattctgtgctctctgagtttgtatatccaactcatcgataccaaaatatgctaactggcatttgactcttggtacattattatagtacgagcatttaacttttggtacatgtatgattcattctcacatctaatattttttagctgcttgttctatgtgagtatgactattgatattcatgctataggattcaaggttgttgggagaattgcatgttgctctgctgaaatccataataaaagatattgaggatgttgcccggactccttcagttgcttcagggatgactgctaatcctggaggtggtcatccacaaattgttgaaggggtgtgtgtgcagatctttgctataacatagagcttctattcaaattgagtaaattctgtgctatttatattttctaaaacattcctgatctcttattgctaggcatacgattggggcttcaacatacttgcctggcagcgacacttgaatttgcttacatggcctgaaatattgcgccagtttggtttatctgctggtcttggaccacagttaaggaaaaggaatgctgaaaatgtcaataatcatgatgataatgaggtatttgtctgttgaaagtgtccaatgcatatgcatttaaattagtttattcctgatagctgcatcataatcatgtgcaatctgtgtagttctgttggaggcaataacttgcacgattgtagattgtattgttgtatcaatatctctggtattttggttcctgagcaattttcgattcagagaaaacgcctactgtttagtcttatagttggctccatagaatcctgaggtacaatggtatttatgcttttgatggaaaattcaaacatagaagctatcagtaccgcgatcctatgatcttgctaggctattttgatcttggtccttccaggattgtagttaggaattacaatataaaataacagcataatcctaaatatttggaatcatagttctcgaggcattggtaggatcatggtcctacgaacaagggattatcctatcttaaatactgaatgtggtccttgaatgaaagtataattggagaaacttttgtaatctgaagcaaaaaagcagattagccacttcacagttttattctctttatggcaagaaataaaattctctcaaccctaacagccctgaacaactcaaaatttgcaaacagggtcgtaatggtgaggatgttatttccatactgagaagtggctcagcagctgtaaatgctgctgctaaaatgaaagaaagaggctacggtaatcgccgcaggtctcgacaccgtctgacacctggaactgtaaagtttgctgcgttccatgtgttgtcacttgaagggagccaaggtctcacgatattggaagttgcagaaaaaatacaggtatgccgaccacatccaaaaaagttcaattgtaacctgttgctatcttattgattttgtttattgatctcttcagaaatctggactgagagaccttacaacaagcaagacacctgaggcatctatatctgctgcactgtcaagggattcaaagcttttcgaaaggactgcaccttcaacatactgtgttaaaactccatacagaaaagatcctgctgattcagaggctgtgttggcagcagcacgtgaaaaaataagggtgtttcagaacactatttctgagtgtgaagaagtggagaaggatgtggatgatgctgagagggatgaagattctgagtgtgatgatgctgacgatgatcctgatggtgatgaagtgaatattgaggaaaaagatgtcaagacttccctggttaaggcacaagatggt

SEQ ID NO: 81958 - DNA, 43203 bp, Oryza sativa
  unsure (1)..(43203): unsure at all n locations
ccagccgccgcctccccacgtccgcccgtcgctgccgagctcaccgccgtcccgcctgtgggctgtggagaaggaggcagctgaagaagaaggtgagagaaagagagaggaaaatgagtggaggagaaggaaggtgagaagataagggagagagagaggagagaaggggccacggggagagagacggaaattttgaataggatgggagggacggctatttttcggtgcgggtggattaggaggcccgcacatgaaaatagggttattttcgcgtgcgggcctgttaagtcacccgcacacaaaaattgattttcgtgtgcgggcgacgctcccaccatttttccatgcggtctgacttacggacccacatggaaacaaaacgggggtggcgtccagcgtaatcaatcctgtagcagtgttatcactaatattcaagattttttccgggtggactcgcacaaacacaatgagcaagagcataggaagattttggcgatgcagctatcacagctcacgacatttttcttctcctcttattaacttaagccaagcatgcaagtgcatatttatacaacgacaacgcactcacatgaataccggataacttgctccactaagctcatgcatgcacaggatcctatacaagctagtagagctgaccatgtaaaatgctactcccctgtttcatattataagtcattttgattttgatcaaattcaaactactttaagtttgactaagtttataaataaatatagtaatatttacaataccaaattagctttattaaatcaataattgaatatattttcataatatatttgtcttgagttgaaaatgttactacttttttctataaatttagtcaaacttgaagctatttggctttgactaaagtcaaaacaatttataagctgaaatggaggggggaactaacttgcatgcaagctaacaaactctaaacgtgcttgcgtgcacatgcagccactaatcactagcttggtcccatgaaaatgcttcctttttgcacgtggctgatattggcgccactctccagccgcttcgcacgacccggctgcattccggcggatgaggcttcgctgacatatgggctgatgggtatggggcacatctgagacccatgtccctctaacttaaagttagaggagctcctttctatttcggtcaagcctatgtatttgtacgtatcacacgtattgccgggtacttcttctgaagccacacactgctacagtgctaagacctatacaaccactttctacgtgcaaatgaacaaaatatatatgcatagtattaatgacaagattatttctaagagtgcagccggccgggtgcctgcttctgcagttttgcttgcctcgggccacttctggatgactgcatgcgtacaactttgttgcagggctgcagaagagccccaagttcccatgatcaaccaaggagctatagagggtggccgagccctctctgcccctctgctgcatccgtgtctctggcagcactaacatacactctcttgcaacgaatagtttatctccaagttagaccaaaactcccgacaccttcttttcctaccaaggatagagagaaaaaaatataacccaagctaaagtcattaacaattaagcatggaatgtctgtgtgtgtgtgtgtgcatcctaattgatgcgtaagccgggagttccatggtcaattacctaaaaagaactatgcatggaactttgccaatgagaataacatttatatgcatacaagtaaattaagaatggtgtccccagtgtaacaactcgtctacctcgatctggtttcaacaaaaaagcaagttcttttaattagatgtttggtccagaactacacatggaaacttttgtaggatcgaatcacaagaactaaaccaaccagagggggggtgaatggttgatatacctaaaaatccaaactattagcagaaataaaagttaccctcaaattcgatgtagatcggtctgaccgaggttgatccgccggtttgaccgagctcatgccgccggtctgaccggtgttgatccgccggtccaaccgcctgaagattgcctgccgcgtgtgaagtcgccgccggtctgaccgcctctccttcgtcggtttgaccgccgcctgccgccggtctgaccgccggtatgtcgccggttggaccgccgaacccgatgaaacacaaatcgaagaactcttaaagtagatgacaactttatttcttctctttgtgtttacaaagtgcaccaacagtactccttacaaaaatctcgactaaactcgaaaccctaactaaactagcaactcaattgctctcaaaagcgatacaaaagcgataccgggaagcctcacgctccccctctatttatacatgaggtaggcagcctaaagccacgaaccaaactcatactaagagtcctaaacaccttaggaaaacctctagtacaagaaacaaactttacataaccaatcataccaaatttagactccttccaaattcgactccgcatcccatacgcacacaatacctccatcgtatgtcatatgaaatcttcaccaaccatgtgcatcaactatagccatagtatcccgcatgatatctgaccaccacggacatcgtcttaccaccaagccgactcccggtccatcaccgcaaatactctcccgagacatcgagtcacctacacatgaaacaaacaaagaaatcatattccgagaccaagctgacggagcgtggggctcctcaccgggagaccgcgcaggcccccctttgccggttcggccgggggcgctgagtgaggttcttcgctctcgatctgaggaaagtcagcgggagaggaagtgcacaagacacgggcgacgtagacaggttcgggccgctgagaagcgtaacaccctactcctgtgttctggtggatctgtgcgtgaaggaatacagagaaccggagagcgagagtgagttcaggcactcgcccccctttcccagagtcccaaccccctttctcctaggcctgggcctcctttttatctggtcaggggtcaccacatgggcctctagctgcctaagaagggaaacatgctttttacaatgagggctagtctacggccggaaatgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccaggcacacgccgcgaccggtcacggaccggataagcgtgcgctgcgccgcattaaatgcggcgtggcgcgttcgtccaacctgctataaatgcggttaggtgagccccgctgtgctcacctaacccacacatgtggcgccaaaaccacagggggtcggggcgcctcagccctcggggccgaaacgggggcgccccagccctcggggccgaaacaggagcggcccgacccctcaggaagacagagggaggggtggccacgtcaccctcgggcccgacccccccgagggggtcaggccacgtgggtgaccgcggctacccaagcctctagtcacgatacccccggccccatgtcaccgacacaagctatctccaacttgactcattgttagcaaacaacagtattacatacgtatagtatccatctagaagccataaccatgaaacaatcacggatatccaaagaaacaacccgaaaccgaaaccgacatagcgtcggccggtcagaaaattgattatctccaaaaccacttcgacgataatctccaaatctcaaaacctataatcacaaataccaattgttcatcacaaaataagaatcaaaacacactttgatcttacaactttttcgatgggggcatttggttctgatttttcttaagataatggatagaaatctgggctctactataatgtgcactcttacaaacaccccacaaatgacaagagcaacattcttgataagttgatgaataacatacacggtgaacatttttttaatgtctggctaatgttacattggaagcaccacataatttggtagttacttttagttgttgtattgggaagaaatgttgtatattacaacaagaacgaactaccactgcattaccttcttctcctgtacagattttgaatgtcgcatagaacaagaggggagaaccacacacaccatgatcgatatctgtggtgtcagctacgttttcagataacagctgcaggacgccatcaagttgtgctaccgatagtatcaactgatcgtacaactatctctacatcatctctgttgcttcttgtaatctcatggattgcaagaaccttgtgtcgacatgcttgatttccaggtgtctctccttcctactaaagtaattcactgtcgagtgaaaacctaccattctcatatggcctatcacttctggtttgtagcttcagtactgataatttaaggagacttttgtttctggcttggctctataccatgcagaaacatactttattatttatcattgagttagtggtgtgcatttcacatgttcttgacctgatggaataagtatatataatctattatagaaaaaatgcatatgtgttgcaacgggtgaaggctattttaatcttattattattgtacggtttagctaagatgaaattcactgtgggaaattcgcttggatattctttttacaaaatcatgagctgcaattaggggtctgatcgtctcaagttagcatgcaagttttttaaagagatttcttatatgactccttctgtatttctcaaaatgaacaaaattaaaaaccgactcaaacatggatatatatttcgaaaagcgattgaacttaaaaaacgattcaaacacggatgacgtaccaaaagtaccggcaaaaacatattcaatttttataatagtagagaaatgcatttgtatggtgggcagagttattattatggaaacggtgctcctactatataagaggcatcctcaatgtttgcagtacagtgtaatcttaaggtgggccctataaatagtgaaccattgttaaagccataccccaaatgctatggttagaatttagctataagatgggctcacatagaatggaaaaaagaattgtttcattccttgttcatgaagtgaatgagagggaaaaaaatactttctttttgcttgtggtacggtagaccttaagcataaggtgcactctaaggtaatgctactttccacaatttatatggctcaatttacaagtgcagtcgttgtcttaagatcacttttttcatacattatggttgctcaaccaaccgatgacatagcatccccttacgtaaggtagtacgactacggcatcagtgatggggctagaggacaattttctattcacatagctcaaattattaaaagaattgcaaactaatatctgtttttgcagcattttctttatgagaatcattagaaatatatatataatttttccttcaaaagtggatctctagtccccgtgttataaaaaaaaccatgatgttttcgaaccagagaatgatgaacaatggtgtactcagttaacccttggctttccagtctgttattcctattttaccacaattggaaacctggacgctcactttttaagaaactgtgaaatgcatttatctgttttcatctcttgatgaccaaactgtgtacgtaacagctatcacattccacaggtcccatgcaacgactgcaaccagtgaagctaggagaacatgttagatgggcatgcagcaagctgtgcagcgagcggccttgagtgtgggtgtggttagaagagatcaatgtgttgatgccgcctcgatgccacaatgcccggctggtgatggaaccctctccatggtgctataaccctgcgcaaaatttccatttttccactgaaaaggagcatggtttggaacatgccctttatctgtcgcctagccttgagttcctggtgcctccctttcctataccgattagtgtgctaaagtattgcccatgttttaccgctagcgttacacactaataactatatatattgatagagcattgttccggtccaacatattgtaaatggagatactggtaacttgaaggaccaatctaaatcgggccgttcattcttaatgggtaagattgaaaaccaagccagagcaaccctagcacgctaagtccagctcgtgatgctccttctctccgaccgtgtctccgccgccgtgctctccaaaaccacgagcaagtccaagcccagcatggggatggagatcgaggagcccgaggcggtacagcccatcaccatagaggtcctgcccgccacgtcatgtttgtcaccggctcattgaagctgttattctgtcttgttcccttaatcccctcttcaatccgccttccgattcggaaaaaaataccatggcgaggcacgcggatgcactgccatcacagtactgcggtagctgaaggggttcacatgtggccaataaatcggcgacggccgtcgtcgacgtgctcgaatccgtcagcgagattgggggaagggtcgcgcgggaggcgtatgtcactggtgagcttgggggaagtgatgcacgaacgctcgttggctccctccgcctgctagtccgtccatcactggcgagagtcctcgatgcgacatctttaggagagagaaaagacaggaggaagataaagaaagatatatgcgaattaactaaatacccttacttttttagtacctctctgtcttatacgaaatcacgtgggcagtatcactaggtataactctttctcacccgttggatcagatgaaattgatggctctgattacattacaggtaccgaggtaccttctagatagtaaaaaaatatagcaaacaatgtattccacagtaccatcatacatgctttcaacactcggatgcgcacctcttcagctattcatggtagcaatttaagtgctcgctaactgaatatggattcgcaaaagtgcctgaaaagttcagtgcttactgaagatcacagagagacgcttgggagacaataacatggaccagggctcgattgtgaccttagcacgggccctattatatgggccggaatggaaatttcatataggaataagtctattttgccttccccaactcatgttcctgcttgaatcgcatcactcaacatgctgaagaagtatagaacacaccaatctcccaatgcttcccaagcttacatcaagtatgatgataaaaaaaaaaaacaacaactctttggacttcggtttcagagcatggtcaagtaaaaccaaaggaagaaagaagcaaactgagaaatataagcactgtattcatgatctctgacaacaaagattcagtatagcaaatgagcacctgcaagtatttaacctcatctatacggttgcactctacgactctactttgtgcgttaattggagtgtgaagagtacaaaaatagggtaagataaactcattgagtgaaagtttgatactgccttgtacaaatcatatatgaaacaatcctctgaacaattttgcactaaattgctcgagatattcgtatactactctctgtatatggatacaaatcaatttactgaagcttgtcagatagttttgaagtgtcttgactactttgatcaagcctcatgattcaagagttccaagctatcaatacatcaagcagattgatggacaaattatagcaccgtatataatatagcccgataaaaatatttccaattctttctaattcaataggcagctagcattgtactttgactccttgtggctcttcattgattcattcatggatagagggaagacacgtcgcattctttggaagtgagtagcacataacagaggcacacttgtatggttgtatgtttcttccaagctgctcaaagactacgagatcaaataatgcaacaatgctaatcagaattcacaacgaaatttgaccatatacgtgcactttgcctattgtatccttatctgtttttcgaaaagtaatcctatcaaacaattcataatttggttgtttgattaattcgcctaaatacattgggttctccagaaagccatgctactgagtattccctctgttccaaaataaataaacttcgtacagtacgtgacacatcctagtatgatgaatctagacagtatactcccttcgtcttaaaataaatcaaccatatgatgtgtctagatttgttgtaatatatgtcacatcctgtggttgatttattttgtgacggaggaagtagcatattagtactatattagttacggagcttggaatccctgtaaaagcccaatacatgtccaaattacaggcccgtaattcttttccgaactaggctaaaaatggtgcttggatggactgtgtcagactaaaattacagctgtattcagcccattccattagattataagtgtggcctggtagaaaattaagtgctcgctaattctatcttctacatagttggtaaccaaaaaagaatttatttctataaagtaaaatatgcaagaagccacatcatcaacaattttaagccatcggatcgcattagtatagagttatcatctgttggatcaagaaactactcatccatttttaggttgcttgctgggccggacgtttgcttgcgggttgaggcagaggggaggagaagagaggacagcgggctggcttggttgtgggctgaagaagaaaatggactggcaatagcccagagagaaatgatgatttttatttaaataaatgttgaaatgatgtttattttatcaaaattagcaattaagctctggaaattccaacaaattttcaaagagtgttattaattatggttaatttaataaaaattaaatccaaccatagcattttatttcttacacttactttacttgtaaattaatttaattatacacctacctacttaaaaaatacttcctccgtttcatattataagactttctagcattgtccatatttatatagatgttaatgaatctagatatatatgtgtatagatttattaacatctatatgaatatggacaatgctagaaagtcttataatatgaaacggaaggagtacccaaatacttcagaaaatttatatttcaatgaattatataatgtaaatctttcttaacttttcctcaaatttatcgtcttttcttcccgttgcaacgcacgggcactttttctagtaaaacaaaaatacagatagtgttggcatgggccagaatggagaaatgtgaacaccttggacctaggcgatggtggtggcctgatgccactgcctgctaggagagatcaatgcagaagaaatggagaggccggtgacagggcgatgattctcccgtggacaggctgcaatctgcaaaggcaccggaaacaaacggccggccacttgagtggaggcagagatttcccttaaatatccaaacatttctgaaaataatgattttttttgtaagttacattagttgatcccagcttagtagatttctgcctctaccctgccatatttgtgttgcatcgcaagcaagcggtttttttcctttgcttgttccacttctaatttattttttcttcgaaaatttatactagcatgtgaaaaataaattagaagacaggtttttatacagttcgtgggattgctcacacttttttttaaggaattagcggcaagagatctgctgattatattaggagaaaaagttctgatagttctgacacatatagtagctgataattcacctccagtcatgaggtgagattaggaagaatacaaaaagtagattacatattgctcacacttttttagataatgatattcctcacacttgtatccctatctaaatccaacatatgttggacagtgatgcaagagcagaaacagtttggtggcttgcaagaataatctgactggcttgaatgtcagttcccttggcctccccttcctagttctcattgctcttcaccatgaattgagaagacaatcgtcactccttactactcctagcagctaggatattctcattcttcggcggcatttccgacatatatgtggccggatacgaagatgttcttatcatttatcagtgaagcacaaacagggtgatggtaaatatgaactagctaaggaaatatataagctgagctctcaagatttacagtagctcagattaatctcgtcatgcatagtcaaaaattaattggcttccatctttgacgtgataaagcatccagccaattgccgtatcatgatttggaacatagagttaattagtcactacatgttaatgtaaaaccagaatgaatgcatggacgtaaaggggtcagtttaattgatttatgaacaatatcaactgatcaaaccacaaaccacggatgtctttggtatggccaaagcattgctagatcccaaggctgaattttgcagaagagctggtatcctgagacgatgttggacttcttttttttttttttggaaccaccaacttttcatggtcatggacgttaacagtatggttggtaataaaccaaaacaacagctgatttggtttgtaaaggtggcaaactagtgcttccaaattaaagtcacaagacggtggttttatgaagttcataaatatatagtagctattcacacattattaatttggtaattgacaaacagttgctagctctcagtggatgtttcttgtggtaactgcaattaatctagtatgtacctgttcgaatacactgaatttataattagctaatggttattgatcaaggtgcaggatccaattccaatctgatgcaggcttcgcaagtaggtttgcaactatatcaacctcccattgtattgtatcggctatacttcaacgaccatagtctctcctcgaacgctatcatagatcgtcaaatacagcaaaacggtactgctctactggaataagttgcacttgcttttttgctccttacgcagcttgtcgtcttgttgtaaatgatatagcaacttgaacatgaattcctgaggcctccatttcctagtggatcaaatatctgaaacgactaatatatatataactgattactaatcttttttcatgtaatatatgtaaaatgaaaatgtatttgattattttataatgaacaattggcatatatatgatattattggttttgatatttgcaaattattggtgatatggttttggagatgtgtgattttcagatgatgaaaaagattgagttgctctgacggtcatggtcagacaagcaggactggactgatcagaccggcgttatgcgagcggtcaaaccggccagcccgactgatcagaccggcgttatgcgagcggtcaaaccggccagcccgacggtgaccagctgaattctaatacaaagacacacaaacaaacatgaacacaagtgacctagagaaggccagaattctaatacaaagacgcacaaaccgtttgtatacccccaacagacaccatggaacttagacgtgcattctcggtgtctccctttcctattggatcctattgaacatcaccatattactgaacgaacaatctctcgagaaattgctacacatacaactggcatgtacgacttgtgaccaactagtacttagttgtttcttgtcctggcccacatgtagagatgctgctcgtatggagagaattgattggcagacatgaggccggaccggataggggtcagacgatgtggtcggatgtatagcagtactcaatctctcgcatgctgctgtggatcacactgtacttgatgagtgctagtgaattttaacaagactgtttagctatccaactctatagcaaggaagcaaagatagtgactattattctatcaagtatgcaatggcttgtaacaattaatattgtaggtgaacggtacatgagcaattaatagaggtatcatgcagtttcaaggcttcatatgaaaagtaattacctcatccttgttggaacacacaacgatgtggttcatgtaaaacgaaggtgcttgcaatgctgcgaaatcctctttggctggtgtacttttccaccaagcatagaagtttaaggagaactgtaggtcggtggctacctaaggaaactccgattcgatccgccccccgttagaacagtgacaccatggatcactggctgcaatagccatcatgggaaggaagctggatttgcgcagcaaaaggttatagcacaaggtaatgcagtgctgggtttaacatatcctagagagagatgcatgcgcatcttgcaggaatgtgctatattactcgagtttcagttccctttgcctccctttcccattgcactttgctgtgaagacaagacaatggttagtaattaacagccacaattctcattcggttactatatatatgcgggcaagtatatactagctatagtataaatatatatgctgagatctccaagctttatgctagctcggattagtttggtcatgtgcagtcaaagtcggacttgtttgagacgttccacacatacacttgactgactgcaaatgtgtacacttttagttactgctagctagttgtagactcatggttactgaaagacatatataatgccaatattggaggagataacaaactgtaccaaagttgtagcctttagaatttagacatgtttgattgcaatacttgattggatataaaaggttgtttgactatgcacacctaactcacttatgttgcagtctcctctttttttttgtaaaaaatatatttctgaagtacacctctctgatcttataatggaaaaaaagtagtcttccactcgtcatggtggaaaaattcttaagctcttgctatttaaaagtgatttaaaaatggtgctttgcagataatcaataattgaaaagcactactagaaaaattatttttgcaggtggccaaatgctttgcctgctatttaaggcccgtgaaaatcatcaatttttgtagatggattttcatctatgtgtaaaaatcgattttcgcaagtgtccaccctaagagccccacgaaaatctccttttttaggctgcacagttaagtgcccacgaagacgaggtattgctttccaaggccttgtggtgacggatccatgctcccaaggcccagtggcagcagatccgccgccctcgacaccactgccaatgatgcacgagggagagatgaagattgtgtcgatagaaccaccattattgccccttcatcgccgttgccgacccaccgccactgaggtctaccagcaccacgcaacccacgaccttaccggatcctagcccgtaagcctcgctgtccgcgtgccaagccaccacctgggccccgttgctgccctaggtccgccgctagatcttgctactgcagctcgatctccacctccagatctgtccattgtagccttggctgtgccatttcctgagttctgccacttgggccccgtagctcctccttgttgttgctgagccgccaccactcctttgtcttgtcgttgagacatcgtcgccaccacgcatgggttctttaccacaagaagagcggtgggagtgttgagagaggagtgggggactaagagggaggacagtgatgaatgcgtgatacaggacataggagaggaatgagggagagggataatgttgaatcgatggggacagagattttaatcggtgtaggcaataggtcgtggatttttgcagcagcctttggttcttcatcctttcgcatattctttgtgctaatgttttttcatcttggcaagagatggagaagcttattttgatatttggagataaaaaaatataaaagatatttcccccgtttcaaaatatacgacgctattgactttttaagcataatgtttgatcatttgttttattaaaaaaatagtataaatatgtaagagtataagttaagattatattttttatttgatgataaaacaaatcagaatgaaataaatgaaatttatataaattttttaaataagacgaatggtcaaacattattcgaaaagtcaatagcgtcatatattttgaaatagagggaataaatctatggcccctgcacggatgcacccaggcaaaattgtagaacaaatgaaaccaaaagggaaaaaaagagaaattaaaggacctggattcattcccaatatgactgcccacctacctgtatatgctagtcccttatgccatccccaacactgcatgtcatctagtgtccatagcattaactatattgcaacagaagcaaaaatctaatgtggcaagagagttaatcaggagaaagctaaaaagatcacgaaatcatttctcatgcaagaaaccatctctacaccaaaaccaagaatataggtgaataaaaggaaagagaagagagatgattggatgggaatttaatttaaaggccatcctcaacccagaatatatatatatatatatatatatatatatatatatatattctgggttgaggatggccttagatcaatgtaactataggatcgcagatcgttacttgggttgttgaaggttggcttatgaaaattttacttaatacacgccaattttgatcaacatgtttagtcatccgattccctctttttttcagcacttttttattgcagaaattacaaaaagtccacattaccaccccttataggatggaatggagttgacgtatgtgcacaagtgcagcccatgctacaatgggctggaacactacatcaataatgatgttgccgacatcaaatagtcagccggtgacttgggcgtaggatcctggtgcctcctgttcccaattatatagttggcaatgaatattgaccctatctgccacttgtcttttatatccctcatctgtttaatttcttgaaaaaatacagtcaagcaatgaactttgtaattgatgaattggccttgatacatttgggtttgggttttcctttgcgaagaccatgtctagcgagtcggcatattagtatgtataattatttacctgaatcaaagcgtatagtaggtgatggtaggggcgcaaaaatatgtagtagtgggagggacacggattttctacacctaggtgtaacatcacctatatatgcttggcacataagtagtcgtagaaaaatgtggaaaatgtggttagattggttgtgatgctagaagtataaataccaatattcatggttaaatatgatctgcctttcaataaaggaaaagaacaaagtttgacactagagtgtgtggacaaaaattgctatgttttgacgacatctcttgttcatggtcagatcaaagacgtacttgtcccagagtatttgtactggtatgcacacatggcagtgatggaagcccagatttaagccgttgatttgcattgaagactttgtttcagaccacttagctttggcaaatgacaaatataatcttgaacaaccgagacatacaagtatattcatcttctactttaactacaaagattatcaggagagagtatatttagcacaggacacagcatatatgcgcagttgaacattcagccagctcaatgaatgcaatagtggcttggtcactacaagaactaatgctatgaagcattgagccaatgcattcgatcattggacgtgccattttacctacaagaactaatgctatgaagcattgagccaatgcacgaactcgaacagcagctatagcagagatcgttgatgagctggctaaaatcgcactggaagcgcacacggcgggccaaatttgctgaggcccgcatgctgaacgaacggctagataattcgttaaaatggtgggaacaatgcaggttggactgctagcaagctatgaccagagtagatgaagatatttcattatatgccacaactaatatttgtaaagctagctccggtactctttacttatagtattatactataagtagaaataatctagaccatccgtttctaagggcatattagtactttattagttcagtgattagtgataagtttgacatttaattagtcttattttaccatgggtcgctgacagattgctctttcagggcttgttcactttaatgtcattttcaaacatacaatttttttttgataaaattgctaaaattttggctacgtttagtttgttgccaaattttagtaagtactccctccgtttcataatgtaaaactttctagcattgctagaaagattgcggcaaaatttgctacaggacaccgaaaaattgcggcctttgctatgagacacccgaagatcgtgaatcttttcgtggacactgtaaaaaagtggtaattagctactgaatactcctcccattattttattatttctagtcaaagtggtaagtaccaaaatgcccctgctctctttcttttcttttccccttcttcttcctcgcgcttgctgctgagctgagcagaggcacaacgcgcgcggcaaacgcgacggcggggcggcggcggtggcgcatcaccggggttcaccaccgacggcgatgacgcacggcagcattccggcgcacggtgcccgggaagaactcgcctttgccgcccagcgaccggtgtccagcggcacgttcacgctgtagtgcttgccaacgccctcacggatttcgttgatggtgccggtgcccgggagcggaggcgcgagtagctgagcatgcagtggagcatggtggcgcgtaccactgcctgtcgacgaccgcgcacgccacctcgctccaccccccggtctggccgccgcgccgccgcaccacccaccggagcgcctcgcagaacggcacaggcggcgttgagtgccagcatctgctcgaccaggtcggcgcggggtcagtgactgcatcggggaggagctcgtgcatgggcggcgcgtggcgtcggtataaaaaagggaagcgagcaggaaaacgtcacggtggacgcgggtttcgtgttaattgagatgcgccaaaatgcgttgtttacaaatatatcacaaaatctaaaccgagagggctctcgatttagtgttaaagagcgacgtaattatttgtgagagaaggtccaatgcgctactaatacatgagagaaggtcctgtgctactagtacaactacgtgacaaagggtccagttgttactagtgcacacaatgcatgtctatttttttttctttttatacaattttctctcaaattacttatccaatctgcaatctgattacactattacgttcgttgcaattaaatatttacaacaagattttacatgattatattacgatgaaaaaatatttatatttataaattacttttattatatacgtaagttacttttatcatatatatatatatgttacttttagatttgactaaattacttctatacattcataatgatctaagttgattatttttattattgtttttagttaattctatattttgtggactttataaatttctctacactttacttacgaatttactctacatagtttcttatttcagctcactcacaatataattatttctactaaagagagttactcccccgtttcataatataagttattttagcattgcccatatttatatagatgttaatgaatctagatatagttctaaattaaagttactttcctttttattataagttacttctgtaatatatatgtaaattacttttaacctttactaaatttacttttatatgtctaagaagtaacttagtgaaatctaaaagtaatttagacatatcataaaagtaaattgtgatttttcattaaaatataatcatgtgagatcttgttgtaaagatttaattgttacgaacacaacggtgtaatcggattataaatcggattagtaatttaaaagaaacttctctaagaagaaaaaaaacatagatattgagtgtactactagctattttttggaaataagggtgtctctctttagcactatcagctagcactctcgctgtagttgtgtcccaaatatatatgcatgcgggcgctggttcaggatcctaattacaagggattagattaatcatatcttctatctatctgaaccaacaaaccatccgtgcatatatccatatatgagatgacaagataattctagtttatctaacagtcggggggagttgaaggtggtgtggacgacgttgacggcgaggccgcgcgcggtcgtggaggagctcggcgagctggagcatcagggcgatgtggctgcggaacgggaacgagaacatcacgacgcggcggcggcgagctccggaggcgctgtcaacgagcgcgagcgacgcgggcgggcaccatgacatgagagaaagaagaagaacagataaaaagagattgacaagtgagcccatgggtaaacttgtctttaactaaagtttctctctccgtttccatcggaaataataaaataatacagccgctgtccgccagctaattaccatattttttgagtgttcatgagcaaatacacgatcttcgggtgtctcacagcaaatgccgcaatcttttggtgtcctttagcgcaaattttgcctattcatatagatgttaatggattcagacacacatatatgtctatattcattaacatctatatgaatataggcaatggtaaaaagatttacattataaaacagaggaagtacatatgaaatcttgctaaaatttggcaaccttaccaaaattttagtaaccttactaaaatttagtaatgacagaacttggtaaggttgaaaatggtagcaaagtgaacaacccctcagatttcctaaaagaaggaaaaaaaacttactcgcttagatacgaggagggttacttgattctttaggttgtgtttgggaaggagggactttagtccctctcacaaattttagttcctatggaggaactaaaatttttatgagagggactccttcctaaacaccaccttagttgagcaacggtggcagagaagaacaacaaaacgttacttgtttttactggatttactcacagaaaaggcagaaacattggcaagaaaaggcagagaagtaaataaaatcagagaagttcataatgcgctgtaatttgttatttgttttgtaccaagattaacctgaatctactgtaaaaatataaaactaagagaagtgcggttctacatagaccaagcaggagttcagtcaggataaatcaaaaaaggatgaacacgtgagtggtgcggctatgagttcagtcattgacgacgacgccagcggctctggcgccaaaaaaaaatcatttctgggataagttttttcagtagtctaaattttataaaatgatcaaattgtaaaaaatccagttgtaggaggtcggtccaggtcaccggagctctccccgacgccgccagatcctgccgccggagctcggtccgccgcatcctagatcgatcctgcactgcgaatggcatccgcagcaatggttgatgtctctgcacctggcacacagtctcgatatgccgtgtacctcagcgccgctgacaccacgccttgttctcccgcgtatccaccgtcgctggcttcaccagcttgcaagctagcgaggagaatgtgttttactaggtaaatgtcgggacagcacatagcatgaacctcctctgttccagcagctaagcgtgctgagcctgtcataccgaagaggttagcaggtatcaatctcccaatgcttcccaagcttatatgtatattcaccacaagggcaaagaatatgaaagaaaatttgattcttggctcatgagagcttggtggagggagaagcatgggattttgttccagataaagaagtggaaagcagagtaaaataagcagatggtgatatatatatatatatatatatatatatatatatatatatatatatatacatatcctcgtatctctcttggtgtgttcgtatatctggaaaaaaaaccattcagatacagtttagaaagtgagcacgtgcaagtatttaaattttacttggttgtattctacaactctgctttctctcttggagtgggaaaagaaatgaaaaacataacaggaaaaaacatggtcaagctcattgactgaaagtctgaaatttgattgtataatgttgcattaaattgcatgagatactctctgtatatgccgattgctgaaacttgccagattagtcaactacctcaagcctgattagtcaggagctccaagttatatatatcgagcagatcaataacaacatcatatatataacctgctaaaaaaaattccatttcattctttccaataaaaatattacatttccttgcaattaaatctggttgttcttgacttgtgggtcttcattaatattcgtgcaggaaaaggaaatgccaactccaattgctgataactcctactgtacagtataaatattatactgtagttctcactaattaatcctagtatatatacttatgagttcaaaaagaaaatcctaatatacatatcaattccttaatctcaaaacatcctcgccgccagctaccccgctataaaccatatgtgcttccctttttcaaaaaataaatgaaatatttttgcctgcctcaattgaaatcaatttggggccaacaccttcacagattgctacaacttttttggagagagagtagccacatccaagagccgtcattgtctttgcctgtttctaacttgctaacttccagatcggctaatccaaatgcagctcggacccaatatcctggtgcctcctcttcctaatcagagtttacaatcgccttttttttaatgttctcgtatggttttttttcaagaattaattatgtcgagcaattcatgacttggttatcaatgaaatcaatgaattggcctaaatacaagatggtttgttttcttcccaaaaagccatggctgccgagtagcatgccggtactatataggagtatttatctaggacacaagagcacgagtggcgagcgagtgcaaataattgtgagatgagttttgtgccttcatggtcatgcatgactcacaagcatcaattgtccaatgtccaccaaccatctgagcaccttgctgttaactcacctgttggcattatgttttaacagtgcaggtgcatcaattcattcagggtaattctaaatttactacgggactaggcgactaactatacatttgtcgtcaaattttaacttaaaattttttatagatataaatatagtacaattctgatgtagttaaattgtaacttccatataactagagtgtataacttgtacgtagctttccaaaaccccttgatgacatgctatttccatgagaatggagataatggtaccgaatctcctcacatgtgtttgggttttaatttttttactacctcctttacataaattttaaagcaaatcgaatgattcaaaattatattatagttacatacgagttatcatataattacatagcgattgtactatatttacgtctcaacaaatatatagcaaaatcgtttactattgacaagtactcggttttacaaagcctttttcttccctttttgccatctccatgagccttcctttagtgcgccaagttaaccccattcaaaaggtactatttagcctaggaagtgcttcctatagactaggggtaaagtagattgatcatttttcaatagtaaaactggaattttcacatacactactagaaaaagcatttttgcagacatgggattttttttccaggtgaacatgactctcggagctaaatggccgcctacaaaatataaaccgggttgaaactcactgtccgcctgcaaaaatctatagacacgatggaaatggtatttttatatcctgcgaaaataccgtgcggaaatttatatccacacaggcggaaaaatatccttgaaaaaaaaccctttgttaatcttatgtgatccacctgcggaaattggcgtgaatataaatagacacgacatggaagcaagaatttttctaagtctcagctctcagctctcctctccctctaccctctcttccttagctccatcagcgaccggtggtggcggggtcggcagcggcaacggcgaggcatggggtcggcgacggcgacgctcggggacggtggcatccacacccggcacggctcccttctcctccctcctagatccggccgaaggggggagggggaggaggggtggcggtggctacccctggaggtggcggcggtggcggttcccgtttctcctagatccgacctaaggaaggccaggggagggcgatggcggcggcggcagtacccctccctcccagatccggacggagggaggccgggggagggcggtgacggtggtggtggtggcggcggtagcagtacccctccctcccagatccggacagagggagagagagggtggtggcggtggcggcgctcctgcatatttcccgtaaccctagatcggtcggaggtgggtaggtttgctggtggggtggcgcctttgtcgagtaacttcagttacatgcatgaacttcagtgaaccaacttgtatcgatacccatggtatagctatccaagcttgcaataatgataggcctacaacctacttcgtgcagcgatgattattgtctccaaggatcatcctaaaatttaatgggccgcaaggtgttaagtttcaacctatttatgaaaaaaggagttacaccctgatgatagcaagaaacagtggagcacgagtggcgacaacataatatgcacaggtggcatggcagttatagtgatagcggggtggtgtgactgcggtaggttggactagctcctacctttttatgatacagttagctgagtcatattgggccgatagatggatggatgggccatttcaggccttattcagtgggatttgttagtattaatcttgactagtaggcgtcatatactcttgcacgtgttgtgtatgggcagcaacgtgatgtgtttgcatggtagactagctaatttgttagtacataattagttagtgtgtgtgtgttttgtatggattagttggagcgatttctcagggttgttagctgcaacaaaggatagcgggcgtctcatgcggaccgtggagcacgacatgcagtagttagtggctgtgcatgtatggatcgtgcgagcgtatatgtgcgtgagactcggccagcaggacgttgctcggccttgggccttataagctccatgtaaattctgtgtttgtgtgagttgggaagaaacagaagaaaggcgcacatcgctgaaactgcttgcgtgtgtccactacagcgcgtgtctttgttttgtatgtttagtgcgagtgtgattcttgtgtgtgtgcgctcgcgtgagtttgctgctccgtgagttcttcgcatccttggccaaaagctaacaggattcactcaggggctggaagagtttgagctccttctcaagactgtcttagtacggtcttctctgcgcctgtactgcaagcaacttgagcacatcgcctctgattcggagtaggactgccaccgcatcttttgcaaggagggtagcgcatctgtgagccgctgttatctggtctgttccaactttgttgttgacatcacgatcagattgtatgacactaacttggacacatgttcccggccggtgcccccttttcctgatcagagtttgcaaatgaaacttggccatcgtattgcatttggcacttcctatcctcatctgtttttcaaacaggagctaatgctagctgccatacaattgacttggttgtccataaattggcctaaatacaagatggtatttatataaaacaacatcctgtgtgaatgcaaatacaatgtgccggagtttgtaaccatgcatgacgcacaggaataatctgtgcaccaaccatctgaggaagatgccatttacttacttctgggttttttttagaactcatgcattctttttataacaagaaactaaggtttagaaacgagggcttttatggtgcttgaaaggtatttcaagtacctcctctggtataaactttctaccgttcatccttgaagggtaatttaggaatagaaaaacataagcatggatagtttggtaattatttttagctgtgacctttagaactctactaggttttctgtgcactactagagaaagagaaaggggctttactcccggttgggaaccccctatacttccggttatataatcgggaccacgaatccgggacaaaagatacccatctttattcccaggtaaaataaccggagtaaaaatccataccaccgagacttaaaatggagccaggctagatccggttgctgtttttttttctttttctcattgtttttaacattgaatattgatttcattccattcccaaatcatctccaaattgatcatcacatcacagatcaaaatgatcctctccaaatcctcaaattgatcatctccaaatacatcacaaattcttaaaaaaattacatcacaaatacatcatatattcacatcacacataagtcaaatacatctcagatccgaatcacaaattctcaaaaaaaatctaacatgcgttgcccgcctgctgcgccgccctccacgccacgcggttgcctctgcgccaggccaccaccaccctcgtgccgcgctaggccgccgccgccttcgcccgtgtcatgccggctccgccgcttcgctattgcctctgcaaggaaagtgtggataagagcaagaaaagaggagaggataagagagagaggagagggagagaggaggaggatggggagaaaaactttgcgatagagcatttgaggataagtcatagggattatatacgacgggttgaattttagtcccagtaggtattactaaccgggattaaagatctaaataatctttacttccggttggtactaccaaccgggactaaagttgtgatctttactccctgttggtagtaccaaccaggactaaagattcttggccccctgacaggcctctgacatgtgataaaccgggactaaagatgattttttgtcctagttggtaacaccaactgggactaaagataattttttttaaccgggactaaaaataatatttagtctggttctattgtgtaaatcagccgacccagtaaagatcacttctccagtagtggtccgtccctgtaatttgttccatatccataggttgttcttgttgctaactgaataatccataactaatctcttgtttcctttactgattctcatctaaaattggattattgaaaatatcatactattatcttcgattaatctatagacataagaagcagtggccttcccttcaaccattcgttgtaaccattcattatttacgacagtttttttttgacttggcattatttacgacagttgatcgaggagcaattgttgccttcaaccaaatttactgaacatcctgatcaacagccgccatgacagataattaccttcccattgagccatccaaggttcatatcgctcatgtctgctctctcgatctgtctgtgtatcggctctcacaacggcatcagatgattacgcatccaaaaattactgatataaccttttacttaatgtattaagttaatacatagcccacatatttagtacctttctctatgtaccttctgttatacaccgtcagattgtatgtaatcaatggctgccatgccttccaagcaccctagaagatctctttagaaacatagggcatgagttatgcttacatctctcttgggaaaaagttcttttttttttacaggatagcctgacagttggtagatgtgagaaatatctgaacagtcaaaatccatttgattttggctagaggattgcctagcaactttagccaaagtgtctgccaccttgttcatttccctagaaatccgttgtattttgatctcccttccctgcaaaatagcatgaattttggacagagttgggtctcaaagaccagtgccttggagtaaatgcatggagtatctgcttctttgttgctgcagcaagaacatctattcagccagtggctctgcagctagtcaccattcccaattcgcacctcgcaagacaggggccaaggaagaaatccactccaggaaggagaagcagtgcggttgccggcagagccttccagttggcttgtggctgtggcaaagcaatgccctatcgctccgtatgtataacttgaatttcagttccctttgcctccaattcctgttgcacttcaccggttcaaaccatgaatacaagacaatagtgatattttgagaaagggcatggttaattactagcagctaaaatttttatcataccgctggctttgctacatatgtgtagcctagatggtcaggaacacacatttgtatcatttgtcactggagcacagacaagtcatcaactatatactgtatacctagctagatgtcctctccaagctttatagggggggggggggggggtttcaaattaatctcgtcatacttggtcatagactctgagactcataattcaatattcagttattttttcattatagaaaaccaaaattattgcacttggcagtctgaccaaaccaaaaatattattttcccttggcagtctgacttgtattactctgtcatgacattcactttactgattgcaaaaaataattaagcggtttatttatttttagacaatgaaataaattccaacctttgctcgagtagctacagccaattattaaaaaaatatgttcaacgacgagcacaaaccactaagtccaaactagcataataaaaagaagcgatgcacaaactaatgaccattaacactagacaaagatcccgtaattacggtatcctacttgtaaatcttaatccgtagttggcaaaattttacacaactgttgcctctaggtaacaacatgcagtatacataagtttgttgtcctcatcacacatttatggttgtgctgcttaaaactagagccaacacgttgccctgaaaagtactacctttgtcctataaaatttgaaattctagctaatttaggacaaattaggaggatagataaatgaccgcaataaccttatttaatgaacctcatatatgcatacattccatatcgaaaattgattaaaaggaattttgagataattaaccccacataattagcattcttaaattacttgttggatcccacgtgattagaaatacattttttttggacaaagcctcaaagctagaatttcaatttttatgggacggaggtagtacctgcgagatttatatggtgatttgttaaaaaccaaatcatttctactaaatcatagagcccaacattagcagatgctactacaaggataagtttcttagtttttacatcaatacccacaagccaatttccaaagatatgaaatatactatgtggagtatttagaccaaaagaaatttgtatcgatctccagagattcacatgcttgttgtggccaatttgaaacttaaatacttaatacttttgttactctaatatgtttatgtcacttcagaatagatgctgaagccacagagttgttggaaaaactaaatgagaaggagacctgtagagttcatgctcaagaccatgcaaaaattatagaaaggacttctgctgcaaaccgttgaggtgttacttctattgaattgtattcaaattgagtaattgatttgttttgctcattaattttaccaatgagatgttcacatagactttctcgacttagctcagtcatttacatacagtctcatgcacatataagattgttcaggcttaatttcaattattttatttgcagctttgttgatcctagtcttattaagcaaatgctgagttgctgaccatgatagttcacgaatctgaacacaacattttagtacgaaggaagtagatatcctaaaaagaaaaaaaattctttcacacatcctaacaacaacaagattagtgcaataccatctaatcctcctgccatgtcttcctttacaatctgctcaggaattggaaacatgttcatctttcgtgctgcttcaaactcaaatgaggattccaggctcaaatgttcaatccgtcacagctactaacccagctccatgggtagccttggacgacaacgccaccaaggttagatcattcatgctgcgagagaaaacacacatttttcactactgcatcaacatgattgcgtgtacgtacagaatcggatcgaggtgttactgcgtgtgtctcgattgatttctcatgtctcccaatagctcgtgttccttgcatttgattcggtccatgtattaaaaaagaaaaaataataagaaaaaattgttctttttggtcgcattttgatctatacgtgaaaataaactaaaattattatttccggtcacgttttgatctgtacgtggaaaaaaaagttgaccgttttcttaatgattttaatacggtatcgattaattgttctctcacgtgtgagcctggcctgccgcgtgcaactactatggaaggccatttgagacattttttatcactgtttgtttttctatagaattcacgtcgtcctttttctgtttttatgttctcgagaaatatacacacgcttagatttttctgtttctcgcgtatgttctttatcgtgaaaataatgtttacttttataaaaaaataaactgtacacgttaaaaggtgaaacggttgattttcgacctatagtgtttgggacttttttcccccagatcatagttttcataaaatattttagaaagaaaattatgaaccactattttagttttgacaaatggacacatatgatattaaaaaacatttatatatgtatgtataaatgatttatttattatgtagaaaaacatatttgtttaaaaaatataaaacctttatgccatgttaagtaaaagtataaaatttaatgtgtcattttatacataattttttaaaaaatccaaacaagtaaagtaaattttgagatttatcaaaattaattagtttaaatatattttcttttggatttgaatatttgaaagatcaattatttagtatatttagagttgtttttaacatatcatgtgtaacaaaaatataattttggctcaggaggtattaatgatcctattccatgacataagaaagcaaggtttctttctttatttctttgttttggattttctttgtataatagtttcagatttactgtatattctagagttataggagtagtactgagtagcgtggtatatttaaagaaggaaaataaatgcaaattcgttgttttagatttattttttgcttaacaattttgggtttactatatactctagttataaaagtagtaccgagtaggcgtggtatatttatagaaggcaaatgagtagaagttcgtgtgattggaaaaggaagatagttttggaaacctctagaatccatatgtgatatttttctctagatttttcctcacatatgattgttaggttttttttctctagtataaatttatgatttccttcaaaataagaggtaccacgtgtaccaattgaaagctagcaaaagagccagttttagattattagataggacgtgctaatgagcgttattgggctaggtcgctaggaggacagatcttgggttttctttcttttggctcttttttttcgccacgtggccacttctagtcacctctactaagccacatattttctctaccattataaaagttgaagtttatctcactttggaacgttcgactcctacatggtgttcgcctcttcccattcctatatacgtgcatcgtcttccatcacctccgttcgttgtcgccctttgcgattctgaaaccggacggtattgtaacgttatgatggcaatgtctccgcgaagtttcccatgtcccattgcatgtccgacgtcttctccagtactcccacttccccaacaaccaccctcactcctatccaatcgatcgaacccacgagcttagtatagggagatcactaccatagtagagctgatttcatgtcgaacccggtaaacataaacacggggtaccgcatcttgacaaaggggaaggtggcgtgcacacaaccctgccgggtgggggcaatgatgaccatccctctttcctttcacattgtcttcccactcagtcatttactggtcatactttctcttcctctttaccttttttacagccagagaaagtgcatgtgcgttgcaacggaaagaaaaactaatttgaaattgtaccaccatgcataaataaataatattcggtcacaacgaattgtgacgccgacttgtgtagctggctattacatcacccatcacccgatcatagaaattgttagtttcacgcttcatgattgaaaaaaaatcctaaattagaatcacatcactttatgatagggaaaataatgacacgaaatcataacccactttggtccaagcaaggatattaggattttacttttcctccttgatttcagcccgacactaagcctggcagacactccggccggtgagagatgacacgctcctccctcgtcggcggctccatcgtcgtgtggccaggaaccatggctccgcacatccccttgcggctgtcgcgaccgagaaaatttgcattttcctgaacgctagtatattaatctccgtcctagaaaaagctagggtacaccacacaaacatgatataaaagacacatctttattatatcgataatacttacattattacaaaggcgcttcaggcctgacaataaaaaaaaataaaaaaataaacagcagcggactagcgggcctacggctccatcttcacaggcgctcaactggggtataagccagggctccacctaagacttcttctccaaagcttctcttactgaaggggggaaagatagagcaagaatgagtacaaccacagtactcagcaagccacaccggcagatgcatgattaatgcaagagggtacaaggggaaataatataggggttaagctttgtagaaaacagcatttaaaagtcacttagttgcccaaagctattttataaagacgatcctagagctacacaatattattaatcaaggccgtgaacccacacgaacctgccttaacccaaggcctacgatgattcagaccgaacttgcaacccgacctgggccccagctcgtcccaagccaatcaggccaaccattccacattttagttgttaaacaagttttaagaattaaaccactaacttaggtacattgctaggcttgcccaaatccgagggcgcggctattcgaatagattgtactctgatcagaggtgtacatctttacccacaagacacatctttactccgcattccatggccgtggaacccgtcgtaaaggatgtgacataacccctttacccatcctagccgtgacaaaagcaccgacccaacctcgcctacggccggaatcccgagacaggtaggtaagattgagcccctagcagcaggacaccggccctgtgccatgacatctcgactaccgagccgcagcccgtgtagccttcatttgccctagagatgtccatctagccccgacttcgtccatctccatctgtgtactcttgccaggactagactgagcaccgggttaagccttacccattagacatgtggttagtacggtagtgctttgcaacagaggcccgaagactggtccttatagtggccgaggtgctactagcagaacaatgcacctcgagcccagcctaaaaccattttgagagttttgaatagagggggggaggtgtgtgttcaattccatcacaagccaaccattccacagtgtccaaatgatatgagaactcccacagtctaaagttataaaaccacctagtgttgcctaattaatcagcgaagcatctatctaaattcatactagtggaaccattaatagagtacccactagttggggttttgtttatcctagggtggagaaggtaataataacaatagcaataataataaggtcataacaaaggtaaataggcatagctaaataaaacaatgataacgcgggaatttaagtaaagcggtaatgcaataatttaaattaaaataattttataaactaggattcaatatgctcaagagtgatgcgacttgcctttctcagagagaacggccttccgaaccttcggcgatcaccgcgaaccacgcttcgagaaccttcagaacgacagaagctacgcgaagtacacaagcaaagttacaagcctataaagaagcaataaaaatacataaaaaaataagcacatggttctttagattataacaaacattaagagacttgaacgggtcgattcgggattcgtatgaccaagacatggtcattcgaagtttaatgctgtcacgtggagatttacggattattgtaattaggttttgcaattataaaacatgtgtaagcgcttgcctggaaaagacaggaaggctgcgcttgttgacatgcggaccccacatgtcaacctaagggaccacggtacaccgagtacacagagacggtccacgggtcgacggaagcggaccccgtgtgtcaaccgaggcgagtggccgacaaacggactccactagacaccacgcggactacacacgtggacaccacgtggctaccgagcgggcacacaaacacggtcaccacacgcacccacgaacgactaccgacaccggtacacgggcaccggggtcgacaaccgcacaacgggcgcggggcgacaccgaaaggacgaggacgggggcagcgagaggaggcacccttaccaccacgcaacgaggcgtgggaacaacgacgacgaacgggcgcggcggagacggcttggggacgacggaggcgaacggcgagggaacgacttcggcggcgatccttggacgaaggcgagacgcggccagcacaacgcttgacgacgcggagccaaggacgaagacgacgacggggctgcagcaaccttgacgaaaggcgggcgacgaacagcacggcttgacggagggacgaacaccacgactaccgggaatgacgggaggacgacgatgggaaccggcgaggaggcgacgatgaacgccggcgggttcagctgaaggggaggcgaagccaaagacgacatcgccggctcgccgctgtgatgccggaggtggtggtggcgcggccgacggcgcacgggtggaggaagggccgaccggggaaattccgacgaggcggatggagaggccagcgcggcacggcggtgttccggcgaaattcgggcaacgtggtggcctggccggggaagaggatggcgctgttgtgccgggagaggaggcgacgacgacagccgacgcactggcgaggtggcacaggcggctggggcggtacagtgccggcaacgccaccaaacgtcgacgaggacaccgatccggcgagtttccggcgaggatacggggaggccggggaggaggatggcgtcgcagtgccggggaaggcgatggcgacatcagacgccgcacgggcgaggcggcacaggcggctggagggtggctggcaccgaggaaagagaaggaggaggcggggagaggtggtgtggccacgggggagctcgggaaggggctaaaacgatagaacggagcgagggggttccattttataggatggtggagggagccgggcatgggagaggtgggaacggcggcagaaaagttggccggcggccatggaaagcggccaagattggcgcgggcgttccgggtgattaaaagcacgaatcaagaggtaattaagggggaaagagaggggagggaaaggggattaattccccctaatcaattttggaattagtcatttgaatcgagcggatttgagggagaagaaactagggttcacgggagagagagaggagctgtgcgggaggaggacgacgacccgggtggtggggcccacgcaggcgcgccgtcagcgcgcgtgcgacgcgcgtgcgcacggctggctcggctcggcctggtttgggccgggcggctgggccgagagggaaggagggaggggaggggcagcccagaaggaggaggagaggagggagtgggccgggaggggaagggtaggcccaagagaaggagggagagaaagagagggagagaaagagagggaaaaagggaggactttggccgcgggccgggagagagtgggaggacttcggacttggcccaaaggaggaaggaggatttatttttatgttttctttttagtaaactctgataattgtttttgttgcttaataatattttcggtgctctgaaaattcaagtaaaatttgagggctctttttagaccacgggaatttaacaaaaaatctccggacaacattcgaatttttcttgtacgtattttagtgtttgccaatttcttttcgaattttaattaattctattatttcttttagagaatgatttttatttcaggatgaatttatcacgggcatgacagcggcttctgtctgctgaaaaaaatttagaaatatacattttttccgtggaatttgtaagaaagtactgaacatgagaagatttgtgaaaatataccaccgtcgcggtttggtttagcgagagcgcggcgtcgcacgcgggatgcgtgagaacgagagcggtatcgctgtttagataagcgaggacgaagtgccggccgtctcgcggcttggagtaacgagagcgtcagcactctcgcagtatgcgttagcgagtgcgatggggcccagcgttgctaccagtttcctggcgccgaaacgtgagagcggcggcggtctcgcgcctgggaagtgcgagagcgagcgggtgccgcgggtctaggaaagcagcgacgggacgcgcagtcttgcacgaaggtaatgcgagagcgccgggcggtctcgcgcggtgggaatgcgatagcgccacacggcggtctcgcggagtgggaatgcgatagtgcacagcacaggctcgccactgcgccgaacacgagcgatgtgacagcgctgtcgcttgtctgatttgcgagaccgcgctttgctttccaaattagccagacggaaacagtaatgtactgattattaagttaattacttgtatatttgcatgaattaacaacatgtgataatagcattagtttttaaggctcattagtaaatatatatgagaaaccttctgtatatgtactacaaatagaacttccattatttaaactttgttatatcaaataaaaaatcacattagctacaaattaattgtaacatacaattagtacaaattaattgtaacttaaaattactacaaattaattgtaactttaatttaattttttaccgtataaaataattatgtctatctaatttttaaacccgaactgactctaagtcatataacagaaactacctccattatcattatcctacttaataataatatactatacattattaatattttatatttattaacttcatatttttatatttattgtttgccctaaggaccatgtagctttgcttcacggaagaggctgttgtcttgttcgaaatataaaatttaccggtctcgcaattctaacaaacgagatcgccggtcccatgcacgctgtcgcattgctaatgtgcgataccgtgtcggactaagcgccaaccagaaaatcaccatgggacccactccacagttgctcttgctctatgaaagcgcggtaccgagtccactctcgcgcttcaggtgtgcgagaccgcgggtcccacgcacatctcccgctcgccagtaatgccacaccacgggccccacaacactacggctctcgcgcgttgaaaaagcgataccgattccggtctcgcgagggcaatcagtgagaccgatgggcccattcctgctctgtctcccaaatcgcaagaccggattgggtcatctctacgtggcgctctcgctcaacggaaaaacgataccgatgcggtatcgcttacccaataagtgataccggagctgacgtcacgcttttgcttattgatattgcgataccgtgtcgatttcgctcagtcccgttgcgaacctcggtatcgcgctttcctcccgcgatttcgatagtatatttgtgcaaatcgatcggcatcaggtatatttatgaaaaaaatattcatgaacagtatattttcaaaattttttctctgtctgccgtccacttcccgaggtgtgcatcggagggccggcgcactggctgacggcgaaggcatcccacctccctaagacagccaccgcagtggcgtcccgagtcgacgacaacgacgtcactgaggtcatcttaacaggaccatgatcgattggtgctgtaacttaatttgttccttcatgcaggtatactccctccgtactcataattaaagtgagtcgtttagaataatatttaagtcaaatcttgggaaaatgtaaaaattatatgaacagatttgtcttgaaaaatactttcataaaagtatacatatataactttttaataaatatttttatagaaacaagaagtcaaagttatgttttagagaccgtgttgctgtccaaaacgacttcctttactagtacggagggagtatacatctgtatgaaaacttgctctctttttgtttggatatataaattccatgttatacccagttttagctgacatgacactgtgttagggtgaacccacatgtgagcagccggtctacctactcctctctcctcttgctctctattcgccatccctcccaggcttctcactaggtgacggtgggtggtgagcaacagggagaagagtgatagctgacaggacaggagctaggtggtagcacgtcaccgagttggaccagtcgccgaactggaaggtgacggatggcaaacaagaatgggcggcaggcttttggggtggaccatctcaccctcctcccccttcccctcccacggcaccttcggttccccatctctcctaggaaacaagcggcggccaaaaagagaggagcaaagcgcccctctttgccatgactcatcatctttgccgcctttgggtggatcattagtgcaaagacaaatggtggttcgtcgacatggtgagcggtgccatccgcgcgaaccaacgctcttctatgcccaacaaccactagttcacctcctctatgtccacatgccgacaggcaacgtagccaccggtgcctcctcggcgcaaagggtagagatggctgtctgccacctaggtggaagccgacgactagggtaaggatcactgcaacgggagctcgccttcgacgcctcttcccatgggaactacgtctccattgctgcttcaagacaacggtgggcgtcacaccggcttatgccgcaccctcgccttcctctgtgctcgagcccacgcttcggcctcgttggctccccgtctagacaatctttcctgatgtctagggatgggtaattcaatggttttgacatcctttaagtaacctatacaacattcgaattctttagtagtgtattcctctattatcgatctctataggtgagcacgattccgtacatagccattcataatagacatgtagcgctcgtatcccatatttgatgtaagtataaaggaccaagttcaataatctgagagacaatctaaacaattagatgcactatcatattgaaaaataatggagcaaaatacatctcaagctggcatacggtctctttcacaaatttctacaatggccccaactccaaagtatcaaataatttctgtgaaattcaatttaaaaagtaacatatatttgtgatcaccaccttaatctaaggtggtttgattgcccttatagtattagggagaaagacctgttagcatcacatgacagtcatgaaagttgtatctggatatggtcaaatctttcatcaagactagcttcctaatgtttgatgagaaaccagtagacaatatcaccgcatgtaaccatttgcataatgcattcttctcttctgatgttgtaaatggcaggaggagctcaatctttgcatcaggtagttccttaggttgaagttctattcttatagccaatttcgttacagtctatctttcgtcttaccatgttaatctttactactataattcatgaacctgtttccgcagaattttggtacgtcatccatgttcgtcttaccatgttaatctctactactataattctgcatgggtccaaactttcctgaataagacaatattttccaaccttttcttcactattgttgtttgagcctcctcgattctactaactgagctgacttagcttgatgcattgatcactgtagcacgtaccatcctcctgatgctttccaagctcaaatccaccatcatgagaaacaaaatcaattctaggtaattctttgttttggagaattgtgatgcatgcctactatgactgtaatagaatggaaaaggcacaaatggtgagacatatatatatatatatatatatatatatatatatatatatatatatatatatatatatatatatatatatatatatatatatatatatatatatatatatatatatatatctatctcacacacacacacacacacatacacacatacacatacacacacacacacacacacacacaccccccccctctctctatctctcacccacacatacatatacacctatatatacctatatatatanaaaaatataataaaattttaatcttcccacacatatatacacccccctcatacacatacacacacacccatacatcattcctcatatacatatatatataatatatacacaactttacacatatacacatatatttattctcctcattnctctaccatatactacatatatatatatatatatatatatatatatatatatatatatatatatatatattatatttttttatattgtcacttcaaatacgccatctagttacattatggcatagaagtgttccactcccgaagatccttgaattcgtcacttgtcactagggcaccctttgggtcaaagaaatctcctttcacatgacagcactcatggtggatgaagtggcacagatcacgctggacatttgtgatgcctgtatcgtcaaagcttgttcgacgttttaatcttggcaactgcatgcattgaagataaacaatatattagtatcataaatatgtgaagctgtctagtacatagtacagggacttacatcctctgcgttaaccctgtacctcttattaaccctaaggaattcgcacgggtaatacccgcaaaggaccgttcctcgcggttgcttgtgacacttcaggacatatcatagaaaaaaatagttaaaatttgcaattagtgaaacaattggaatacattaagtgagtggagtattaccggccaataggtacgtactagtagcttctcccttgttcgggtctgttctccacccttgaacttgtagtattggtacgcactgtacggatgtcgtacgtttcacattaagaaggatatttatttataatacattcatataaaaatgcaagagtcataatcacttactactgtaagattgttagaaattctttgtatgactggtgtctgttatcgagagggtccaagactaccacagttccgtctttaaggtagatgagtaaacagatataatgatcgctacatattaacaatatcatagttagttagtaccagctaaaataagacatatgtgtagaagataaatgtaccgaacttacttaaaattataagtggctatgactactctcttatttggaaagtgcaagaaggcttgtccaatatactgtgcgacaataatcaatttctccttgtgcaagcccttcttgtattcagctatctcttttggagtcttgcccttcagctggtctgaccctggtgctagcctcacggtatgctgtggttgacagatccgagttggatccaagaagccgataggttcttttttcttcttagcatccatgtattgcatcctacagaagaagtttgttagtaacaatcacatggatttgtattgtacatatttttcatataattaattaaaactcatactcacatgcacaaaacaccgacatagttgacgtccatcttatcccgacgatatatggcgtggagatctgagaaatctagccatacgtaaccttcggcgccgaagcaatctaccggtgatcgagctgttatatttcccaaccctttcttgctgacctccatgtagaaggtatgtaaccttctcatctcccatggtccttcatttagtgcccaatccggtaagagtgctttcccatgttcgtacttttccgggcaatcatcagttgccaagtttgttggcccggctagttcagtggccttctggggggtcatcatctctgagtttggcacgttccttaccacctctgaagacggttaccatgaacttctctttgttctcatctttggacttgaagtcgtggctcctaagcactctaggcacctcagaactggtagtggccttctcagggacaatggtctcttgcacctcggcgtcttttgtaggaaaagggtcttcaaatatttctggctctgtagtttgtccctcaggtaagtataggtctcgcaaccaatctatgaagagatgcttgtgttctttcattatccactcggtggtgtgacccttattgttagctcgtagtagttcgatatgttgatcgatgtagggctcaacgatagcaaactgatgaagtacgctgaagtgagcttcttgaaatgatttgtgatcatgggcgatgaatctcttctttcctatcgttcccctgccactctatctgccctcgtgtcggggcacaggtactccaattgcatatccatctttgagctaatcgatacagcactcgacaacctcttcagtactataaccctcaaccattgatccctctggatgtgtacgatttcggacgtaacccttcaaaaccgccatgtaacgctcgtatgaccacatttgatggaggtacaatgggccaagcacaaccatttgcgggactatgtgaacaatgaggtgctccatcatatcaaaaaatgacggagggaaacacatctcaagttggcactgtgtctcatgtgcgaatgtatggagattttctaactcttcgagactaatgaccttctgtgacactgcgttgaaaaagtagcacaaccttgtgataacaacctttaaatgctccggttttatggcccttattgcaattgcaagaaacacggtgagcaagacatgacagtcgtgtgaattataaccagataccgagaaatctttcatggaaactagtcgactgttgtttgatgagaaacctatgggcactctgacatcacggagtgacttgcaaaatgacttcttctcctcagatgtcagtgtgaaacaggctggtggaagatatactttgccattcttctctccttcttgagggtgtaactcttccctgattcccatctcgactaggttcatccttgattgcagaccatctttagtcttcttcggcatgtccaacaatgtttcaactatattgtcaaacacattcttctccagatgcatgatgtctatggcatgccgaacctccagatctttccagtacgggaggtacttaaagaatatagaatgcttcttgaatgggggagggagtttatcatctggcttcgaactatcatcttgcttcttactatcctctggtttcgtagtcttctcgggtttcttgcactttgtcccctttgatagtttcttagtcacttttccaaactcgcaaacaattttctgtcattgcacacactttttcccccgatgtaggttttggtgtaggatcagtctcttcagttccatcgaactctgccttcatcttgtggtacttgtgatttgtgcgtaggaaccgccggtgccgcatgtacacaagcttgttggaacccgggagatacctatagtacgttccattcgagcagatcacacatcctgttttacctttaatttgatctaaaactgaaaacattgctggataatcgttaatggtcacgaagatgatggccttcactgtgaagtattctcttaagtactcgtcccacactttcaatccctctttccataaatcagccatatcttccaacaatggttcaagaaatacgtcaatatcaataccagactgacggggtccctgtatgaggatacagagtagtacgtattttcacttttgacaaagccaggtaggaagattatatatggtgagaagcactggccaagtaatatgtgagctgctcatgtctctaaaaggattaactccatcagtactcagggcaaatctaatgttccgtgggtctttagcaaactctctatactgagcatcaaagtttatccactgacgagcatctgtcgggtgtcgaatcatcccatccttcttgcgcccttcttcatgccagcgcattagttccgcatctcgcggatttgagtatatccgtttaatgcggtctttgacaggaaggtaccacatcacaagtgtcagacggttctaggcccgtattgctattcgatttgtaccagctagcatcgcatgttggacattcatctaaacaagcatactctttcctgtacagtatgcagtgattaacgcacgcatgaatcttttccacaccaagtgaaaggggacatatgagtttcttcgcttgatatgtgctggatggtagtgagttaggcatcgggagcattttctgcagaagttctaacagacagtcgaaactggtatcagactatcaatgtctcgcctttaacctcataagttcaagaactgaccgtagtgttgtgaactcactgtcacagcccttcgactcatcatatga

SEQ ID NO: 81959 - DNA, 39951 bp, Oryza sativa
  unsure (1)..(39951): unsure at all n locations
gcctcaattgtgcaaacgcattggatattccatgggcagaaccaagaaaaatggaggcttccaagttgtattatagggtgctggaggcaatctgcagagcagagtcacagaacaataatgtaaataatttaaccccattgttgtcaaatgaacgttttcatcgatgcttgattgcatgttcagctgagctagtattggcaacacataagacagtcatcatgatgtttcctgctgtcctggagagtactggtttaactgcatttgatttgagcaaaataattgagaactttgtgagacatgaagaaacccttccaagagaattgaaaaggcatttaaattcattagaagaacagctattggaaagcatgtcatgggagaaaggttcatcgttatataattcactggttgttgccaggccatcactttctacagaaataaacagccttggtcttttggctgaaccaatgccatctcttgatggcatagtagcacggcagagtattcaccctgatggcttgccacctactccctcaaaaagatggccttctgctggcccaggtgctttctcaatcattcttaaatttaatgtttttgtaatcaactactctcatttccaaaactactgttcttattgggaaggtacttggtatggatagatttgatcaccttctggtaagctggttgaacgttgctttgaacattatattatcaaatatcaactgattgcacatcttgtcttaggctaggtagcagatgttttatcagtttggttgcacagtgcattgctattacattttctcttatcaatcggattgcaaaatattttctgttacttaccttaacattggttaggtgtagacttttagtcctacttgtatattggtaatcataattgtcatcaccaccatttttgtcaccacaaggtttcatgagttcatagtaactattagtatcatgtccattagttttaggttagtgtaatagtatgtgcaattctgcattgtagcctatatataggtggcagaaaggactgtgatgaaaaggtattgccactaaaaattttaaaagtccctataatgtaacaaaaagtgccatttaccaaggaaacctctggctcctctagacttatgagctgaactgtacagtctagcttagtatggactttggtccttgaacatagtcatgcatctattactcttgaactggggataccacgagctcagttttgcagcagcatgtatcctattttgtttcatatcaactgttgtcggtttgcattgaaagtagaattgacgccttattgtcatgcacaaggaatgcttgaggcagtatggagcatttaagtgtttatttatggactaacaaatttgataaccatatgaaatatgatcacacattatttaaacaggaagttcataaattaaaacttctttaattgcttgttgcattgttcggttattcatttctcaaatggttttttgtagatggcaactgttatcctcaatcaccaaagagattatgcaccgaatctaggaactcattggtagagcgcaattcgcagacaccacccccaaagcaaagccaaacagggttaagtattttgaaagcaaaataccatcctctccaggcaacattcgcaaggtgtgatcacctacttcagtttgtgaagagtttgagcatatactatttttttgctaaccagagattgatgatttctgaagaaattgttttactatctcatatcttttgcagccccactgtcagtaatcctgttagtgggaatgaaaaatgtgctgtagtaggggtccagatcttcttttccaaagtatggtccatcttgtaattaaatttatggtttttcattgtttctatgtttatcgaatatttagttctggcctaaaactttgcagatcttgaagttggctgctattagaataagaaacctatgtgaaaggctacgacatgaagagctgactgtgagcgtctataatatctttaagcagattcttgaccaacagacagctttatttttcaacagacacgttgaccaaatcattctttgctgcctctatggtgttgccaaggtactacatcacatctccttgagttttgattggaactgaacttctgtgttgattgagggatatgcctactttttctggccctaggtcctgtagtttctcataattacgaaatggtatgaaatataaaataagagccagactttatttcaggcattttaatcattgttgtctcaagataaatatatttgtttatctcaataatatttttactgttcactaataaatcaattaattaaactcatgtttctataattaacctgccctctgaaacaatctgaggacacctactaaaaggttatttagttttgtgaaaagtctgttcgaatttatggaagtttgtttgtattacatatattgagcctcttatttttttttcttcctttttatttgtgttgaccatgctttttctgccaggtttctcaattatcattgacgttcaaggagatcgtcaacaattataagagggagccacaatgtaaaccagaagttttcagaagtatctttgttgggagtacaaatcgcaatggtgtatgtatcttttaattccagtatctgccatttttctttcttctgatagttcttcccctagcttcttatttttactttgtttttcttttcttttgaaaattctttgatattaacagggatttggatcacgtcatgttgatatcattgttttttataatcaagtatttgttcccacggtcaaacctttgctggtggctctaatgccttctagtactcgtcctgaagacaagaggaacactaatagtatatcctccattctgttttctcagtttaaacctgctaattctccacttaattcctcttataattgacttatgtctattacctgctttcttaggccaaattcctggatcacccaagtcatctcctttctcaaatttaccagatatgtccccgaagaaagtctcatcttctcataatgtgtatgtctctcctctacgacaaactaaggtgtgcacttctcttctcatttctatactttgatcgttttagtttgtcaattttctctttactcagttatagttaaattcttgagcggactatatttcatgccgatgtgtcttttttggttgggcctgtgcatgatctttttaacgcatgattctctgtatcaattacagatggatgcattgctttcaccaagttcacggagtttctacgcgtgcatcggtgaaagcactcaagcttttcagagcccatccaaggatctggctgctataaatagccgcctaaattagtatgtcaacttcctctgaaatacatagtctctctctctctctcacacacacacacacacacaagaagtgaagctcacaacactcagaattcactctgtttcttgccaaatatgcagccctaccaggagaatcaacacacgaataaacttcgacatggtgagtgactcggtggtggctggtagtctgggccaacccaatggtggttctgcctcttcggatcctgctgctgcatttagccccctctcaaagaagagcaaaacggactcttgatccaaataaatgggtccatccatctgtatagagctcataatcccacagattgtttctttggttcttctgaataagtgggtgaagcaaagtgcttctcgactgtaaatgttgtgctagtgttgtaataggctgtagcagtgtaaaaggcggctgattgtctagaattaactaatggggtgtatcatttcattccccagccgattcattaggagcgaaggctatgtaaaatgctacttctttttcagtgtgtaaataaattctgctaatatcccttcattcagctttggcaattaggcaagtgtttgcacagtgttgttctcagatggatggtaagcaacaaaagaagcccttagggtcacttatacatgtaacgtgatgattgatatcaacctcattgtcaattgttgtacaagtaatgagaaatagtgccacctgcgtatgaccatgcattgtctgtatgaggactggtgagaatgttctgcgcactgaacattattaattttcggtctaaccactaaaaagcatcttctattgccacataaattttggaagggcatccatcgtaatcattctgcaagtatagaactatgtaatagcaattgaggtttcagttctgggagatctcctataacagctatggtttgatccttagaaatcagcaggaaatgtacatcgtctttctcacttcttgtgtggcctatacggaacgactcagtccaagtcttgtagaatgtatcagagaggtgagacgagcattattagcccgtgtcactccatgtcttgtagaatctgactcagtccatgtcttgtagaatgtatcagagatgtgagacgaacattattagcccgtgtcactccatgtctagtagaatctggtctccgatgactccagcggatgatagacgatcattagcccatgggagccactgctcctcaacatgctgcttcaaagcagccaggtcagctcggagattgatgagttcaccatgaattctctccctcccagcaatggcagggacaagaagaggtgattcaaagtccttgggaagctccataccttcaggaagcttcaataccctggccaaagctgctttgaagtccccagataacaacggtacatcatcagtgaccgctcctcccaataaaagatcatctccaatatctgatgcaagtgtagtgagcttatcgcgagctcctaccaactcgtccctagcttcagccagctctgcaagccccgcaagctgtgtgtcatcaactatccagccctcttgattcacgtactcctccaggtactgataaagttcccgcgcatcattcagtggttcacaccctgacactgtgacaacaacaggaggcggtaaaggcaagctgcctggtggcatcagaagttcagcatgaatacgacctgcacctggaccatctggggccactgtcgttgagttgagatcaaaaggcagcaccccatcctggggaagatgaaacgcactagccactgccgatactacccgtgagtcgatgggtggccgcacccaatcatccacttcgacgagaacagttgaacccgcaggtagatctgggactcgttgagcaatgacaaacaaaactggggagcatcagcacttgtaaggtttccctgggcgatagctcgaagtcggggaatgtcctctgccttaatcaagtcgtgagcaccgtgatccagacgatcctcaacaaattccagtagcctgtgaatattggctgactgctcacaaggtactctaataatcatggtaggaagtgtaggtgacatttccgcaactgcacgaacgtcagcaaggccattaatgtggtgaggcgccattggcgcacacaatctgcagatcaaattaaattcagttagctctcataatctaggagaattaaacacactgttactacagaatggcattgtatgcaatcaatgaacatgtaatgcatgtaaactgagcagagtgccacagagttatgccagggctacaatgtcacaatgataaatgattcgttcaaggcactatctaagtagttaaaggcagcaaatcaatagtactcttcaagtaggaatccaaggatggtgagaagtatcaagtacctagcaggccactttctgggaggatcaagtgatagatttcagcacattattcagaggatttggagaaaaatataaaccaaggagccaggaatcctaattcaagagctatcttgaatgtccatcaagcaccaaatgttggggctagtaagcaatgggaaaaaaacaaatagatatggaccagcaactagttactacataactaattagacacaatacaatacatcagagctagctcaacacattttattaacttgcttggtgcacggaaaaacagggatgacgtatatattcatggtgtgcagcctatgaacccattgcagttagtaaattgtgcaatcttgacactaatttctttccaataaaacaaagtggacctagagatatcatgcaggcatactctggtggatccttctagaacatgttccctggtgtgtttaacattattgttgatagtacaaactgtagtaacatcgaccaagagtacataagagttgtattatgcagtcagttcggcaattggctgccaactaaatgggaggaactatgaacaactaataaacatctgaaaatgtttgtacgagatgtgaaggatcaaagcaccaatgtcatcagggttggcaaaaaaaaaatccagaggggagggtcctcgcgcagttcatgaatctcatggccgtgcttgcgccaccatcccctgatcccctggcccctggccggtggcgtccccaccgacgcggcgtcgccagctagccatgagcggatgagccatccacaaatctgaagctatctatcctcaccgcgtgctgcccgcccacccgccaatccgaacccaaacataatgggggaaaattcgaaccaaaccctactcacataccggagaaaaaaaagcctcgatcgagcccgcgcacccaccaaattgaaccgaaacagggtggaatctgacctcagggacgccccggagagggctccggcggcggcggcggcggtccggaggcggagggagcaccgatcgccctcgaatggcaagggcaaggagcagacgagagggggtgggcaactctggcgagcgatgaatggaggcgcgccgtctcccgcccctatttcgtttggatgtggatgcggtggagttttttttttttttaaagctttttgacatctgtttcggcgggcttcgccaaattgatgatgggcgtcttcgtgtgctttctcaaaataaccctcgcgtctctcctttagatatgcattcaaattagaatttggttgaggagttgatggattttgggttctttttgaaactttatgacatcctatttttaaatgccactagagagaatttgtcttgctcttgtgccctttttcagccttgcgcgtgccacatcactgttacaacgtggaatcagtggggagaagataagatttcccctagcccaagaacaagaggaagaagctccccgatgtacttgttgtcagggttatggataccacatacctaatagtagttgactaaatctcggcaggacctaccacataccatgttctatacggaaacaacctacggatataggaagagttccggataaggaaagacaaccagagttctacatggaaacgacaaggactactcggattgtatccatattgttttcctagttctacttagacaaggggacacctataggtataaatacaaggcccccctaggaggagaggggatacggacaatcaacaccaaccataatctacggaacaacagaagccacaacatacaagccaacatacgccaatacaagacgccggatattgacttcagggataggcacggctagtcccctacggtgtctccggatactgttaggagagacgaaagcgctatctctgatcttgccgggcacggattcgaggaggaaaactaccctgttgtcgactacgagtcagaccttcagaccgccatgtcgacaatagttagataggctaccccaaatattgtattggtgtgattatggtgaataagagcaacaatggcttcagccaacaggatgtagggttattacctgacaattcaggggcccgaacctgtataaaaatcctcgtctctgtctcttttacctcagtctcgcgtatatcctagtaccaacgatccctatacgatgcaaataccagaatcgcgacatcaaacgtcgacactcgtgttgtgcaccgccacctccctagcgccgggcatcagatggtgaggccgggaaagcaactgcagtgacatcaaggggcatgacgttgccgtcaatgttgagggagcgtggagaagagcctaggggaggaggacatcaccgctaactagtcgatggcaagaggttggtgatgtccaactcgcctagagttgaagctacccacttagtgctcggagaacaacaacaggagccatgtagcgaggcgccaacgacgagctccgtccctaaatttggagttccctgttgtggtgctcgaaggattgcgctagccatggagcgaggcacccatgtccctagatcgagagctcctctctaggtgctcgaaggatggcggcaacggccaatgaccgaggcaccagcgacaggctctgtccttggaactgagtctccctgttgcggtgcttggaggacgaggatgatggccatggagcgaggcaccaacgacgggctccatccctggatttggagctcctcgttgtggtgcttgaaggactacagctgtgaccgtggagcgaggcatcgtcgatgggccctatctctagatctgaagctcctcgctaggtgcttgaaggatggcggcaacgactaaggaccgaggcaccagcgacgtgtgtgctccatcgatggaactagacctccccattgcggtacttgaaggaggacgacgatggccatggtgcgaggcaccaacaacgaactccatcctatggcatctaccctccatcttaggaccactcctagaatgagaaattcgaataggaaaagaaaaggttggggactgcattaacttgggatatgttcagttaatcaccatttttgtggtgtgaaattatttccccttaatctccttcaaaccgaacaaggcttatggggtaatcatatattttcttcctatatactccctccattccaaattgatctacatatttcaaaggtacatcaagacccagaaaagctaataactctctcatgctatatttactctagcaacaaactcaatacatgcaccatccccactatttcctagccaatagcaaatcaagatattgcatgtgggttataaatgcttgtgtgcatggatgcatgcatcaatgtccatttactccaatacacaaataacaaatagacctaatgaatgaacacaaatatgtaagatcatttagaaataacctcaaaaaaactatatgtagatcaatttggaatggagggagtaattggtacccactacctatcattattgctataaagcagctacaggaataagccacgtcatcgagggaatgcagccgttagatatcatccaagagataattccagccgtgtaatatggttccatcggccgtcaatcccaggcgtgcgctcacttattgcgtggttgggccaagccatggcccatttcttttctcccgttggcccatcattaggcacaaagatgcaaggcgaccactacattgatttctttgttttttcgcaagcggaggaggcgccgtgacaaatgtttcagattctgaaacggaggaaggcacatgaagagatgagaagtattgagaactggtatgccttttattcccccacacaccacgatgctttcttccagtaatggcaaccggaccaccgatccgagtccctggtcatcgactctacgtatgtgggcacatggagaaattcatgtatattattttgctctaatcaggttttggttctggtctgagttatgcagattcgaattggactgcccgccgatgggtgagataactctaaaatcgtacgcacataatatgcttgatagaatgcataactcataattggacgtacggaataagttggacaaaaacatcttcactttttataatagtagagatatatattcgaagttcataaaaacataaaccaattaagtacttgttgacgaaaaaatcgaacacaccggcctgggagatctgcttaactcctgtgcaggtccaaagattggttggatgcgggtatgccagtcagtttgatcctgcaactgacaagatatgcaaataatagacaaaacagccgatggagtagttccagccgatagctgatgccgataccagccgataatgatagggttttgagcaatcggctatacgtccaatgtagattctaacactttagtaaataatgatatataggcaatcgactactgataataaaatataacaataatatagtccagtataaaccaatcggctaacattgatatgatagaataagcactgatctggaggttaaagcatacatcggctaaaggtccgctgccatgaaatccacaagattagattaaacagtaaaacctttgttgtcatcggctaaatccaacttatatgtatatgcaattcttatgagccgatgcaacgtctagataactcaccggctgaaaccccgatgaaacccttattggcaatcaagaagcagactagagattatggttctaagcacgacttagtagatcaaacttaactgatgcagcactaagtatgaaaagaagcataatatctagacaatcaagccgttgattgagttttcagggtggtagatgtctaagctaatctaatctagcaacgcgatttagccgataccggcagaaaccctaaaacaagaagcagccgatagagctaaattgatatgctaagactagattaacatagacatatgataaataggtaggcaaatatatcatctaaaccagagcaatccaagaggtcgaatgtactgatgcagccttgaacgacgccgacataaacgatacaattgcctgggctgacagaacattggacttaccccttagccggagatcgaacaccgatgcagccccacgtcaggtgccaagtcctgccggacgataaaataaagtagaaaaggtaaaaggtggcgatgcgccgaattgtattgatcgtgaagatagtttacaatgatcccgggtgtacatatttatacccatggtagatactagtccttgtaggataagaaagaaactttcctaaagataaaaggaaaacataaagtctttataggacactgaacacacttttctaaaaataaaaaggaaactaacaaactattcataattaatagatacaactgccttcttcggacttgatccgtacatggcaatcatcatgaagcacgtcaactcaatcagacaatgattccaatatcaccttgccggaatcggctacatcggcttaccttgttcgattcggtaactgccgatgcacactatagccgatgcggttctgaagccgattcatactctgtttctgttatcgatttcctcccaaatccgcttcagctttaactccaaatccaatgcaaatttaccaaatttggtcgttaacagtactgtgatgtgaaaaaatattaaagatcgtagaaaaattaatccctccgagttaataatacttgtcgttttggacaagggcacggtcttcaaaatgtaactttgacaactattttttattacaaaatatatataaatttcaacaaatatatgattttattgaagtactttttaagactaatctacacatgtggttttcatatttttaagataaatattttagaaattatttgtagtcaaagattttaaagtttgactttatccttatccaaaacgactaatattatcagcccggggggactaatacactttatagttatattttctatgaagataatatgttttcttacacacagggttattttcctattgataaaaattgaatagccagctctttatatttaaaaacatagcattttattctttcttttatattattttaaaatttgtatttattattgaatatatagtcatatccccgtatgcatgcatgtttctgaaaatacaacgtatcgtgtatccgtgtaaaatatcagctgcgacatttcgaatatttaatcgcatatatagacgttgaatgcaacatggcatatacagcaaatttctcattgataggaatttgtcgaatacatcattagatataaagcaggggggaaaaataacaaaagcaattgcgatgcaaacacgaggcaggagacccaacctcgcctgggctggtcctatataaccttccttgttgggcccggcccatcgaatagtagcagacaggcgggcctctcttccagctcacgcagcattcgatcgatccgttttctgccactttccctcgctcccatggccgctgcgccgtcgccgccgccgccgccggcctttcttccgccccacccccgtatcgtaaactacatctccactcgccagggggcattcgagctagcagctcaggcggcggcacatccggggacttccgtgatcgtcgtggtgaccggatccaatccactccaggacgcacgcaaactgtttgatggattggttgcccggcgagacgcactgggatggtgtgttctcgggctcgacaagttttcacagctgttggagagatacgacgtgctctgcgacgacaggaacaagttgagggagctggtgggcagcatctacgccgacatgctcatcggcggctcgtcggctccggaggtggcgctggagagccacgacgccgccgacgacgtacaaggcagggtgcgtcggctactgagcatcgcggatggggcggacgcggcaacacttcgcctgacgctgctcgacgacgccgacgaggctcgccgtctctgccgcgctgggttcctccaagggcgccgcgacctcgccgccctcaagcagctagtcgaggacttctggatcccatccatcaaccgccagcttgaaggtccagcgttcgtcgacggcgtccacctgccggaggagctcgtggacgaccttctcaaccagcgtcggcttcacccaccttcccaggaggaggcagaagattaatactccgttttttaatagatgacgccgttgactttttctcacacntttaatcattcgtcttatttaaaaattttatgcaaatatataagatataaatcacacttaaagtactatgagtgataaaacaactcataacaaaataaattatgattacgtaaattttttgaataagacgaatggtcaaacatgtgagaaaaagtcaacggcgtcatctattaaaaaaatggaggtagtacatctcattgcccattgccattgatctactatatacttgcacttttactgcactcatgtgtcatttaattacctgatcacatcatagattgagagaccaaaacatcttacaatttatacagctgtcgttgcaattttaatttctactgtagcagtcctagcactgcaactcgcaccacgtgcaacttgtttgtgctacattaggaatatgataatctaacacggcgaggaatcgcattgctaacatatttggagatagtgtgttcatatcctttcgagcatttcgcatccaagtcaccaccaaaagtgattcggcaaacagatctgtcaagccgatgatcaagaatcaggagttctagtgctggtgagttctccacgaaatacagagcaagctcaaggcttgaacggcctgctgaaaatccagtcattttgaccaacttgaggtttttatgtggacaatgtttctccagacttctcaactctgcttccttttccatgtaacaaaatggctcctctatatcttccagctacataaagtttcaacaaagatgaattgcttaggaaaattatgagtctcaaaccagacaccaaagtttaaaagtatgtgctcataaaccaagttggacttgaaatttgaacattagcacattcagaatacacaaatggcctaaaaaagctacagcagtccacaatttcatactgctatgaactgaaaagttgtgtagcacggctgtggttttggtatcacattgcaacaattgtacattgttcgaattcttaatttcttactccttcccatttcaaaatgtaagaatttccaggattcagattatgtaccacaatataccacccattccaaaatacaagagtttccaggattcaaattctgtaccacaatataagcattgctgtgctgattcccatggttccaatgattccaaagtcaattggatgcttagaaagggaatctaagcaatttaaaattcaaaaattgaccactgaggtgactaaaaggaatcttttgacttaaccttactatttgctaataaacaacctaagaaatgcttatattttggaacggaaggagtattactcaattaatcagacatgacctatccactgtttcagcttctactataagtattacatgaagatcacacagggctcgaaataatgacaccacaaacgtttctgtacacacaaccacaagggttaaggagaataaatcccactattcccccaaacgattgttggtccacttattcccttaaacatttgggaaggaaaagatgttggagaggaagccatatgattcatgccccatattcgtgtccaatttcttgtgactctttcatagttaacatgaagggataaaaggccttgcaagctactgagcgtctcaggctctgagcctcaggctcccatggttcacttccaatttggttcttgcttcctgaagcagctctggaatcttttcttgttcctggaaaccatgctgccggtcgatcactcttgactagttctgtaacaaccggcggtgattatagggttggaggcagccagattcgttatacaacacatcacagcaggtctggggtttagggtttagcaatgggtgaaggagcatggtgataacggtgagaggctgtggccatggcagctaaggtggagagaatatgatgtgttaggatctgtcatctgggggcaaatttatgtcgatttcaactgaaggggttggcagaggtgacaagaaaggaaacatgataaaaaattttatggcagaaggacaaaggtgaacataagattttttttttttttttggggggggggggggttggggggcataagtggatcaacataccaacatcatatagcttaacattagatattatctagacaaatgtaagttatagagtgatgttctaaaaaatgcctataatatggcatatacaacgaagagtgtcaacactggaatttacacttaatgtgcattccactgatggcatcatttacttttcaaaaattttgtttaaaactgcaatataacagaacagttcaacagttatcaagttaagggcctcgaggctgcttatcccatttcttggagaaccagttatttaattttagtactgtctaaagttcatgctgctaaatgtgctagagagaagtaacttacatgaaaaacgagagcttctaggactggagcagcatcaacaaacttagcaagaaatagaagatcatatttcgtcgatatatcctgcaattttaactccaattgcttcaggcaatggaatctattgcttggaggtctcctggatataatcatctgcataggaaatgtagtcaagataaagaacgtaaagtatctcaaataagtgatattgttttcactaacctcagtacagccactcaggaacaatgactcgaggtctggcatgagtggtgcaagatcagtaaaagcatactcaataacatctgatgacagaactaactcaatgtgtgcccccttcaacactaatgcttcactcagtactatttttaggtgacagatattgtaagtattaatcgcaacaagattttgagcatggatctccaaaatcttcagccacaagcagggaacgatatcaatgtagacaagcttagctagtacatcagtgatcttcaagtattccagcattggacattgccttagcttcaactgttgtagagcaggggtataactcaacaagctctctaaatcttctgtggttatacatacaagggccaaatcaagagtcttcaagcttcttaggccactaaaagttggtaaaggcctcaaattcataaagcaaagcttaagatgctctatagaggttggttctggagcagcaacattagaggatggaaagctgtatttgacatcacgaggatgagcataccatcgtggacttaggtcaatagtcagttcatttgcaccagatcggactgcaaagtaaatccaacggtcaatatagtgtgcgtacttgtgattgttgaggttgcgcttcaaggtgaatgagttaatccctgttccagcgtggtgccttatgatggtgttaacacacctgacaaatttagccctcctcccttgtttgtgcacccgtttattcaaacccaacgccttcgaggtgaactctaaattaggatagagcctccaagattgtagccacttttgcgacaccatgctgacacgcgcagcattagtcagcgaaagcaaccggattatcaagaacaccacatcctatacatcaagaagaagtcagttgaatatatatatatatatatatatatacagaactccatactcacattcataaaaagaaaaacagcacagtcagtataagtggacctatataacgtacatagaatggaaattgacactagattctactagtatttacctcaggaatgtcatcaaactgtaatatggctcttttgttcttggggaccagtttcccatgacatggattcattcgcttagccattagaccaaaaaaacactgatctgcagtcaactggaagttaataaactgtaaattgtaataggccattattagcgttggatgggtgctactgatgtcagaacagaaagaaaacaagagagagaaaagatgggagctttaaacatctactcaccacagtattgcagcagcagcacgcaatgctgacgaaatttgtggatttgagtctcccaagtattcgatcgatcccctctagatacaaacagaagcagcgcaagcagtggcgaagccaggataaaaattcacctatggcgaacttactacggactaagtactagtctagtactctagtttgtataagaaaacatacatatataataaaataatggactgaatttcattatcatctcttgcttctatattttcatttccatctcctcctgatatattagcagtgctactgctaaaaaatctctttatactgacaactaacaaacataaaaatttaaaataagagatacgttaaagtgaataaataacagtaccaacaagggtagattaaattctcaccttttatttttttcccaatctgggtagcttctgaaattgggcgcagtcggcgtcggcgattattagatggttcttcctcttccatggcgcaatctgggtaactacagatattacgagctagtttaacattactactcgtaacaactgattgtctgattcaacaggatatagttgctaatgtgcgagagatggaaccaactggtgtctcggagtgattactgtggcggcgtccagcgtggcaacggcgtccggcggtgtcctggacctggagtcggagatcgggcggcacgcggcaggagacgagtcaactgtcgacgagaggaggcgaacagccgatgcgatgaggcgatcagccggtgggcaggtatggcggccgccatacctcgccatactggtggcttcgctactgagcgcaagatccccaaacaaccgggccgatcgatgccaaagctaggagtggccttggttttttttcccttcttgtataaataagcaatccaaatcaataccgaatcggaaccagagaggacggaggggtgaaaaaaaggcgataactttgagacggactcttaccacgaaactgatttcaccgcatgggcatgacgagaaggagttggcgccagatgttctacgtggggggtggagcggagtgatgatacagagggaggcgaaatgatatgcgacgccggccgcggccggaaggcgagtacacggcggcgccggaacggacgagagagaggaagggggggaggggtttgtagatttgggttaacgagagagagagggggtccgtcttttttttttgccgaatccttttttctgttttttttttgcttccggttttattttctttttatttcgttgttttattttggtccgtctttttttttggtgtttttatccggtttctttttatttcgttgttttattttggtccgtctttttttttgccggtttgttttttctttgctgtttttatccggtttctttttttccgttgttttttttgcccgattcgattttttttgctaggttcctttttcgcttttttcatccggtcttttatctcatccgatctgttgtacgttgccgtcgtcggaccaaaccctatagtggccgccacttcgatccgtctccatatgcgttttctcctccaattgatcgtttccccatgcgttttctccttcaattaattgcgaaaatcgattctccacctctctcatcatttttctcacatttcccctctcaattcggcttacagttcgccaattatgcccgaccggcctttttatcccattttgtgaattctttccgatttcgggaaaacagaaagaggagatcgagtggatcaaaattcaaaagaaaaggaaggaaataatgggttgtaggcccaaaaaaggaataattttcatttactttttcaattataatgaatagcgatcctaatgtttcttcattgctagcggttgtactactcaaaaaacgtttttgccccgatgcaatgcacgagtatttttttctagtatatctatatatctatatatctgtatacctatatgcctaataaaaaaatacgcaaggtttccggttttttttccgtctcttttttcgccttttttttatgtcccattagttcttttccatgtgaaacagtttttttcaggctcactttttttatccggcttttttcatcgtcatttttttctgctctcaatccgatcctatcgtcttttcttattgctctttagtccgatccgcacatgggcaaagcccctccagccgccgccacgatgttcattcatccgtacgtttcctcattcaatttactgcgaaaatcgattttctaaccttgttatattcctctttccatttggttttaattcgttggatttaatcccgaccgattgattttgaaaaaaaccttgttatattcctcatgatttcctctttccatttggttttaattcattggatttaataccgaccggttgattttgaaaaaaacagaaaaaggagatcgagtagatcaaaagccctcaaccaatttcggggagatcgagaaagattcagctggatttgctcctcggcgtcatgcgtggcatcttctagaggttgaagatgcagtcggttatgcaagctagatttgtttatgggccggaccaaggagagacaaaccgagcgaagggatgtatcgaactgggatagggctgaaaaataaggaagtttttctcaggcttccttttttttatccggttttcttcattgccgttttttctgctctcaatccgatccgatcgccttttcttattgctctcagtccgatccgctccacacgggcaaagcctctccagccgccgccacgatgttgattcgtctgtacgtttcctctttcaattgattgcgaaaatctattttctaaccttgttatattcctcatgatttcctctttccattcatttttaattcgttgtattcaatcccgaccggttgattttgaaaaaaatagaaaaaggagatcgaatagatcaaaagccctcaaccaattttaggagatcgagaaagattcagctggatttgatgccgaggatcggctccggcatcattgtaggatcgaggattcagctggatttgatgccgaggatcggctccagcatcattgtaggatcaaggaggccgactagaggggggtgaataggcggttttaaaacttaatggcacttcaacaaaactaacctaagttgctaggcaaggtgaggtacaaggttaactaagcaactaagttaagttttgcaaacctaagtgatatgggctcaaatatgtctctatgaatgtaaatttgctcaaatgtaaatgcaacaaataaatgagacaagagacaaggaatttttcaccgaggttcagaaactcgccggtttcctaatccccgttgaggcgagtccaactccaccgctcaaccatgaagccaccgcacgcccccttcatcaaggggtgggcaaggtgggagccagcccacggagaggactacccaagcctcgatcactagggtagttattccttcacttcgaaggtggtgaactccaaatcactcacaaacggcgtcgggcctcctccacaatctcctcggagagatcaccgggaaacacctccacaagccatctaggaggtggcaacctccaagagtaacaagtctaggatgcttgccgaggatgatcaagtaccacactagctataacaatgaagcaatgcacttggattggcttaactcactctctaacacctcactagataaactaagtgcccaagggtgtgagaacactttcaagggttcaagataatgcaatggagtgccaaaaccttacccttgctgctagagagtgggtatatatacccccaaccaccaaaactagccattgggattgaaatccccaactctttgctctgccggtcagaccactatagtgtggctggtcagatcggactactttgtaacggctaggcaatcattgagcccactcaacctggccggtctgaccgcagtgtagtggccggtcagaccgtccacggctcgaccagaccaccaggggctcggtctgactggttgcagctctagcggctttggatcgccaagacgagacctccttcaaaattaggatgagcggtcagaccgccatgggatgggaggtcagaccggacaacatacttctgtcagaccgcaggtcacttttcagctcaaccggctgttagtaaaacggcgatatctcttgactcgggtctcggaatttgacgttcttagactctatggaaatcttattcaaagggctatccaacccatgaacaattcatccaagaaacacaacttaattcagggagaaatggctcatctccaaaggatatccaccggacatacccacaagatgtcactcactcctattggacatacccacttctctctttgtttgggacatgagaaaactcatcatacttagctagacaagaccaccaaatgcacctacatgcatatgaactaatatggcacaagatcatcgacgtgctcgcttcatagacccctcttgataatacggcgcctatctagcaaatccggtctacaccaaacaccaagaccggggaaagactacgaaaacattcttatttcaattatacctttatcttgtgccatccaacttggggtcaatgcttgagccaagatcaacactcatgaccattcgcttgaaccatgtttatgccgaggtcttgaccatcctttgttaaggctttcttctcatcacaatcttgacttcattcttgtcgacatggcgatgtccttggcttggtgaccatcaacccatggtgtcatccattagcctcatcacaattagacctattcctttgcacatctcaaaggggaacattagtaccaacaaatcggttgtcatcctccacttggtgactaaccggttgcatatgaaagatatggatatgtttgttgagtattcattaacatcgcaaagtgtcatatactcgtatgcaagctcaaatgcaaagatccaatataaataataggtgaacaacgtggatctaaaacatgcacaataaatgtataggatttgctccccctaaatatatgcatacaaataaatatacaagagagacaagtgtatgcataagttatgaagaactaatagggtttatcctatacacatggagaaggcatgtagcaatgataaagataaacaaaaaacacataccttcatgatctccatgttctcaatgtaaaggagactaaataagataagactcaagtaaacattagtctcacacttatataacaataacatggaaatcatatatatgaacctatcaaaaaggatgagataagaagtgatacatatcgctttatctccacgaatttcatccttgtcatgattaaggtccatcaccaaagaatgcatatctaccacatcttattatcgggaaataaccttgttgaaaacttatgtaaaagagagattaatcccataaatatcggtttatcatctatcaccaaagcaacaattacacaaattatttaattcaagatctttcaatcttttctctcttttgtgatagataataatccgatataaacaatatggagagatgagatgaaagatgatttcaaatcaagatagaaatcttaaataaacaaaatatagagtaacctccccctcaagatgtgcatacatatggatataaaggaacacatatgcacataatcaatcaagatcaatgagggagctcacactatattttggatccacaggagagacaaagttagaatatgtgaagtttaatacatacctctcatcatttttactttcatatccaaatgagattagtcaaacaaaagctcataaaaatgttagtatcatattgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgcccccctgtggtcttggcgccacgtgtgtgcgttaggtgagccgaccgggctcacctaaccgcatttatagcaggttggacgagcgcgccacgccgcatttaatgcggcacagcgcacgcttatccggtccgtgaccggtcgcggtgtgtgaccggtcacagaccggtcagatcgcgggttaggtggcaacaggcggcctgtcacacgcctcgcctcgtcccatcggaatgatgagagcttcctggctctcgtccctagccggagccggcgtgctaactcctggagttggtatgtcagtcccggtcagatccattccaggcttcagcgcaagtatggcaaggaagtcactggccattaaatgaaggttgaagtgggcgtccccgggaaaagcgggcgagcggggcaggaggcgtgtgctctgcttgtcagatgtcacttccggctgtagactagccctcattgtaaaaagcatgtatccctccttaggcagcaggaggccaatgtggtgaccccggaccagataaaaaggaggcccaggtctagagaaaggggggggggaaagaagagttgggacgctagcgattgggttctagagcctgaactctctctcgctctcgggcgctctgtattccttcactcacagatccatcagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcacatataattagatttgtcattaatcaccaaaaccaaattaaggcacttgaacttacaatcatgcgtggcatcttccggaggttgaagatgcagtcggttatgcgagctagatatgtttatgtgctggaccaaggagagataagccgagcggccaaaaaaaccaacgaaggactttcattaacttcttcgattataatgtatagtgatcccaatgttttaatttattgctcggtttctaatagttgttgtatcactgaaaaaacacctttacccattgcaacgcacgggcatttttacgcaaggcatccgaatttattttcatccgtctaaatttttttccactatttcttttttattttcttttttcgccctttttctctttttttcgccttttttttctcgggtttattcttgtccgctttctttccatgggctggcacagctgctgggcctgagcggacacgggattagcggcccaagaggtaggagaggaagtgtggcggctgctgggcccgagcgaacagatggatgacggctcaagagagaggagaggaagcgggacggctcgggggtgaagaaggaagaatgggctagatttgatcccagatttaggccctgtttgtttcagcttataattattataatctagattattaagccagattattataagctgaattataataagctgacatagaataagctgtgagttatttgtttgtctggattattggaggcatggattattgggtttgaaaggataaagtctataatgctctcagctatctgttcggttgatggcataggtgggtaatttttctcaagtatgtagggatagtgggtctttagccactcaataatctgaaaaaagctcctctatagcagcttattagattataataatctggcttatagattataataatatgctataataatctacttgtttgtttcagcttactcctaataagctagattataataatcctaagctgaatcaaatagggccttagaagagggtttttaagttagttttaattttaaattaattattaaaattagcaattgagctttaaaaaattaaaaaaattatagagaatgtggttaatcatgaaaattttaataaaaattaaattcaagtacataaggcttgtaggtattccctccgttttttaatagatgacgccgttgactttttctcatacgttttaccattcgtcttattcaaaaattttattcaaatgtataagatataaatcacacttaaagtactatgagtgataaaacaactcataacaaaataaattataattacataaattttttgaataagacggatgatcaaacatatcagaaaaagtcaacggcgtcatctattaaaaaacggaggtagtattattttggtccgtcgttttatctattgtcgtcatttttccttttttacgttgaggtattttttttatcggtgtcagtcttctcattatgcgcgagaaatccccttccggacgcgcgagtcccccccccggccccctctcttggcactctcttcgattgtcctctttttatttaaaaaaaaataaataaacaatctaaattcataatcacaaaaagataaaagatctaatctgactatatatatatacataggtttccggtagtatttttagttcgcttccgcttgcgttaaaatattttccatgtgcgtcgaaaaaaaattatgtatatcgttgctcagaaatccatgcacatgttatcgcatgggtcatttggggatgactagggatcggtcgcccgatccaaatctttaaaaatcggcatgacgtcaacgccgatttacgtgtaaaacaaattcaaactgatttttctcttaaattatttatccaaatcatgatccgattgcaccattaaattcgttgcaattaaatcttctaaataagaccacacatggatatattctgatgaaatattttttagcttattattgattttttttaatgttgcacgatgttccaccaggtatatcggaattgtttcaataagtagatcgaaaatgtttcactcgtttaaatcgggtgttgtttcaccttatataaaaacaatgtttcagcaaatagcgaaagaatgttttagttcactgcaacatttgatccatacatagtgaaacattgtgagtatactaaacgaaacattttttaatggaacaaaaaaataaaacgaattcccttaataaagggtttccaaaatatgtgggttttttgttgcaatagagtatctcagatcactgtaactttagatctataaatagtgaaacatcatgagtacactaggtgaaacatttttggttgaacaaaaaataaaacgaattcccttaatagcgggtttccaaaatacgtgggtttttatgttgtaacagcgcgttccataatatcaaaatccaatgcaacatttgatccgtacatagtaaaacattatgagtagactagctgaaacattgtaaaactactggttgaaacatcaaaagagaccatatgcaacattaaaaaaaatcaataaaaaactaaaatattttttttatcaaaatataatcatgtgtggtcttgttgtaaagatttaattgtaacgaatttagtgatgcaatcagatcgtacattagctaaatagtttatgagaaaaaatcttttgaagaaatgagagatgaaagcacgtagggaaagattctttgcatgcaaatggcagaccatgcagcgtctgatttttcttccctcccatcggacgcccgacaactagcattctccgggtcattaccgcagaaagattgagaaattaacccaatcctaccctattgtactattgtactgcttccttgccagcttgaactgaatcgaaactataattccacgagcgtaatttctactccctccgtcccaaaaagactcaattcctaagtttccgtatccaacgtttaattatccgttttatatgaaatttttttataattagtatttttatcgttgttaaatgataaaacatgaataatactttatacgtgatttatctttttaattttttttataatttttttaaataagatgaacggttaaaggtcgtaactatcgatctgagacacgtccccatgatcgtccatccgtgcgctcgtgcgtacgagattggaagtgcttttgtttttttattatctataccttttttttataagaattacacagtacaacgcagacattgacaacatacgtgcactcacccctataaatgcacgcacgcaaaccgtacccctagcatcttcgaagactgggccggcaagtccttgagagacaacgcacgcacactcacccctatgaacgcacgcacgcaaacactacccctagcatcttcgaaaagactgggccggcaaatccttgagagtttgacgaagtcatcataggcacctcgctatcgaggggtacgtcgcccaccactgaaagcacaacgccgttaaatcctggaaaattcgctcccattgggagtcgaacccaggacctcaagtgctaataaggctcttgtaaccactaggctacatgccatttcgcttttattatctatatctaataaaaaatacctaagactttcggtttaatttcggtaaatctgtttttttttgttttttttccgattagtttttctcttacgtggaagttttttttttgggctttcggtttttttttctgactgaaaaaatacccgtgcgttgcaacgggtaaaaatatttttggatcgttatatattttactctttggttttggaccaaaagctcatttcattccttgtcaagtggagttgtatgtcctgctcgcatagctgactgtcctcttcaatcttcaaagacaatgttgtgtccgtacatgccaaaaccgatacccgtcaaatccggtccaatcttttacgatctttcaaaattggttgagggtttttgatacacttttttttataacaggcattcataatacccggcttttaaacaaagccaaagataacagaggtcttacacaacagaacgagaaaaaaaatccgacttaaaagaacaagttaacactggagcataggatcactgcagaggcccatcaatcagataaaaaacacacccacgaaacaccctaaaacaagacacctaacatgctaaaccaaaacccaaccccttagccaagatccagatcatccggcaacctccctagcgggcgtagttgtttttgatacacttgatctcctctatccgtttttattaaaatcgaagtgataaaactcgggataaaaacggtgattttttaaatagagattaaattcagtggattagagcagagttaaaagggaaaatcgtagaaaaaatgatgaggggtagcggggaattgatttttggcaatcaattggaggagggaacgcatgggaaggcagatcgacctagtgtttagccgggcgataaaaaaacatggtacataaaaaaacaaatccttaccgcgtgcgagaaaatacaactaaaaaacagcagcaaacatatgaaaaaacccggtaaaaagacctaaaaaaagtaaaaaacagcatagggtaaaaagcgaaaaaaaggtgaagagaaaaaaccagatggaaaaaaaagcgaaaaaaaaacaaacggaaaaaactgtgaaaaaaaagaaaaagagtgaaaaggacggaaagaaagaaaaaaaatatacggataaaaaaagaaaaaggaatcggacagaaagaaggaaaagaaacgggcggagaaaaaaaaaggaaaacggactggaaaaaaggaaaaaagggtgaaaaataaaaaaagacggacgaaattttttacggaaatagatccaatccccagcatcgtcacgacatagatatgcctcgccgtgtatttctactctaattgattgaaaaaagcaattccctgttcatccttcatttattgctcagcttctaatgctattcccaatccaataactaggatggtgtctatagcattaaataagctgccaactaaaatgaaaaatgatgtggtaagtgaataaatgaggaaagagaagaaaccatatcttgcatgagacatagtttctacacaatatcgaagacatcacatgagataagtagtattaaatttaagtattgagtagtggtgtatgcattggaagagtagcatctttagtactattttctcgatgacgtgaagtttatagaaactatgtctagtgtcttgggctgggaatggcctaatagctgttttatcaatgagaaaatatttttacccgttgcaacgtacgtgtattttttctagtttcataaaaagtacagaaactacataaaactaaggcaataattataaaactgcatatttagtggaaactaaaaaaactatatatttaattaaagcatattgtagagtttaaatctctatcaatattattattagggagaattggtcattcgactctattctgaagtctaattaacaatctgaccctacgttttcaaatttgcttattagatcctgtttttcaaaattggagttgccattagaccctgtttctattataccattctggtttcatttaagaaaagaaaaaaaatgtgttctaatagaccaaaatacccctgattacacacattaaccctatccccaaatttatcacttcccattccttttcctctccctctcccctctctccctctctctccagaggagctctcctcgccgtgcagaagcaggcacgcgacggaggaacagtggcggcggggcccgggtggcggagcttggactgcggtggtgttgatgtaaaaaacacgaggccggagagatctgcttaactctagtgcaggtccaaaaatcttgccttttaggttcgtgagcgtgccaattgatttgatcctgcaatcaacaagaaataaagacaaagaaatcgtggttaaatccataaatgatagccgatcggctagttgacgatgacatattatttatctctgagccgatgtcatatgtgaatcgatcggcaaccatgaataaataagaaaagactaaatctactcgatcggctgtagatattaacaatatataatccttatgtcgatataaacttaaatcaagtaattgggatagatcggtcgtcataccgagacagtataaatcacttagatcgaagtatatactaacaatgagattatagatgttcatagcatagccgatccaatagatctagcatgtatcggctaataatccgatatcactctatactaagatattaaaacaagtaaaatatatcaaacaaaagcctaatatactttattgtaataagatcttaatataaagggaagatctagcatatctgaaagtgtaaattaggcctagaggggggagggtgaataggctaattcaaaaattcaattaaaagcggaagcactaattttcggatatttctgaaatttttggatatatccgaaaattttcggagtcagcacaaacagcaaagtaaatcctagatctagttgcctacaacaagaatatgctagcacaaacagcaactagacctgtagcggctcaaacaagcaaagctagtggagagggaggaagtaaagtcaccaaagatgaagctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagtccgaaaatttctagtaccaacaacatcgttctggatgttctcggaaaagtccaaaaataactttcggacaagtccaaaaatatacagaagcgaaattgactctactgatgattttcggaaaatccaaaaatcagattcggacaagtccgaaaatatacaaaaccacttttgctttcgcagtctttttcggaaagtccgaaaatcactttcggacatatccgaaaatttccagaagcgaaaatctggttctgtgtgttttcggaaagtccgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctattaactcaaggaaacgaaaacgtacaaaataccatttgctcatttgccgcattacatcacatcaacgtattcggcgggatatgtattacgctaactcattgaggacaaaacaaccttcacatttgcttaaataaaaatgttagtcctctctaatcgcattgtaattaatcaccaaaatcattaggggcctagatgcactttcaatatcaatcaaatacatgaaatataaagctaaatcaggtaagatcggttgaaaccccgatactaccctaatcggcaaccaaaagcaggctagagattgagattctaagacaacttataagatcaaactcaactgatgcagctataagtatgaaaagaaggacaatatctagacaatcaagccgttggatatttcatagagcggtagatatcctatataatctaagtcaacaatagtatttaacctgatcggctgccttttagcaacagatgttagccgatttgagggttagataacaatattgcctgagattatatagaatatctgataactcaacgaactacataaacaagattagagtatcataaagatggaagcactaatcccgaaaacgcaagccgccataacaagttttacctctagttgaagatcgaaaccgatgcagctcaatccgaaagcaagaactcgtcgaaacaaaaccaaagtaaaagggtggcgatgcgtcgagattgtattgaacgtgtgttgttgtattacatggggctcggggtctatttatacctgagattacaaaatatgtccgtgtcggacacgactcttatttctaacaaacttttaagataccataagtctttgcggcagacttttgcccaaacatatctttaaggaaattacatgaaatatcataattaatagatacaattgccttctcaggactctatccgtgcatggcaatccatatgaagcacattaactcaacccgacaacatgcattacgtcatattgtcggtatcggctcaatcggccaacctagtccgactcgaactctgctgatcctgatcatagccgattcggactttagccgattctcgctatgtttccgtaacgatctccatcttgaattccgcttcgattctatcttcatctccgatacttggattaccaaatttggttgttaacaggcgggcgaatcagacgaggaggggcggcagaggcccgacgatgacaaggacgagcagtggtggcgaggcccaggcagcgaagctctggctacggtggtggatccggcagtgcttaggcatctgggctacggatccgacattgtcaaggtgtgccggttgcggatccggtggcaacgggacaacgacagtggcacggcggtagcagctcaggctgtaattttgcgccggcggcgccgaggtgtataggcggtggatctggtagcggcgggttggcggcggcagggccagggcagcagagttgcgttggcagtggatgtagaggtgactgggcatgcgggctgcaaatccggcggtgctgaggtgtacgggtggcgggtcagtgatggtggcacaacattggcggaaatcagcggtctgcgacgatgcatgacgtggcgaggatgatggagtctaaaattttattgaagtttattcatatttttatcaaatctatgttaaatttgtcaaacatctatcaaattgaagtccattttgtcaaactgaagtcaaatttgaaaaatttaatataacaaatataggtcaaatttgaccaaagtctgagtcaaacttgtcacaaatcggtgaaacttacactaagtgcacaaatcattctcattattgccaccatacaaaactatgctaaactaactaaatgctttggtaaaatagggtcaaaagagcaagggcagaagagaaattttatgctccttttaagaccgttacatgcctttgatagaatagggtcctaccgtatcttcagttttgaaatgaagggtcaaatgagcaaacttgatataagatggttaaattggtagttagctttcaaaagagggtcagatatgtaattgccccttattattatgttggaactattaggcgttgtagttttgtacttaaattgatgcaaaacttgtagttattaaatttgctaatcaatctttatttttgggatattatattttaaatctctagttctatgaaaatttccatgctaaatttgtagttttgtaatacaagattataaatatgaagttttacgataatttggttgtagttttctgaaatttacttgaaaatatatcattactatttacctatttaaattagtgtacagtatggtatgaatccaattttcatattattgtagtggtaccatttcagttatacgaataatggtagtattctttaaaactgtcaaatttataatgatatgatctaactaaccctttaaggtatatcattttagttcatatattttttttaacagggtaactataatttatagctactccctccgggctgataatacatgtcgttttggacaaggctgaagtcaaactttagaatctttgattatgaatcatttttaaaatatttgtctttcaaatatggtgactacatgtatagattagtcttaaaagtactttaataagatcatatatttgctaacaattttatacatattataatgaaacataatggtcaaaattgttttttttggagaccgtgtccttatccaaaacgacaagtattatcaaccggaaggagtataagcgatgtcactttttatattataccagtaaatattttcttttagcccctgtcctttttcttcctcttccttctcttttttcctctatgaccaaattgcaatgtattctaccaatcatatccggaggagcccagaccatctattcccttccggtgtaaatctgtaattgccgcggcggtgaccagtagcaggatgcgcatttcggttggccatgatggcagggttaattagacacatgccattataaattcgaaggtttggaaaaatgccattactattcgataaattgtaaaattgccattacaaatcgcataaaactagaaacatgccacgttctacgcctgatccgcgattgtactcggttttgtgcataccgtatttatgtatggaccataatgcccttatgtatgactatgtagggaccgagtggaatcagtttgaccgcggtgcatggcgcattcccagtgaaccataaacctagccctaggcttctccggcggcggcgggatttggaggcggcgtcggcggcggcaaactttggcggcaatggcggggagaggcagaagagcataaggaagagaagtcgaggatgcagggtttggttgagccaaaccttagacagatgcaatccatatatatatcagcagctgaatgattctaagaatgagtgtgagcagctaaagaagatgttgaaagaagagaagtgtagtcatagtagacaactttatgtgatgttattcttgttggtcataattatgtatttctatatatgttctgtaaattttgtagccacatttggtgcaagtaggtaaatcagtgccattttgtgtaatgttaatcattgtctatgaattatgtggattcaatttcggtgcgttaattatgtggatttaatttcccactctaggtgctctgttcaggatatgtctggcagctcaaggtacaagctgatattgtgtatttgcagcaagagctgactcttgcactaaagctgactccatagacgccgtcgccgctgccgagccgaagacgtcgccgccgtagacgcagccgccgcagcccgtgccatcgccgtagacgttgtcgtcgccgcggccgccgtagacgacgtcgccgtcgtcgctggtagggttaggtctaaatcgaactagaaaggggataaaatgtgtgctgctcctgctgacccgactccagtggcggacgcaggattaaaataaagatgggacgaagatgctcgtctcaataagaacaactaaacataaaaaataccatatttatgttgtaatcatatgaacatatagtataattaataaattaaggcaaacaaaaaaaatgatattaaaataaagtaataatttttgcgccatacataattcattatacataaaaagatatatattaaaatcgtagacgggtgacaaagtcagtgacatataatggattctctaaaaagatactagtaaacatattaatttgcaaatatgagtcaatgtttgatagatatcttttaaaaaataaatatatgagaagatatcgcattaccaaaataagatgattattattttgtgtagaagggagagagagaaacattagacacctaactatagtaggggacgggggtgagcagtgtcgaggaattgactcaggaaagcatcacataagcaggattaaaattggacacttgggctggttatttatggcccaattgtgaattggatgtggtggtaggcggcccaagaaggatacggagggttagggcggcacgggccgtagctgggccggccgcccaaccccgcctaatgcgtggcggttttgctataaatctgttgacaaatttcttcctcagaatttgtcgatttttgaaccgcttgatgaaactcgggattcgtgcttttatgtcgacgctttaatttgtttctttcgacgttcgccggccgccggccacaggtgtggctcatgcacgcgtagatgtctagatgacagacgaagggcaaagataaagcggcagggcatagccgaacatgcatgcatgaatgatgacctccgcacgtatcgtacaaacatacattgcgagttcgtaatccctctttcacgtgggcagtgccaaacataagttttctaaagttacatctcacttatatgcaagttatattatagttacagtgtagttatactgtaattacagtgtaattattatatttacagtgtaattacatgtaaattatagtgtaattattatagttaccgtgttgttatagtacagttacagtgtaattattgtaagttacagtgtaattacagtacaattatattgtatttacatttgacaaatttttaagagaaaatttgtcgacaaatgtataggtagtccgttgagtcaaacgtggtcaacaatgatgcttctggcgtagagagtggcattgattcagtttctccaaatttgtaatgacatctttacaatttgttgaatagtaatgatatttttccaaaccttcaaatttgtaatagcatgtgtctaattaatcctatttatatccatatgatgagtaaacttgtttgattattttctttctttaagcaaaagtacaaattattaagctgattatggtttttcttttaataaattatattgacgatatacttatcaggtggtataataagtaaacatttgttttggtgtattaaattatctgatacatacgtgcgactggtacttgcaaaccaagaccaaaagcctacgatacggccaattcaacggcatgcggcatgctcttttctttgaatacaactaacaattcagcgacatacggagtacttcccaggcttctatatatatatgagtttcttataaatgtaattttaatttatgtattttttatggttctatgaatttttatttaagaataatagctactacgcgtacattataaataactagaaaagacacgcggctttgccacgtaattggctagctcgtaggaaacactaatggccacaaaggcaatttgatgggcgaatcatgtttctgtgtattgttgacattcttttttttttggtaatcatatggacaagagcactgggaaatttgacatctctaagtaaaagtgtggacgaatatcagagctggctaataagtatatcgttctataatttaaagatcttacataatttaaggttaatagctgagctatcagttctcatgagaggagagatcagagtgaggatgaaatccagatcaaattacccttttcatcgagtcatatgtcgttgacattgatctttgttaggatcgagtcatattctccttattcgattcaaccttctttagatatagaaaaatgtgtatggcttgttttgggttgatcagatttaaactcttgcaactccaacactggaatgtttctttgctttgtgggaccagtggctcgacaacgctatataaatatgctgtagaggtgcactgtggctacaatattatgaacgatagcgatagcgcacaatgcacttgttaaaatcacattatgaactattttgcactgtagcatatgtaatggaatatactccttccatcttgattgtgttgacttttttataatatttgactatcatatttaaaaatttagcataataaatatgtaaaagtgtaaattaagattatagttttcttgataaataaaataaaatgatattcatacaatattgttgaagacttttattgtcaaagttttattttgaactaccctaaaaaaatctttttttttggatcacagcaaataacttttttagcatccatcaaaaaaatcaagcaaatcagtctcagtacaccattaaatttctctatccatatatcatatatgtaagccatatcttcaccataatggaggatagtccaaacccaaaaaaaatggaaaagttactaagtccaaaatgaaaatattggtttaagggtgatccaaaataaaacattgctaataaaatatggtctaaaatgtaatttactactctttaataaaataaatagtcaaacgttatttgaaaagtcattagcgtcggatggaaggagtacaatccaattcacaaaatttagtgagatgcatgtaaaaatgatctaaatgcagccacaattgttcttcctctgcactaaactctgttgtactgcagaatcccaattcctgtttagagcgagatagtatgccaactattagctccaaaaatattcacgccaataatatattgttaacttaataatagagagcatgtacagtaatatgttactattagcttatctacccatatttacttcttaatattttattctaacatttttattgttagtcctatccactcgttcttttctgccgtgaaaactgaatagagcagccgtgtatcagggtggccagtagaatcttatgctgcttcactcgcgttgaagcccatgagtctacgtcgataaattagtcgcccgtttttgctctctcttcactcaatcctcatacatctctccactcaatcctcatacagatcaccacttttaccatcatatacagattatcgttgcgaaatggcatatagtctagtggttgcaaaagtctaaataacaccttaggttctgggttcgactctcatgggtgggaacgaattaaatattgtgctttcaatgataggcgatgtacccgttgacagcgagacacctatggtggcttcgtcaatctcaattttttagactttttggtgtttgaatctcctgaaaatgaagatggagataaagattaagtgttccacataaaacgagatggtaataatgtttgattaattgagttttaattattacaaacttgaaaaatgtatcaatctgacattttagagcaactttcatttggaaagttttcgcacaaaacacactgtttagtagtttgaaaagcatgccacgagaatccaaaatttcatctcctccttgatggagaaacgaacaaagacagctatactgtacagattatcgctggcttacaccagctatattgtactacctccgtttcagaatataagactatctatcattgcccacattcatatagatgttaatgaatctaggcacacatatatgtctagattcgttaacatatatatgaatgtggacaatgctagaaagtcttataatatgaaacggaggaaatacctgctatattgtacctgctcttaccattcgtaggccctgtttagatgggactaaaacttttaagtctctatcacatcggatatttggacactaataataaatattaaacgtagactattaataaaacacatccataatcttggactaattcacgagacgaatctattaagcctaattaatccatgattagcttatgtgatgctatagtaaacattatctaattatggattaattaggcttaaaaaatttgtctcacgaattagcttttatttatgtaattagttttataagtaatttatatttaatactctaaattagtgtttaaatacatgactaaagttaaatcctgatccaaacaccacaccaccgtagaactacagcaaaaagtcagtaacaccttcccttgaaaaataataaaaatgagaaaagagcaaccgctccaatcttcaccgcccacgtgtccacacctgagaaagcctcctccccctccaccaccgccgcgttcgtcgccaccgaccaccgtcgctatccaagaagaatagacgacgacgaccaccccggaaaccgagctcccactcgcggtgaggtcaccaatggcggactccctcctcctcctcgcctgccacctcctcctctccctcgccctcctcgccgcctccctctcccacctcctcctcgccgccaccacccacctctccccttcctcctcccacctccgccgcctccgccaccctctcctccgcctcctccccgtcctcctggctctccccttccccttcctccc

SEQ ID NO: 81960 - DNA, 17313 bp, Oryza sativa
ggacgagtccaccatgtacattagcgacacccgccccacggcgaggcagctctggaagccgcccgtcggcgtgctcgaggtcggcatcctcggcgccgccggcctccagccgatgaagaatcgcgacggccgtggcaccaccgacgcctactgcgtcgccaagtacggccagaagtgggtccgcacgcgcaccatgctcggcaccttcagcccgacctggaacgagcagtacacctgggaggtgttcgacccgtgcaccgtcatcaccatcggcgtcttcgacaacaaccacctcggcaacggcaacggcaacggcaacaacgccggcggcggcggaggaggaagcccgccggcgagggacgcccgcgtcggcaagatccgcatccgcctctcgacgctggagaccgaccgcgtgtacacgcacgcgtacccgctgatcgtgctgcagccgtcgggggtgaagaagatgggcgagctccgcctcgccgtgcggttcacctgtctgtcgctgatgaacatggtgcacctgtacacgcagccactgctgccgcggatgcactacctccacccgttcacggtgacgcagctggacgcgctccggtaccaggcgatggggatcgtggcggcgaggctggggcgcgcggagccgccgctgcggcgcgaggtggtggagtacatgctcgacgtggagtcccacatgtggagcatgcggcggagcaaggccaacttcttccgcgccgtctcgctcttctcgggggccgccgcggcggcgcggtggttcgccgacgtgtgccactggaagaacgttgcgacgacggcgctggtgcacgtcctcctcctcatcctcgtgtggtacccggagctgatcctccccacggtgttcctctacatgttcatgatcgggctgtggaactaccggcggcggccgcgccacccgccgcacatggacacgaagatgtcgtgggcggaggcggtgcaccccgacgagctggacgaggagttcgacacgttcccgacgtcgaggcagcaggacgtggtgtacatgaggtacgaccggctgaggagcgtcgccgggaggatacagacggtggtcggcgacatggcgacgcagggggagaggctgcagtcgctgctggggtggcgggacccgagggcgacgtgcctcttcgtcgtcttctgcctcgtcgccgccgtcgtgctctacgtgacgccgttcagggtggtggcgctcgtcgccggcctctacctgctccgccacccgcggttccgcagccgcctgccggcggtgcccagcaacttcttccgccgcctgccgtcgcgggcggacagcatgctctgagcaagacgacgtacggcttcaaaatgtttgaaattttcagtccaaaaagatgagatttcgttttgtttttgtttttgtttacattttgctgatgaatttggacacttgagatatgagaatttccctcccatgtaactatgtttgtctcgaggattctaataagtgcatgcctggattctaataatacgcaactctttataagaaagtttagggaatgccattctgcgtgatctgtaatctgggcctgaattggaattaggctattttagcccccaccaagatccatacatagcctaacaaaactgagtgggtgatgaagaaagaataagttcactttaggtccttcaatttgtcgctaagtctgaattcctccctgaactgcaataccagactgatatgatgtatccctcaacttccaaaaccaatacaaataatgtcctaagacgatttcgatggtggtttcagctgacaaccgctccacagaaccgccgttaaccattgatcgttgaggaggcgtattctcaagggacccatatctacagctgtgttaatgggggcgtggtttggtaatacgccaatttggccactattagtagaaaaaatgatttctttcacttcacaatcccaaataattcgcttaggagtcagtacataaagattaatttcatttcttcaatttgttttcctcttctaagtttatagctttcgtgctagcttcattgatgttacccaccaaataaaaaacttgttcgggtaggccgtctaattctccggaaaggattagttgaaatcccctaattgccgtggaacccacatatgaatgagacagtgactgtccggttaaaaataaaaaaatacggtggaactcatgtctcctccccaatatgcccatctcctccgctgagagaattcgtgatcgagccagtcatcgtcaaaacgaaggcggcgctgccatcagtgatcaagaacatggtgggtgctgtgttgactggaatggaaaaggggaacgctccgatcatgtcgaaggaggaaaccaaggaagcgtattttatataggacgcgtcaggggccatgtcgaaggaggaaatcggggagtccatggcagaaaacaaccaaagcggcccggccaccgtcatccaccggcaaggggcaaaagaaggggacacgcatcggcgagggcgccatcatagaggttgctgtacatcctcgaccatcctcttggtggccgctggtcattcgcaagacatcgtggggccgtcactggcttcaccgttgtcgtgccaactgcgctggtgtgcggtctcattgtaatttttttttatttttaactagacagtcattgccccactgactgtcgccatatggaaaggaaatatgcgaactcgcagcgtccgagacggggactcagctgcgccacccgcaagttcgcttggtatatcacaggagatttcaaaacctatcacttgccagatgatgcatagggattggtggattatgaaatttgaattctcaaaacccattcaaactttcactcgggatatactttcttcccacatcgaaacctcgaaatttcacggttcttcagtcgattttcgtcaaaaagaaaaaaacgtgaaccctaccctatgacggacctaagtaaggtctgctttatccgaatttacttgaggtggctagctactacgcctaaaagaaacactacagctaattaatccaataatattacatggccacaacaaattctcaaaagtatttttaaaataaatttcaactcgtaaccatgcaaaccagcgtagaagaaactctactcgcacatggtagaggctaactgaagaatagtgctacattgcaacaaataagcatattcaggatcttttttctctggacgaataagcatgttcaggattatggatgtaggcacggaggttacgatatgatccaataattcaaattaaacggtaccttgacaaccaataaattagcagcacgttcgacactggatatgattgaagatagcattttcactcgtacatattttctttgtttttaaatatttaacgccgttgacttttttaaatatgtttgaccatccatcattcaaaacatttaagtaattattaatttttttctatcatttgattcattgttaaatatacttatatatatacatatagttttatatatttcacaaaaaattttaaataagacaaatggtcgaacatatgctaaaaagtcaacggtgtcgaatatttaaaaacggagagagtatctcattatccttggggtttgaaccgtaggttgggttgtctaaaaggaatattctgcgtatatccagttgccggttggcttggtccaatccatctctccaattaaacatggtccgttccatccctccaaccaaacaaaaatcagatccatctcatcctaaaaatatatgaatggacctaacccatctcacatcatcctcaaaccaaacatatattagaaaagatggaaagaatcacacaagtcattgagaagcaagtgcaattacctaaaaaaaataaaatccagatgaataacacttgctgatatgatcatataccaaaaaaaactacaaaaaatatgaaaaacgtacccgtcaaaatccttcaatagtctctgtatcattaatcgtggtagataatgtgtttcttttgttccatagaagtttatgccaacgaaattcccatcaaaatcaatcagtggtcctccaataccggcctggcaaaaaaaaaaaaagcacatgaatagatgaaattttcaatgacacgcatatgaagcgatgaattaaattactcatattctgatacaattaattgtttacaccatgaaagaaatcaacccaatgtaccttagtgattttacaagtggagatcataagctctctgcagtcaagcttgctttcctcgtcagacaatatcccacttgtagccattaatttgcctgattcaaagatacgtcctatagctactacctccctatgaggttcgatttgcatctgtttgtcgagttctgctgtccgaagacaacagaaacccttgacactgaccacagcaatattgtagctcaaattgcaatgctgcaattcgcttacggcgattcgtttatttggaaggtacactttaatctgctaagaaacacaatgtgagaattaaagagtatctcaaatgcacaagcaaaaggagtgtttgtgatgccaaccttcaggttatcagcaatcttgttttcatcagcagatattctaaccaaacttgctgaagtcacaactcttgatgtggatccattgaagtctataaatacacctgtgcaagcaaaaaacctttcttctcctacaaagatcagtgattgcaattatagtcaggtgatggaatagagaaaacagacaaatatggagaagtaaagattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgccaagggtgaggagccaatttttcggaccattcgacgcgtacgtcgtgcacgcgcgccgcctgccctgccctgccctgccaggccaggccaggccaggccaagccaggcgagcgagcgcgcgcgtgtttcccctcttctctccaccacacatgcttcaagtggctagaagggcatcctcccttttaaggaggtccccctctcctaaaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatagagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaactctgccttgcagctcacaagagtatatgcatcttcacttggatagggtatatatatttgtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccatagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaaccacatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaagagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctacttccagtagtctgcattaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgtactggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccttgccaggccaggcgagcgagcgcgcgcgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaagatcatataacattgtaatctcacctttgaacgaagcaagtgagacaacactttgggatgtatttaaagcaacctttttactcagtttgcaccatgtatcttcagcaaattcctcttcaaaagtatttttcaagcgcataccccctggttaaaaaaacataaaactacagttgagtttgctagaaaataccgtcaaaatgtgcaacaaaagtaaccagcaaaagtgaaagcaatgactcaccccaaaacctgattggcatgggataattacgagactttagatcctttttcaaaagctgcgtgaattctggtgcaacaaggtgaagagtaaataatgatcatgtgatactaatagctagcaaaactgaaagcaatgactgaccatcatctggcaagggcttaataagttcaggaaacaattcctcctcccagaaatctggtgcaacaaggtgaagcgattaatttacatgttctggtagtgatcaataagcagcattataacatgctgagagcttgcatgataatttggtaacaatcagttagaaataacctagctcgattcaccttctgaatcacttgtagaatattcaggaagcttctgagtctcactttcattctcttcatctgaagtacctaaaataaaatttaaaaaataagcaagaaaaacgaacaaaactcaaaacaagcaatgagagattaatgaccctgcattagaaatgactaataagtaataacattataatacgaggacagtttgcatgatcatttaataacagttagaacttgatacttgattggctcatcttggttcaccttctgaaaagcttgtgatggatacggtttgctcctggttccttttttttgccactcctcttgaggtacctaaagcgggaaaccaaatgaaatgaatgaacataattaaaacaacgcaatgctctatccagggcatcaacagtagattacaaaccttacatgttattatagtgattatactatctaccctgttccacaaatatggagtgcatttattttatattattattgaaaaactagcatattgcccgtttgctgcaatggattttcttttttaaagaataacttattgtaccgtatatattttaaagcccataaaaatgttgtttctattgtccaacatattatcatcatgctactttttctgttactttatagatgaaaaattccataatattcgattgtcatatttttcttctggcggggtctgtggcctgtggggtataggagacaggaaattctttgtctcactctttgtggtcccgaatggtagttggatggtggtggtggtaaattcactaccaccactaccatctttcatattagtacatagatatatagatacatggcatatttcatactgcaaaacaagataagcatcttatctactatacccctaacaaatatatccaatttatgagcaccgggaacaccacaaagttaagctttacccacaggagaggaaactacaaccaaggattaataatatacattaatgaagatcgacttctgacaataaacaatttatccagtacaaagagtgattgtgcttcaactgatgaactcaccaacaaaattgttgtgtatcatcttagatctgcatctttcaattatgcttgtgcattcatcgtcgatttcaaccctgcagcagaatgtagtatactcttatagtgcaaatacacagagctgctgatccccaaaaagaatggattgcatatagctaatcaaaaatactatcaagattaacacttccatccataagaagcatattatggaaatcagctatagggcgtgcaaaacatagtaatatattgctttatctagcagagttataataacatagtactatgtgcaaaaccaaatcgctattatgtgataggctgtcaaataaaaatgaaaaaggtccactttaatccctcgaactactattttgcgggagcacttaaccccctaaactatttctagctcaatctggcttggcaagtgtttgactgtttggaggatctgaatgaaagtacgaggcataccagagtgtgcaagatcgcaccaagcttcggtaaattttgttccttggtaggaatggagtcctctcctccgaaaaaaagttcatgccaacaaagttcccatccaaatcaatgagtggtcctccagccatatcctggaagaaaatatactgtcacactgagctaagataagcacaaaaataaaaccatattgaatgaaaaaactacatgaagagaatgaaatgtttaaggccccaaacgatatagtacagtgtatgtagtgaactagtgataaattctgctactcatatcatgagacaattattaatttccacaataccgagaagaaagaagagatatcagcagtgcaccttagtgattttacatgtggagatcataaggtgttcaggataatctgttggcccatcagtcactatcccagataacgccatcaatttgcctgagttgaaggaacgccctacagctactaccttactttgggacccaaatcgcacttcgtgatcaaaagacgcagctcgcaaaccaggtaaatatttgatcaccacaacagcaatattgtagtttaagtcaaagtgtcccatccacccgatgacacgttgcttatttggaagcagaactcgaatctgcagtgataatgcaagcaacactgcagaattattatcatatcttaaacaggtaagtaacagagtgcagagaaaattaggggtaccaacatccaaaaacggattgatcttgctgtcatcatcaaaacatctaatcacatttgctgaagttagaatacttgtagttacttcatctttgtttctgacaactatgcctgtgcctgaaaaatgcgtctgatctcctgcacaagataatatcttcaatgtttagaactgatgatcagatacatatatggaaaactaatttgtataggcactcaccattgaatgaagccactgagacaacagtttcagataagtttgaaatgacttcttgactgagtccactctaggcaccttcactataatcaattaagctaccagattcctcttcaaaagcaacacatttagagctgtgtaaatacatgtaagaaatggcggaagtgaatcaacattcaagaacggactcacctttctttctactatttgtgcaagttttcttctcttcatttgagctcgagcaattgccccttcgtttagacatctttccaaccttggatcagaaaggacaagacccaaatactgagtaaacattaccatgaaagttcgatctttaatttgtttttgtttttttttcttttggcagaagcaactagctagtcaaatcacaaactgattttctggcacattacgtatatagctaggtacacgtaaaactgagtagggccagaccagctagtaatacccagtaagctttgaacataattaaggtgtcatataaatgatcttcgcaagcaaaagaggaaaaaaatccttactgcaaatgaatctatagactaatataatgccattttaactggagctgcatgatacctgattcacaatagaagaagctaccaaaggttaactgagcaacgatgaaagcaaagttcagatcaattatttatctaagataaataacgtcggcttgtcatggtaatttacaaatttgcagtagataatttttttaaaaaaagaaaagcaagtaaacaccagtaatatccaaccagctctataaccatgaagaaccaatagacagggaatagtggagaaccatgtgtgagagatgaatcaattcacagaagaagccccaattgctcggggttcaactatatatctttcccgcccaatgacaaaaactaataggtcaagtagctagtacatgacgagcctagaacaaaaattatgaaagataagatacatactaattatctaattattgactaatatagtataagttaacatggtataatttagctagtattgaataatttactcgggggccttgggacccggtaacgtagtaagcataacgtagacacgccaccggcaaatgctactgctagcttgccttacacagatcacagacagggcaagcaagaacacaatttgtaatttttgctcaactaagaacacaatttggaaaaagaagcgcgcattataggtcaccttattgctgcctagtcacccaagttagtagccgacgcaggcgccggagtacaaggcaaagcgacggtcgccggagacgcgagcaacacgagggggctgggaggcggtgacgccggccgcgccggatgcgcgcgtctggtggccgtcgccgccggcgacggtgagggaggaaaccctaaagtagactagggaagaggagaagggggaggcggtgcgcttgcaattttcgcgcggatgggaaaccaacagacttgggctatatagtagtagttgccgcgccggggaaattgattaggcccttgtttggttgggccgggttgaggctggattgcggccggatccgcggggaccagaccagcccaacccagcccagccaggacgtatttttaaaaattaaatccatgccactgcaaatgtgctgattcagaaaaatacaactactatttgtgatatctattgcgtaccattgaccatgccatcgccatcacattttctgttataatataaattaaaatacccctacatatgagacttacatgttagctccatcttcctcctccaccctcgcctcttctcttttcaacatctcgctctacatctcccccggtggatagaggatgcggtggcaggcggcccatgggtgcgcaatgcaagtggctaaagggcaaggtagcggtgacctcatcgacgatggaattagaggttgtggaagctgcatcgtcaggacgggagccctcacgcgagctcaccaatggcatcacacatggaagctgacagatgagggagacaacatgttgcctacatgcatggtgtggtggtctgtccggtgtaccagagccatcggcggggtggttaaggcagcaacggcgcacagtcgacatagaggggtggcgtggcggcgaggttcggtggatgggggaggaagaggcaatggtgagaaaatagatctcccctctctatttcctcactcaggctgcaacgcatgaacatctcatcctctccgtcgggaggtcaccgacagcttctcacttaggcggattgcgcgcgttggtgttgttgttgctgctactcctggtggtagttggcggcggtgccagagacggttgttgctgctactggtggtgattggtgtcgatgtcggagacggagaagccaagtaggttgacggatctaacgaggcaatgaaagaaaacgtgacggcaatggcatgtttcaatcttacaaaattccagtggcacgcaacagatatcacgaataatggtggtatttttctgaatcagcatacttaaagtggcatggatctaattaaccatttttccccttctcaacctattgacctgtttattcacagtaaagggaagagaagaagagggccacgcatgtcacgcacgctcccacggcccatggccaccaaccactccatcgtatctcctctctctatatatatcttatccatttctttctctccgtcttcacccgtgcacgtgtgcaagcgaatgaggaagcgatgacgctgtcgcctccctctagcgatggtggaggccctctgacaaacccccttctctttacagcaagcttcctccgatggagaagagggacggaattgagcaaccttcttccagcgacgaaagcctctatttggcaagcctcctctttcttcctccagcaaccaagttagctctatctccaccatcatctccagcctcaccagcgccaaaaggtgtcaatgttccagagcggcctccttcccctcctattcgccttactttgccctcatcgatatcatcagcccacaacccgctgctgacctcgcggctctaatggcgtcaccgccacctcaccaaccgcccttgtccgccacacatcgtcaaattgttgcctcataggccatccctctaagcttgagtattctatagtgtc

SEQ ID NO: 81961 - DNA, 12255 bp, Oryza sativa
caaaaccaccgcggattgggtcaaggggtataatttgtccggtttgcttagttgggggtgaagaatacccggttttatggttcgggggggtggtaatttggacagccgcgatagttccaggggggattcgtactttttcctttgcgaatttgcgatgattatgaggcccgggctattgctgctgactttgtgccgatggatcgaatgtaagtaccattttttaaagataatggaagtaaatccagtctttgctcaaaagagctataaccacttattacacaaactcgctcaacagtgatcacacaccataatgtaagtacctaaccaacaacaccgtgcttatatgttatttccataattagtgattttatgacgaagttgtttggtccgtggatcttcagtttcgcttacagcttcatgatttctttaagggagttcatcttataccaccataggtgggcaatagtcttcctgccccgctggatgatagcagtttcaaccggtagcatgaaggctttgttcgcactaatgcgtgccaaaactacatagggcatcagggtctatgtatgggctttccatgggccttgccttatggcccaatgcccatggcatgtaaatatgtaacatctccattcctgtggtccaagccccttcgacatgacaatactcgatgtgataagatgggaggtatagtttttcaggaccctcatgcatgtgtactctcctatcattttcctgcagtacctgatcttatccccgttgggcaatgaggagcttgaaattgtgttcctggcgcctccctttccctatgtatggatggacggtttaagagcttgtttgtttgggtaaatggggatttcttcaatccctacataatggcatgaaaactcgactaaagaagacatcaatctgcaaagggtttgggctcctatgtgcgtcgtacatccagatcggagtctgttgaagacgtcgtctctgacattgtttcttaagagttctatatatatcatagaagagccagctactagatgcacctatggtatttatcatggaaggcaatatcacaacgtaattaactactccaccaatgcaaccatgcttttggagacacatggatgtatagatggctatatggcccgatggcccgcccaaggcccggtgattttggcccggccaggcacctctggtcgtgcctgtgctggcccggcccaacagccgtgccgtgcctaggtcactacctcaacacgctgggccggcacggtccggcctgaagttcagggatgcgaaacagacttattctcaaccatatgtaaggcacgtcacaaagaatagggaggaaaaatatatttattttagctatatatatgtcacggccgaaagaggagggaggggaaatagagttattttaaagaagacacgatgggccgtctgtgccttcgggctagcacggcacggcccgactattggtgggccgtgtctgggcttgaggtgcagcctgtgggcgggcacaccacggcccaatgtgttggtcaggccatgccggtccggtagaatctagcccgagcacggccatgcttgggccgtgccgcgcagatgaccatctatatacatggatgtatttacttaaacatttttttaggtgatcttgcaaaaaaaaaaaagccatgtctcaagtgcgagctagcttcatggactcagaattaacctcatatagaggtgagcatgtacatctccgtaaactactgtgtattagtataaagtaggactcagtagtaagcaggatcattttatcctgtttggttttacgacatcaaacaatgcaatatacagccaatggagtttgaatggtttcaatattaaagatcattttcatagctctcccagtcccaaatgtacagcctgatattccaatcgtcgtattagttaatttattgcatcaatttgaatttgttaaaaccggtatcacaaacgccaatgatgtcatgataagcatagacctccaatctgtttgcttgatcgactaggcattgctcacagtcacggaccttatcacttacacactgattaattcaatattagcaaacgagttttttctttttttgaaacgaaatttgaggcaacgcccaccgtccgtgctcacttttgacggaatttgaggaccaaaccgtgtcaagattttgctgcgttacaacttgctttcgacgagtaatggatgtccaaaaaccaacatactcactgggacttctttattggcaaatgaaaaacacttacataagctcttcagcttggtttcaattgactgggattttagttcaattttgcttttattatgaatggatcctagatactctcaccaatttacaacaagctctctgagatttcatcgatctgtaatagacctatttagtccattatatccaagaaggttactgtgatatagtcatgtttatttttactagaatcgacagatcaaaagtaatggaaaattataaactcccaagattatgattgtgatagaccaactgagtggcagccaaaacaagctctgatgactcacagccttgtcctgcatttctccttaatcaccatcaggagatggatgttttcagttccttgcgctgcttgagatttcttctaggctagttcatcataattgcacagtgggatatcctcattaacactatacattctgccaccacagtagagcaactctctcccacaggcaatggcttttctctgatctccaactatgagcatcgagcatcacagtttcgtgatcttgcacagacaaagtatgggtgggcagatcattgaaaatgcttgctgattgaaactaacttctcggtgcctccatttccaactaggatgtaaaactatgatccacaatattcctctaccatatccagcagtggtcttcaaaccattacagaagggagcgcctctgctatttatctttggttgattattctttgtacaattttcacagatcggattaaataaagtcatgaacgaaatgaacctcgaatgacgacacatgtgctgcacaactatacatggccataaggcccgaggcccgacaacccagcccaaagtgcggccatttggcccggtccaaacacgacatggcacgattggtgtcagacccaagccagctcgggccgacagttgggtaaaatagacttattttatagagaaacacgatgggcgcctgtcatgtctttgggctggcccaattcctagggccatgggtgtagcccgtggacaggcacgacacagcacgacgtgtaggttgggccatgccgggcttggtccgggtggcctatttggctatctatatgcacaacaacttacatggaataaaacacccagcaaattatttaacttgacgacaacattatttgcacattgcaggcacactataaaagttacacatttaaagagagtttctcgtgtgtgtgtgtgggggggggggggctgaaatctcgaaaattttgcgatgaaaaaaaataaatttaaatagaagtaaaatagtgaactttctatcctgccattattcagctcacagtagttcggatgaatacgaactaatggcatttgttttgacatatttggtatgatgagatacgttttgaacattcataaaagttgaaagcaggtcttctgaggtaaaaaaatgactacatttaataaattgtaattattagatttggtcgtattgtgtattatacaattatacaaggaaagtaaaatacaggtgccttgatcacaatttggtgccaactgctaacactgtcgggttacaaatgtgctccgttttttttggtttgttttggcaggaacagctctgacgagagtgttgcatcaggcccccgtcatgtcggattggacactaattagaagtattaaacgtagactaatgacaaaactcattccataacactggacttattcgcgagacgaatctattgagcctaattaatctatgattagcctatatgatgctatagtaaacatgtgctaattatagattagttagtcttaaaaaatttatctcacgaattagctctcatttatataattagttttattattagtttacatttaatacttctaattagtgtccaaacatccaatgttacaggatccaaaaaccacctgatgaagtaaaacttctccttttatgtttggcactccatttacattttatatcctctctgatgtcttaattatggcaaaagatattcctgtttagacagaagttatcctgaagcattcatccaattcttagaactatttctgttgtcattagtgacattagtgagtaatgacatctgttgtgcatagcattttccatggagcagaacagggatcatacacatcataaagataacttcataattatctcggtaacaacattgttaccgccaaataaaaaaataacaaatttatttcatgttccatgggaagataccagaaggcaccaattattttttgtgtaaataggtatcaggaggcaccataattaattaacactaaaaagtatggtactatctgatgtcttccgagactagtttttaggaaaaacctttaacttcttcatgtagaagagatcaactccataaagaagttaaaagtttttcctaaaaaaaagttagagctaatgcttcaggtttagagaccaaagaattacacaattgaatcaaatcggaacgctttctattattgtcgttaagcaaatcctgacaaaagttgaaacaatagcgacttaaaaaaaatgactatgcagcaaaggagtacatcacaatacaacacccataaagctgctaaaatatttagatttaaaccttccttataatatatacttccatttcagttggttgttctagtatgagaaattttgggaaagagtatattagatcatttcaaattcatgaatttctaataatccctgtgtactcagctagtctggtctgatcttggtcttgctgttcaagctacccactgctctgcgaccggccatccattaccaaggctgtctgctaccaccaagcatccaaaggtgaggcaagtgcaaccgtagggcttgcaaggacatatcttactgtcttgtatagttgtaaggtgggcagtatcaatccccttatggctcaagcagtctagaacagccggaagcacaaccctgtcggttgaggatcttgcatctaaatataatcaagtcctacctttacgttcctcgtcccgaggatggacccaataggttgaaactgtattcccaatgcctccttttcccttgtatatgggacagttagaatgttgttttagtgtgagtgcggaaacctgatatcgatgccttgggaatatgatgaaaaattgaactaactagacctagatagcatgctgattttgcgtatcttgctgttcaagctacccactgcttggtgaccggccatccatttccaaggctgtccgctacaaccaagcgtccaaaggtgaggccagtgcaaccgaagggctacgtgcaaagacatgtcttaattactgtcttgtataatagtaaggtgggcagtcaatccccttatggctctagcagtctagaacagccagaagcacaaccctgtcggttgaggatcttgtagctaaatgaaatcaagtcctgcctttatacctcgtcccaatgaacccaataggttgaaactgtattcccaatgcctccttttcccttgtatatgcgatagttagaatgttgttttagtgtgagtacggaaacctaatatcgatgtcttgggaatatgatgaaaaattgaactaacaagacctagatagcatgctgattttgcgtatctacactagagctagcttgttgccattctcactttgttatcctaagagagttctggtgttctacatcagagcacagggccagttgcaagcaggttctagtatacatttctatatatatggaagtcaataaaagtaggcaatgagacgacacatgcatgcaaatatggtatttatcatgaagaaaagatcgcaatgtaattaagtaactcaaccgaccatatatgcttctgaacgcatcgatgtattattgcattttgtactttgtagaaaaacaatgggttgtgtccatgtgtgagctacctacatgtatgcactcgaagctgtaaaattatttgtatattggacataggatctcggtgcctccttttccaaaccggagtttgcaattaaaattgacgatagcatttgcttcccatctattatctacaagaataaatgttatatatataccccaaatggcttcacctatctgcaagagatcaaagaggcttcttgttaatttgcatgaccatcatgatatatctgttgtttaattttgacaagaaagaaaacgagtcaagttgcatatttcaggttcttcaatttgaagtctcaaattcgacggagaaattaaaagtcatcaggttcatgaagaaattaacattcctcatcttgcatttgatcctaaacttattgaactttgccactgaacgagagcctgctagagctatacagatcgcgggaccatttgatatatttgatgagcaaccgaggacacacgtcattgccggtcggcaaatactaccgcagtgttccattcacgttgtttgtgcccaatggagtttcttcacaagagcgctgtgtagtgatgccgaggttttagcagcgtccaagaaaattctacgggacgactctagcataagatcttatacctcactctccggttcacggactgctctttttgttcaaacctcacgattaaaccgattgccttgatcattgaaattgaaggtagcttgaaactttgttccgggtgcctccatttcctatggcatgttcgacgatgagacccattatcattttgtaagcacctccatggccgcaccaaaatgtgtattcaagcatcagggtcttcttctatttatcatgggttcacacaactctcaacataatttctgcaccaattctcagcacaattttgtgcgtaagtaagattaaataaagtgttattaattagtgagtaacgacatctgttgtgcatagtattttccacggagcagaacactcaaaggggatcatacaccacttcacaattttcttggtaaaaaatattgctaccgccaaataaaaaatcacaaatttatctcatgttccatgggaagataccagaaggcatcaatatttcttttgtgtaaataggtatcaggaggtaccataataaattaacactaaaaaatatggtaccatataatgtcttttcaaaaacaataaaaaaggctaaataaatgtgaaggaacgatactaatgagttaccaactcaatccaaaagcagagctcatgccattttgcttctgagaggaaaacaaaatactaaaaactgaataaattaaaacagcgcagtgcatagcaattaatcaaaaaaaaaaaaaaacagcagtgcatagccggccattctcagctgaaagacagtttcaatgaatatgatctaaccatcgagtgccatttggttagactgtgttgtttcttgataatggttagacctaaaaccaagatagagctaaactccataaaataagttagagcttttcctatagaaaaaaggttagagctaatgctttaggtttggagtgtggaaaaatctaattggtgtattctattgttttctaatctattacattgactctcttatagggatagaaacttagagtgcaatacaagtaagagtagatttatctctaagattctatctctatgatatatcttatctctatgtttgtatttgaatcttatctctaactaacatatttgtacttctaacaaagagaccatagaattaaacaattgaatcaaatctaagctttctattattctcgtatgcaaatcctgacaatagttgtaacaatagcaagttaaatatgcttgctgctaactgtagagaaagtggaatagatgcctcaccaatgtggggaggtgaactctcatatatatatagcagaattacaatcaatgctagtgctgagttacaatcaatactagggagttacataagaccaaaggtctaggagagtaactatctaggagtgtaaaagtttaggagataaacagcctatagattaataaataatcctaatacccgcccgcagtcgtagcgggaggagcatgaacgcacagactggaccgaaaatcagtaaataactgaaccggcaaacctttggtcatgatgtccgcgaactggtgcgatgaagggacatgaagtacccggacttgtcccaaagccaccttttcacggacaaagtggatgtcgatctcgatatacttcgtccatcgatgatgcacgggattcgctgtcacgtaaacagcactgacattgtcacaatagacaatagtagccgaagcaattgggacatgaagttctagtagcaattgccgcaaccagcagcactcggcgacggcatgagcaacggcacggtactccgcctcagcactggaacgagagacagtagtctggcgcttggaggaccaagaaaccagataatctccaaggaagacacagtagccggacgtggaacgaggagaatcgggacaacccgcccaatccgcatcggagtatgccgtgagggactgaatcgggccggagccgatgtggaggccggtggagaggctgcccttcacataccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacgggcaggccgtcggtggcggagagcttggcacgagtgtccactggtgtcgatgtagagtggcactcggccatgctggcccggtgaagaagatccacagcgtactggcgctgtgagaggaagaggccggcggaggagcgcgtcacagagatgccgaggaagaagtggaggtcaccaaggtctgtcatggtcgaagcagtgaggatgatgtcatcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttaataccatacagggacttctgcaatagacagacagcatcaggggcagcggggtcaacaaacccagagggttgctgacaatagacggtctcctgtaggtgaccatgacgaaacacattcttcacatccagttgatgaattggccaagcacgggatgcagcgatgctgagaacaaaccgtatggtggccggcttgacaaccgagctaaatgtctcgtcgtagtcgatgccatgctgctgcgagtaaccacagaccacccaacgagccttgtgacgagcaagagtgccgtcagagtggaacttatgcttgaatatccacttgcccgtcacaatgttgtccccaggggggcgaggaacgagacaccaagtgccgttgtcaaccaacaccttgtactcatcagccatggcagtgcgccagttgggatcagccaacgcactgcgataattggccggaacaggagaagcagcggtggcgtgggtagccgtgtaggtcagcctgtcaaccggccgtaaggagctagtctgggagcgcgtcaccatggaatgcggctgaggagcagcagccgtgacaaccacattgggtgaagatgatggcgggaccgtcacggtgggccgacgggtgtagacatggcggaatggtgacacggtgccggctcgggtggcaccgaccgacggggcagcgccgatcgaggaggcgctgaccaagggcgtgccagctgatcgggcgtcacgtgccgcagggacggtgttgttcggcaagcgtcggccgaagaggggaacgtacggttgctcaacctccatggagggagccaccgtaaggcgtcgcggttgctcaacctctgtggagggagccaccgtgagaggtcgcggttgctcaacctccaaggagggagccaccgtgagaggtcgcggttgctcaacctctgatgagggagcgaccgctggagggagtccctgcagcaaaaaatcaaaagacgagggagcagggggagttgctgcgaagggaaatcgtgattcgtcaaacacgacgtggcgcgaaatgatgatgcggcgagtggagagatccagacatcggtatcccttgtgggaggccgggtacccaagaaaaaagcaagttgtcgagcgaggggcaagcttatgtggagtcgtggcactcaagtttgggtaacaaagacagccaaagacgcgaaggtgggagtagtctagggtggtgcgatgtaggagctgaaaaggtagtgagtggtgaacagaggaggagggtctccggttgagaaggtaggtggcggtggcgagagcctcagcccagtaggacggaggcatagaggcctgtataagaagggtgcgtatggagttgttcatggtgcggagcatccgttcggctttaccattttggggggaggtgtaagggcaagagagtcgtagctgggtgccacgactagtaagaaatgaagtggtggcggtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagtggaagtgcgagacaaagacctatcgaaaggtaatcgggtatgtttgcctaactgatacgcatgacataaagaggtgtctattttattacaggaaatagaggacatatttcgaagactgtggatggcggctggaccagggtgaccgagacgacggtgccaaagcgtggaagaagtggcgagggagcaggacgcggtgttggagggagtagcagctggaagggtgtagagttccccgtgactattgcagcgaagaatcacgcgctgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgtgccggtgtccaaaacttagttgtttgggctttggaaggccatctggttcagtgctgcaatgaggccagcttgctcccaattgggctggcctgtaggagcaaatgtgggcgacacaaatggcctagcatatgtggtattggcctgggagtagtcggccgtcggagccggcccaagaaggccggctgaagaggggcgccaggcctgttgctgggccggccaggggttaaaacaaacccaaggcccggccggcctccagctagggttggccacccagccggtcgaactccctccagcagagaaaccgccgccaccagaggaaacgccgctgccaccgccgccagagaaggcctggcgagtgccaccaccacccccactgccgccgccgttccctcctccatttccgccgccgcgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccaccgggagggcaggaaccggagccgaagccgccgccggccaccagcgccgtggctgccgccaccttggcttcgttggcgatgcgcaactccttcagcaggagggtgttgcgcgctgaggtgaagcttgggaggacggctgcgccagcgatgttatctccggtgttggagaagcgctcgttcaggccttggaggaggttaagcacgagttgggattcggtgacggcgtggctgatgtcgcg

SEQ ID NO: 81962 - DNA, 18876 bp, Oryza sativa
gctaacatgtgccatgtgtgctgttctagatgggtgggacgacgaacggtattgcaacgtacaaaacgtgcaagccttgtggctcatctcatctcgcgcgcgatggctcaatatgcatatttcaacgtcgtcagtttttattctcgtgcaactggcgaaggttcgccttccaaaatttacaatgcatcatacgtcagattaaaaataatcttgtctcccgaaattcgtggctaattctcttttaacctcattcatttttccaatatgagaacttaactttgagtcttggacgtgaattaaagcagatagcacaaactgaaattaactacatcttgtcttgtacatgttgtatgagttagtctgagccggtgcaaccaccattcttctttgttgttcgctgtctatgttctttgcaagctcgtagctaattggggttttttaaggagattaataagattttaatgaactactggttggtaccgacttttaagaatttaaaaaagctgtattttcagcttctaatttctctttcattttctaaattctacaactagattgaacttgaagaagctgcaactgatagaagctcctccaaacaaaccttaagaattagcccaaacttgatcgccgttgagccaacacgtcttcagtcttacctgctatggatgcatgagacgccttcactctcgatgctggtgccacgatgtactgtttgctttgtttcgtgcctttgcttctgttgtcttggtcatcctgggagcttcctcagagcctcagagtagggggaacctgccggctccagtagatagggcagccacaatatgtgttgctggtttcatcttccattctacgggcttgggggttcgtactcgacttaccagaaaatacagcacttaccactctcctgatgcttcccaatcttgcattcaacttaagagaaaaaaatgttggtttcacatcaagggcaagtagaatgagcgctgattgggaagcatcaggagagtaaaaaatgtatagtcccaatgcatttatggtctctgtgacaaaacgatccagttctttttttctgaaaaataataagtctagcaagtgtgaaaaaggtggtaaataaattgagtgatttaaatcacatctagcttgcgtattagagcatgaaaaggaaaaaaatgtggtaaatagattaagtgacttaaatcacgtgtaaaatctattggattgttgaactaatagctagtgctggttccacaactggcactaaacttcgtacactaggagtgggggttatcattattagtgctggtttcaagtcgaatacttcctccgtcccaaaataagtgcaatcatggttttctgcgtctaactttgactgttcgtcttatttgaattttttttaaaaaaaatcaaaaacataagtcacgagtaaagtactattcatgttttatcatctcataaaaataaaaatgctaattataaaaaaatttgaaataagacggacgatcaaagttaggtgcgaaaactcatggctgtacttattttaggacggaggtagtacatataacttgttatggccaaggattcaaactggagacctctccttagctagcatcaccttaaactagctcacctacaaatcagtttactataaaaaaacgattttcctgtacagggacccatttatattgcagatgaaccatgactagtcgcgtttgggaaaataagcttattttcgcgtgcggtccatttaagaggaccgcacggaaactgagcctattttcacgggcggacctattaaaagtgccgcacgcaaaaataccgactccctctttccctcttacccactttaaattttcccctctttctctcctttcctcgctatgtctttttcttctctcctctcctctttcctcttcccagtcatcagtcaagcggcctcacccatctgcaccctcttctctcctcccgacggcagcggtgggcgtaggcgatggcggcggtggaggagcaggatccggcgggcggtggccaacccctgcacggatccggcggtggtgaccgtccctgcatggatccggcggccggccggccaccctcccccgcgggatccggctccctcccctcctcttcattctctccccagatccggcgaaggggaggggtgtcggcaacggtggcactcggcagcagcggcggcgtggcggcggtggaggcgtaggatccggcgggcggcggccaacccctgcacggatccggcagcggcggccgtccccgcacggatccggcggttggccatccccacacggatccgacgcccagctgccctctcccctgtgggatctgactcccctcccttcacctcccttccctccccagatcaggctgaggggaggggcgtcggcggcggtgcggccggagcccggaggggagcatggaggccggcgagagggcagatccagcggaggccggcacggaggccaccgctgccgccgacaagggcgggagcggtgtcctcggccgatgacgacgacgacgaggaggcagcagcgccgccgccggattctaggtttttcatttgttttgaaatttttttttccggatttttgtttttacgtacggatgatataagcatctgcacgcggaaatcgtgatttttgcatacccctgggtgcgtgcgggtcgctcacccgcacgcgaaaatctttctcgtagtagtggttctgatagcaaatagatatttttccttttgagttttgcccaacagatatttgaattgtggagtattatgtttgaaagatctcaaatgaaaaggttgtcaacaacaaaatcatcatgtcgatagctataattttcatataaaatttgtctcaatccaagtttgtttgaaaatattaagtttacattcaaaatcggtactaatatagccagggtcatcattgctaatttgtagctagaaccgacacatgcgagacactcattcattagtgctagtttatagctagaactggcactgataattaacacggactcgaattcgaaaatttttacaaccaaaaattcttattagtaccggttctataaactaataggcactaatgtgtgggatactagttgtggcttgttatacatattgacgttgattacccccccataatcagtgccaattaagcactagaactacttacgtcgtcatcggtgccggttcttccttggagaagtttcacttggataacctgaaaagtgatgctccggaataggggaaataggaaaagtttcacggcaaacgaatcttccctatcaaattttatttattacacgatcaagccactatgaatggcatccctagcaatcaaaagcgaattctgatatagcacgattaaatttgttcatttttatgatataatcgtttccacaccgttcaaattccagtgctggttactggcttgactaccaactcaagtgttctatccgttctcatcatggatcaatgaatggctcttaacactggattttcggtgcctcccttccctactatgccgtgtactatgtccaccctagtactattgatattctagtgtttgctcgtaacaaaattggatctttggtattgatgctgacgattaatttttttaagacagatagttctgaccattaggtgatctttggagcccagccctgattctcctgctgtggagcgttggaagggccttttgcactcaagctcctggatttgcatagaattttttagctagtcagacatgtctcactgggattcaccctggacagctctagtgctctactgcactcgaagaacatagctccctttctcgccgtcttgctgtaactgaccagataccttcaacatgtgttcctgatacctccatttcctagcagatcgatataatcccttaaatgtttcacgtaacatagctcgttagtcccgctcaccttaaaatacttcgagtaataattccttaatagaatatttgattattggtcgtgttgatgtactcgattttttttatattggcatggacagaaaagccctccattatagatgctgaccgctttaggctgcgttccccggcacgtaaaacgaagcatgtattattgcataattaatctgagggctctagcccaagggatacggttgcaacagaatattttaagttactctcccttttcctttcctctgtccacgtgtgctttctctcccttttcctttcctctgtccacgtgtgctttcctagtacctggtacctgatacatggtaccggtcggtatctggtacctggtacctttgataccaactaggtatcgaccgatacctgatgcccggtacccaagataccgggtggtacctaggtatcagaccttggtaccaaggtatcaagcctgatacttgtgcggtatcagagggtaccgtcaaaaagaggaggatacgtgggggagggagcgccgcaacggcggaggatggcatcgaggaggcacggcgaggtgagggacgtgtgctcccctagtacctggtaccttaggtaccggttggtacctgctacctggtacctttggtaccgactaggtatcgaccgatacctgatgcccggtacctaaggtaccgggtggtaccaaggtatcaagcctgatacttgtggggtatcagagggcactgtcaaaaagaggaggagacgtgggggatggagggctgcaacggtggaggatggcgttgaggaggcacgacgaggtgaggggcgaggcccgagccagagagcgcgagaagtctcgaggaggagccgaggtggatgttgacggccatacctgttgcaggtcgatgtgggctgccggcgtccatcccggaggcgcaaaagtggcaggctgcagcggggacgacggtgacgccgaggctgaggacgaggacgaggacgaggggagctcctgcttctgccctccccggggcgacgactccccggcacacacccgaccgacgagggtggcgagccagcgcaacgaggggaggcgagctcgagggcgaccccgccgtgggttggctgacctcgccaacgcagtgccgtcatcgtcctcctcggcagccggagatgacgacgatgaccccttcctcccggccggcttcgtctccgctcggccttcttcagagagagagagagagagggggggggagagggagagggagggctgcaattctgtgtgatttgggggaggagagtgaggtaggaggagaggattcggatgattttggggagaggagtgaggtaggaggagaggatcctgtcttcatgggataccgtggtgtaggttttctgttaattaaatattaactattttttgaaaaaagattaatatgtttttttaaaatagttttgtacagaaatttttttttaaaaaaaacactgtttagaagtttgaaaagcatgcgcacggaaaacgagaaaggtgaattgtgaaaactgggggaagaacacagcgtccatggtgtgtggggtgcggttaaagcccatcacggatgaccgtcctccatggtgtgctccatcatcggcagccggcaatttgcatagagtgccacaatctccaagtctgagaaaatggattatatttgttgcttttttttcttttgtttcatgattttgaatgaaattttggtccaattcaaaatttagtttgaaaccctttgacaaatttctccaagatttcactatctcggacctggacgttttgtttttagaacaatagtgttatctagggttaaaaattccaaaatttcggttctatcagaccacccccccgtatggtattattgcagccggttttctttttttacgaatttggcaatatttttgttcaaatttaaccaaattttgttcaaaattcaaataatttcggtatatcggcgccaccaatacaaatgccgaaaaaaaaatattgaacccggtgttatccacggtgaacagaatgatctttttaatttcagcaaataaccagcttgtgcaaccgcaattctctcttgggcagccgtcgtgggatcagacctcacacagtcacattgtcgcacacatggaacgacacctcttctgctcaaattggtgcttgggacatcccgaaacacatgaaaactctgatgcagtgtctcgtttttcgcctctcactgtcactgggttggccagcagcctgcgcgctgctacgggtcatggaaatctgatggctccgacaggtaagattggtgccatccctcgacagattcgtgagctcatcttgggcatggcactcgagaccccgccttgagtccccactctgaccaaattctgttgacaaatgggaagggagagcacatagcaatctcccaatgcttcccatgcttacattcagcacgaccaaaagagaagaaaaaaaaggaatacttggtttatgagaattgtgagatgtgaataaagtattgtaatctagaacgaatggcaggaatggtgagatgcctataggtatcatattcgcatacatatgtgtatatataactcaatgtgtttatgatatctaacccaaaatattcggtccagtaaatgaccaccttgaaagctgcaaatattcaaccacttgtactttctgcactttataactatattttgtgtattggagtgtggaaaagaaaaggcataagagacatgggcccattaactgagacactcaaactaagcgtttgtgtaagtcacaaaagagcatagggtactactctgtttacatggagaatgaattactgaagattttgtcaaacagttatgcatatcaaattgattgacaacaacagaaccaaacacatcctgagaacaaatatttccagttccatctaatccagatcttggcttcttgttgtgtcttatttcgtggaggaagggaaagaccccaaatccaagtgctgagacctctcatgtactgctatcatgtagggagtagcatacaatttacagatactgttgtgttccaagaaggaaaaatttattgtaccttcctcttcctgtcatactatatactgtactgtagttaccactaattaatcctaatatgtttagtcaatgttactctctccgtttcacaatataagtcattctaacatttcccacattcatattgatgttaatgaatctagacatatatatatatatatctagattaattaacgttaatatgaatgtgaaaaatgctagaatgacttacgttatgaaacggaggaagtataaaatttctccaaacatgcttgccaccacaccagcctgcttgctacaaactatctgtaatccttttgttttttctttttttttactaatggatattgccttgcttcaatataaagcaaatttgagggaccgcctattgatcatgtcaaacaattaattcataccttggtcgttgatgaattggccaaacaacctaagttcttccggaaagacatggctatatccagagtggtactattttccaaattaaaactggaacaggagttcatgcctattcaccatgatatatacacaagcataaactatccaccaaccatccgaggacagtatggaaagtataatccgaacatattaataggtgaaattcgaatcaaatatttaacattcctagcgtcaaatcgtgtaccagatctcatccaaacattacatcctgaatgcctcaaatgcatatagtttcctagacatagaattttagactatataagtccatgtttggcacaggtccagatctcagatccacaatagatttgaaatttgtgcgttgaattatagtggttcaaaatttcaaatttcatccaaaataagaacaaaacgatttatccaaatgttatcaccgtaaccgtagatctagattcttggatttgtggagttaggaatacattggattcagagctgtgtcagaggggtctaagaattcaggaaaagcaacctcagtggtgactgcaggtgacatgcatccaccatgcaagatggagttgaagttctctgttattcttcgagacactgaaagcacgcttagtcgaagcgaaataagccaatgcgggctagccacagcttggtgctgcgagtgtcgaaagatcggtgttgcgccctgttagcacatgaaaccttgactctcgctcagagttctcggtgcctcccttttctagctactgtgtgacttcgcgcgcgtgtactgtctacctacattagatgcatgatggtattaggtgtcctcatcttcacattctttgctgatttttcatgcaccttctactggagagatagagaaacttgttattccgaagccttagctagatgagaggaatgtggtggtttattgatcgcgcgaggaataatgagtacatctatggcatgtgctatatcgatatgaccttccgcatgtatatacatttggctcgtagtttggtcgttgtgctaatgttaaaatcagaactagaccagctgggcggtgaggtacaaattaaaacgttatattgatactgttttgatgacggcacatggcgattgatagcaacgggatgcccgatattccgttaggtaaagataactctcgatttggtggaaacttgaaacatatgatctgaaccctacaatcgtagaatcacgtttcctctggttattaactatgccgaaacttgattgacctcgccgagaaggctaatccctacgtgcgaatcgaaaaacacaagaaaaacaagatggattgcaactcaatttgcagataaatgattgagttatcaaagatagggttccacataccgaacttgtggccaaactgcaatgatagaaataagggataagtccattttgcaccctccaactcttcgcttagtctaaaatacaccctcaaacttcaaaaccaggtatttagcatccttgaactttttttttcttgacttaaggcatacctgaactttcaacacccattcattttaccccctcgagtggttttcagctggtattcacctgtgtggcgctgatgtggtggtctaatcagcaaataaaaacaaaaataagggatagacatctcttcttcttcctccatcttccatcccctttctctccttcctctttctctctctatccttcttcctcctacgctagaagagcagcagtggtggcgtccctgttaacatccctgagctcgacgaggagagcagtggcggtggaccaaggggttcattgcgaaggtgggaggtttttccttgtacgccattaagaaaaatggtgtctgcctctgtgccactaaaaaattcgagcccccctctataccatcgtcaaactttatcgtctcctccacaccattccgtcgctattctgtttcggtttaaccatttggcagctctgacatgtgggcctgggaaggaaaaatatcaatcttgccctttcactctctcttctccctcgattccctttttctccctcaggccgccaccacgcagggcctaccggcggccggccaccgcccagccctcggtctggtcgtcgtcgtcgtcgtgatcctcgtcgtcggtgcgctgttccccatcctcggcccgaccggctcctccagcttcgccatgccgcggatccggtggagttcaacgaacccatccacgttgcggtggcggctccacctcagccaccgacgcagatgcaagctggcgtcaacatgagcagcaaggaggacagtggcctcccgccgacaacctccgccttcgccctgacggcgcgcttgtcgtgctccacgtcccgccgccgcagagcatcgccgcggggctcaaccctggacccatccccttcggcggcccgagtaagcaatctctcgcactcgtcttcacggaaataggacggacacttggtcctgtggctcctggatggcttcctggatgtgccgcatggctgatcaggcgaggtcggtggcatcactagtagcaagcatcaatagtcctcgccaccgtcgttgtgctggtcctggcatcactagtagcaagcatcaacagtcatcaacaccactagcaagcatcaatagtcctcgccgtcgtcgttgtgctggtcgtcgtcgtcgtcgtcgtcgcggcgctgccgcccccccatcgcgcagcactgccgccgccgccgttgtcgcagcgccgcccccctcttcgtcgtcgtcgtcatcgcaacgttgttgccgccgtcttcgtcgcgcagcaatgccaccaccatcgtcgtcgcagcgccgccctgtcatcgtcgtcgcagcgccgccctgtcatcgtcgtcgcagcgccccgtcgctgtcacagcgccgccgtcatctcccctcccgctcctttgctgctgctgctgcatctaaggggagagaggagagtgctacgagagagcatattggaccaaagggcaactaagtcatttggctgcgccgttacccaccgttataaccaaaaacgaacggaatggtatggagtgcgcgataaagatcgacgatggtagagagggaggctcgaactatttagtttcatagaggcagacaccatctttcttaatggtatacaggaaaaaacctccgacaatggagccggagctcaagctcctccccgaccctgagttcccacgtgcgtggctctggcgatgtacacctctttggcgtggtcgacgcattaggacccctctgtcattggctggtgcccccaatgcagtggaaggacttagctcgagcggggcagtcgggtagtggcacaactcgcggacgccaacctcattctagatctggcaatggaagtggtgtgggcgacgacgagctcacggatgccaatgccaaatttgttggcgagctccatccatggagccactctccccctcccccccaaccctgaatgcccgaagctccacacccttccgttgccggtaacaccgctcaacaagctcgagttgaaggcggggacgatgcaggccgctccaagcgagctcacggtggggtcgatccacatccatcaaccctcgtcggagcttgccagcgaccccatcttctttgtaatcggcaacccctcttctccaacctcggcaaagggggcgggctccgatacgcattgagctcgccatcaacctccctcttctccacatcaatctcaccgccgacctccctcttctctcaagcacagcgagatctccatggccgcctcaagctcggtgagagagggagtcgaaagagcaagggaggtgaaaaaaacattatgataggtagggcctgctaacattgcatcctggagtataaccgaggtaaaaacaactctagggtgtacagtgaacgatattgaaagttggagggcgtaaaatatccggttttagagttttaggtgtattttagataaaatgaagagttggagggtgtaaaatggacttatccctagaaataatctaagtgaaacccgactctaaatgatgacggctatggaataaatatgattagggacgtccaaaggttagccctagggtgctacccccttgggttttgtccatgacacgattacaagtccaaagacccaaatcagactcggactggattaggtatgtgacttgttttacataattccgatagctaaggaggaattttaacgtgggaccaaaagcatatgaaagtagactcaataagctttccaacaaatacttatggtcccaaaagttcttctggattagcagctatgtccgtttaagggtaatgctgtcaggagtacataatcctaatccagtatatgcataacttaatctcttaccttctatggacaaaaaaatcacttaatctcttaccttctatggataaaaaatgacgtggtaatattggagtagacttgggcaagatcttggtttagccctaatcaacttctttgactatccatatatattccttgtgttcagtctctatcccttaaccaaacaagtctggaaatgagaacacacaaaacttacagtacaataatgcttattcaaatatactagccatattagtcgcgctttgcgcgactttttacatacccgtataaatgctctgtacatataaactgttacatacgctgatggtatggagcaaagcagttagaagcttccccatggttaagcagcctaagaacatattagtctcaattttttttgtactgttcgatgcacgagatgtcatgctttttaaatatttggtttgcagatctcattggatagtgaaataacagggtgattacaacgggtaaagtctctgtgtatctccggtttttatccaatctggtattgttttgtgctgacgaaattcctgtccggttcttcagagtgctgaactgcagtaaaatgtctctattgtgacttgtattgatgtctactactcttctatacaaaaatagcaataccaacattgtaaaagaagtaccttctctattttgtcatcgtgaatagatatcatgtaggcaattgtcaggaaaaataattgagctgcacctatttaatgcccaatgatctgaatgatcaattttgagttagtgagaaaattttcgatgattcaatgaaatattattgttagaaatatcaagaaaggatggcatataatctgccctcgttgtctctgtcacatccgtgctaattcaatgttgagtagtgcagtaagcacgtccacggaggttcagaaaaggttgattaccttattatgtagtttgaaaattgctttattgctctgctgcaaccatcctgcaatttgtatgcccaacaattacattggaaacactgacttttaacaatacatggtgagatggaacctctgcagcttatagcgcctgaaataaaaaggtgaagtatttagtacttctatcacaaacaacttgaatgagggattcataacctgcatgatagctctggatttccactaagatgcatgtctccattcacaacatgagttagaaaagaaaattggacaattcgactcactgtgatacacaccatgtctttgattttcttaaaagaatatcactttgcctatatccaccaaactccaggaacacttcacatggcttctctgcaaaaacatgcaatctgaggtggatatataagaagtgtaatcagctattaccttggcccaggaccaggtatatacgtacaactgctaccagtgtgttcatgctgtagattgccctgaaaaggattatgcatgagagagaaattatgtaaacaaaattaggtggttaacaccatgattttataagtaataaaccaattgcagaaacactaaaagacaataggagaagatgcttagtagattcgaactaaaagaccatttatgctctggaagggaaggggcataggaaataaagaataatggcatatcaagcaaagtagcaaactatcctgttaagtataaataatgtcatactctcaatatagaggcttcaactatccatgatccgccaaaaaaaaaacaaaccttctcctaatgcattgtatccattggttaattctggatatggcttcagctttgttcaaaagatctacaaatgacagccattactggctacaatgaatttgctgcttcctaatgaaattattgatacaaaaaattacatacatcaaatatattgcaatcattttgacccatgctcaagctttgcagagaaactcacgaattacataagtaggggttaacattgtgacactaactcactctgatgcaagaataatcctattaaaaattcggatgactatatgaaatcaaaattaaacaacacattttcctattttttatagaatttcccttctattgtctacacaaaggttcggacaccttcatccgaaacagacactaatcaggacaaactcatggtgatattcagaagtagcaagttgcaattgttgatgcttcagctgaacataagcatccatattacaaatccaaatactactacctggtagttcctcaactgtactcaaattacttaatggtaatctacaatcgtctctggccactatcggatctgaagcattgttcgccacaccggcgttttgggtcttcttgagccggctccatcactacctccctctggtgttgccagctccaagccactaggagacatacccatggaggaggagctggagagcggccaggagggaatgaatcgacgcagtggcattttggatggaaaggacaggaggtgtggccgccgccggaataggggatcgatggaggatactgtgcagcagtacagatgaagagggggccagcggtggtgatggggtcttggagaggagtcgatgaggcagcggcagcggcgggtggctccaaggtcgacaacgacgatgagtgcgagacggcgccgcgagtgcgagaagacagagcgtcagggtgggtgcctcacggtgtgggaggaggaagggtgaaaatgaaaaacaaaagagttataaggatgtgtaaggactagaaatagataggagtttcctcaagggcctagaatatactatgccaattataggatccaacgaccaccaacgtctagagtaagaatcgaacggcccttattactttgatgacgtggcgcaatatggtgacaaaaaactttacttttttcactactttagataacacgtaagtctcacgtagaacatatacatttttatttttgatatgtaagctagccatgttctcatcagcgattttattttgtttaactataaatgaggtatgatgggtctgaacgtgttggtcacccacaaccttgtccctcgccctacacatacatgtgtttttatttacctagatgtgtttttatgtttgtctagatttgaatttcttaaatatttttatggatcgaccgaaccacatttctttactataaattggaacatgtttttggcacaaggggaaaactaaatacttggatgttgatctatcggttaaaaaaatgtaactgaactgcagaagaacttgccactcgtgctgtgagttgttcctcttgctaatgtagaaatgatcgctaatgttcctgtggtattctataaaatatatttttcgtcctgctcatggaggacagagatcacaaaacattttaaggagaatcaattgttatcctaatatgatgattacacagtcttgagtagattgtgttatgtttctgagaactttcaatattagtatatatacatggcaaattggcaagacaaaaaagtttctccaagcacagtccttgtggttagaaaatttctcatagcatctgttttgccgctacgtactcatctgctgttacaaccattcagttcttggctgatgtagcattgaacttatttcttccaatttggttgacagaaagacacatgttggacaacggtgtattcatagctacattgccgtgccattgtaacgtgtactctgaacataactagtgcacggcaatgtagtcctggaacaatcaaatctctcgttgggccaactaaggctgacatatgactaatcaaaattaacaaatgcagtatgaatgaccgcaaatttcccatgattgtaattgttcgagttgcatgatgcagttttgtcggctaatccggttaactgatatcatattaaataaaaatgacgctccttaattagtgatctactatcctgtccctactggcaagacttaattaattatcacgcaccatgaatcatgtagttttagcttctgttgtgttttggaacctctatgtatatagaggcatcgcctgaacacgaaagggcatgtagcttagtggttgtagtgtcctgagtagtattctaaggttttaagtttaaatcttcatagtagcaaatttcagatggggctaagttcccaattttgaatgactgcatatatatatatatatatatatatatatatatatatatatatatatatatatatatatatatgtagaggccgtgtaggcatatattctctaaaaaaaataaaaataaaaaggtaaaaaaccctctaaaaattaaaaaaaggcatcggtcctgagtttaaatggctgcatatattcggttcgatgtagagaccaggtaaaaaatacccttctctaaaaataataaaaaaaaggcaaaatggctttctctaaaaataataaaaaaagaggcatcggtcatgagttcaaatctgtatagtagttgcatttatccggttggatacggagaccggctaaaaaatattcttctctaaaaaaataaataaataaaaggcatcggtcctaaattagccttcactaaaaacaagcacgggacttgagttcaaatctccatagtaatgaatatacacagccaaattatgtaccacttacttgtggtcaggtcttggaagtcagttgttgcgctttttttttcctccattgttagggtgaaattttttgcatgtttcacatatgcacgtgctgtgtccttttcataaccagaataggtttctaataagaataaccatgggctaactgaacacaaattctcaagcttgaatatccttatttttatgtgaatccctagtgcctccatttcctattgaaatactctagaaaacgtcacttttaatttcttgttcaaaagataaatagtatttcctcatagtgtatagcgtgactggcttaggatgctctatatcgtgcgagatatcggatgcctctggtatttatcacggctctcaaattcagacataactactccatgatgatagtacatgcttttcagaggtcaaatttctagtcaaccaagagtggagtgtctaagtaaatggactgagaatgactgcaaattttttctactattgtaatgcatttgcatgaggcagaccaacccagtactgaacttatgtgtgctaacagatcttgaacggtttcgttacaaatcattttcatgaaaaatccacaaagctctcctcaaagcccagtaccaaaatgtacctataactactacctctgtcccaaattagtagtcacttctgtcccaaattagtagtcgctttgacttttttctggtaacgtttgaccattcatcttatttgaaagtttagtgtaaatataaaaacagagaagttatatttaagtatttttgacaataaagcaaatcaaaaaataataattccataattttttgaataagacgaaagatcacaagttacaagcaaaaactcaaagcgacaagtattctaggacggaggtagtacctcacattaattccattttcgtagtgcttcttcttacatactactagtacctttgttctagaatacttgtctctttaggatttaaattttgtcgtactacttgtcccatcaatcattttctactcaaaaattttcttattttaccctcaataaccatttcacttctcatacattatttaacaaggggtattatagacttttgtattaaaccttaatctatcctaaacaaactagaatgacaattattatgggacgtagggagtaattgtaaagttgtagaaaaaccatatcacaaatgtcaacaatatgtgatgtcacaacaataggtttttttttagagaagggtaaatttacatggtctctacatttaaccggatatatacagcctatatttattttaagagaaagctaatttttacctggtctctatctaactgtttatatacatcattctttaattgggaatttagcacatcaaacagggaacttagccctcaaataacccaatttgaaaatcgctcctacttaggaccttgggtgctactcaggtcactacaactattagactatatgccctttcacggagtaggtattactgatggacctaatcactgtctaattcatagcatttctggacccagtcttctctcctcctatgaatatgtttttcatgttcctcttccactcagatttctctcacaattgtcgctctaaccacccatcgcaatgccattaccatactctcaaccaaaacttgggaggccatgtctgtgggattgccaccaaacattcgagccttgtagcaagggtctaagtttttagcctataacatgtaagtgctgactttacaacggattgggcagaaatgtagtagtttttttttaaaaataaaaatatttaagagttgatgtgggttatgaaaaaaaaatccatgggccttggcccattactaccctactggccttcctagatcagctggattaattggatgaaagggtttgcgaacggaaaagtacgaattacccctcccccaccccgaactattgcggtcatccgaattacccccaaaccacaaaaccggacattcttcacccccaactatacaaaccggacgaattacccccctcgacccaatccgtggtggttttgtcctacgtggcgtacgcgtggcagtctaatcagcattctatttattaaaaaatgagggacccacctgtcatacactcatactctctctctctcaggaggggcggttgggcgccggtgtccagcgagatcgagggtgggcgggaggcagcagccgtggacgagctagccggcggcggcgggtgacgcataggaggcggcggcggcggaggatgaggaggcggccgcttggcgcagctttcccccctccctctcggcgtcgtgcgggcggagcggtggccgagtcgcggcagccgcggacgagctggccggcggtggaggtgggggcgccgtcagagcggtgcggcggagggggcctcgacgccggccgtcccgccgccctcgtccttcccgcgcgcacgccgctgagagggagggggagtgtgcgggcggagcggtggccaagtcgcggcagccgcagatgagctgccccgcggtggaggtgggggcaccgtcagagcggcacggcagagggggcctcgacgctggccgtctcgccgcccttgtcctctctgcgcgcacgctgc

SEQ ID NO: 81963 - DNA, 32128 bp, Oryza sativa
gcacgcaaaaataagcttatttttacaggcagacctctcaagagaccgcatgcaaaaatagattttcgcatgcaggcatcttaagagcaccgcacgcaaaaataccctcccccctcaggcatttttccctctcaaccacttcaaaaatttctatcttatcctctccaactactcatccttatcctcatttcttctatctctctcatctctcatgggcggcagcggagcggcctcgcactcccccggtggcggccgggagcggtggcgggcggcggaagcgcaacctcgcgtgcaagctgcgaccgggaccggcagcagcgcggcctctcacacgctccctggtggcagcgcccctcgctcgcccggatctagaggcggcgcccctctcctgcccggatccggctgtgggcgccggcggcgacgcagccgggagcggcggtgggctcgggagccggccgcggcggccgatcgcggcggaagtgtggcgacgctgacaacgacgatgacggatgacggcgatgacgatgacggcggatgacgacggcgacgatgacgacaaccacgaggagggcgtcagcttgggttagggtttgaatattatttttttggggttttttttcgtgcgggtgacataagccaccctgattttcgcgtgcgggtgcatcgcccgcacgaaaaaaaatcagatttttgcagacactttggtgcagacaggcaggagatccgcatgcgaaaacccttttcgactgcacggaaaaattgttttcgtagtagtgaaaaattcaaccccactccgaagccatacaacaactcacaaattgcaatcgggttcaatgtggtctgccaatccagatgactagattgtgataaatctagggttaaggcttcatagaagatagaactgattcatatgctcaagtgaagtattgttcattgcttgagtagataaaagttccaaggacatgattttcagtgaactggatggagaaaactattgcacatgtaagatcaatatattgctgaaacagaaaagatctatcggacatgctggcaggtaccaatgtactatgaataaaccatcctagcgagtacttatcttgttaacatgttatatgtatactaatatatgtatagtgccagctcattgaactcaaatacaacaactatcgtttgacatttatcatgaataccttcaatgtgatcttccctcagctagaatgaagttttctttcgctctcatgaagttactctactaatgagatgtatatggttgacaacttggcatgcattttccagtttcacaacaatatgttcattatttaaggtccgcttgcaaccttataagggctctcgtatagaaaaaaagtcatttttatagtagtgtcataaccggggagaaatatatactactaacactataccaaaatataacaacttttagccgtgaatctatagataagtatttgtacggatttgtagctaagacttatttaattttagaatggagaaagtacctctgtatttaaatatacaatgtcctaggtattatttgtctttggcatacaattttaaccactacatgtattattagaacatggcgataatatccaacaaaactatatattatagaagtatttataaaaaaaattgaccaaaaatgacttatatgtttgcaagctaaagattttgagagctattgaaggtaaaaattgtaaaattttgaccaaataaagttaatagtgttatattttaaatatggaggggtactttcttttatatcgttaatttttcacaacgatgatcatgaactcttctattttgatctttggaccataaggaataattactccttccaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattaagcatctagggcgagcgactgaagaaagagctcatgcagtacatcatgtacagaagctccagcccaataccataagctacactcataagagctcctccactgcaatgataacacaatcacacccatcaacaatttcttaaaaggtaaggcacacacataagaaaaagcatgaactagaacatgaaattaccttccagactaagggaggaagagaaaaccaacctaggatacaatgttaatgtggcacctctgcatttcttgatgtgtcccagtcctagtcctgtatgtctatcagttctctttctcattgcaagttaatccaatttttaggtatcacaaaaaataagcttggaaggtgcacactagctattaagccaacatatatatgcacaaaatttccatctcttccttccctcaagtaagctgatttcttttttttttctgaaatcctaagcaagcatctcctttcttcttccttataaagagtgagcactgaattaatttggttgcatctattaggtcaagcagtagaaaagatgcagcacatggtttgtaattgagtgcagactacactgagccaagataagcatttagtgtcagaaaactccatatgaggtctacaacgattccaacattttgatcatactataaaccatttacatttgttaaattgtgacaacgaaaagggaaaaaaaagagaagaacgtggccatgcatgcacggtaacaaactgggaagcattatcggagaactgacacacatatgacttggtgagactattggtattagtttttattataaatcaacaccaatgagtgcgttagatgccgattcttaatttgatcccgtcaaaagggatcatctgtgtgagaaacctttcataggtgtcggttttaagtaaactggcacatatgagggcgttacagatgtggtgttcaggctatcacaatgcttgcacctatttcttgatgtgtcccactcccactcctacttctccatatttatctctactatatttgtactgcaaaataaaccaacatatatgtgccaggaatcacgactgttctattcatcaattacccaaagtggtaagttagacactgtcacattgcaaagttcacatgtaaaggtatggcttataagggagacgaggtgcttgctatggattccagagcttacatgagggaaggtagagatgggacagaatggcatatatgaacatgtgtaatcttaatatctagtgtgcacaagttaacctccaagttcattttgtgatcgctcaaaaaaatggtttattttgcaatgccaaagagaaccgatggagatggtattaggattgggacgcatcgagaaatgccgaggtgcaaatattaatattgtagtctaatgtggtttcctcttccttaatttgacaatctggaaggttatttttcctattctaattcaatgtgtttcttatttataccatttttgaagtagctgatggacttgtgtttgtattttagttaacaggaacggaatgatcctgttgtgaagttctacaattccggaatccagggcgtgaatgaagttcttcgctttcacttcaacgtgaatgaagagatcggtttattaaggataggggaaatgatacgtttttttccattaatcctcaaattaaatgtggactatttagtacaatatttttctcaaaatgaagaaaaataaagagcaaatattgaaacttgagctgataaactgaaaaaaaaacatcaattaagtaaaaagccatcttattcagcttgaaaaatatcgcgattatctgaagatcacataaatgaatagccgaatcaatccgtgaatacttttttaggtgaaatgcatatcataatttatgtttcatttagggaaaaaaactgattaaagagtagtcaaacagaaaaaacctctcagattaattaagttatgcagtcaatgaaccattttaagtaatcaagtcccgagtatttgttgccttcatccaactattctgctcattgacatgaaagggcaatagctcagtaattagcaagcacatgtccagccatcagctgttgcaacctaaataatacagctggtgactaatcaagtgaaatacattccactaattccacctgaagaaaattctcaactgggggatctgccatgtgactatggaaaaggaggaggggagaggaaaagggaagatgagatacaatagctgatttcacatcatccggtctaattgagtaactgattttaaggagagggaagacttgaactcacaactttaaccacacaatcttgctcacctttgacaatccttagttccttacaaggactttgcaatcatcatatggtagtgatatagtactaagcattgcaagacttggaacatgaggtgttgctgtatttacaagggatcagggattcgaactcgagacctatagatacttttgcgagattttagacaatgcttgctgcttccaattgcctgcacattgtttcctcaaatttcagaattcgatgcgatgttttgttgcctgacgcgtcctcagtctgtcatgcaattgaacgaccgctcctgctgctctactgttaaataaaactcgtccaaggaccaaacccatgaatgaatctgaatacctgatgctaatcttttttatatcactatggtctttttcttttgtcgtcaccatttaacagatgtagtaatatatagtttccacagtacgattaaattaaatggagtcgctgtagacttcactatgaacttattctgatactaaatgtagatcttggctcagtgcacggtcaactgaattcccagctctttctaaggagaaaggagatgctaaggatttcagaggaaaaaaaaccagcttacttgagagaaggtaaagataggagggttcaaaattttggaccggaatttcagaaatttttgaaatttcagatctatcagacccacctgatacgaaattattttggccaatgttttgggttttctcaaacttttgtgaatttggcaaaagttagtcgaatttggacaaatcttgttaaaaaaatttaaattattttggatcgagatttctaaatttcggctatatcagtacctccgatagaactactgaattgaaaaattgaaccctgatgggacaaaatgacacatatgagtatatgttagcttaatatatatagccagtgggcacaaacttcccagttatattccgcacgaagaaaaacttccctgttcattttgtgatccctcgaaaattgggtttagttcttcaattcaaaagagaagaggtggacgtagaacgaataggattgggatgcatcgagaaatgcagagttgcaaacatggacattgcggcatggaaatttcctgttctaattattgcatgttatttcttatgtgcgctagaagcaccatttcgcgaagtagatgacgcattactttggatgtctttgtgcttatgttgcagaaaaggtgctggtctggtctggttacaaagttctattataccagaaaaacgttcaggacaggaatgaagttcttcacttcagctttaccatgctgttttccagtatgatctttacatccattcatcaagcatactgtgttggacttttcatgtatcttttctcaaaattaagaagaattaacagtagacatgaaatctgagctgatgaataggctttgtagaagtaaacattttctcattccacctgaaaaatgttttaagatagcaaaaatgtgtaacccaaagaatcaatttaatgcattttcctaagcgatgcacatgataatttatgtttctccttcatccaattattctgtttattagcaatatgacacgattagattggctcattagtaagcaccatgctgttgcaaccaaaatacagttggtgactaatcaagtgaaacactacacttcttaatcgtgataactgaaggatactctctccatttcatatcatgtcgtttgatttttcttagtcaagtttgaccaaatttatagaaaaatatattagtattttcaacacaataaaatatattatcaaaaatatattcaatattagattttatgaaactagtttgatattttagatggtgctaaatttttccataaaattagtcaaacttgattagaaaaaagtcaaacgacttgtaatatgaaacagaggaggtattctttgagagatctccaaggactgaactcattggagggtaggtagacggaagacgaaaatatataccaatagttttattatagtatctgcgtaaataagttattccgtagcagctgattttaaggagaatgacatgaacccctaatatttaaacattatagtcttgcgcctctatggctatatgcctcccaaaactttgaaatcatcatacggtatagtgatggagcgatcgacgagccgacgagcattgcaaggttaggaacaggaggcgtttgggaacgtaccaaagcatgaaagtgaggatcttgaactggttgtgacaacacaagaggttctatcctgctagtccgtaatcatcatatgctagtttttgcttttcgatgtcccatttttcttcttttccacagtccctgcacatatttgatcctttgcgtgagttgtgaatgtgagaggcatccagtaaaacaacatctgccgaaaacacaagttctttcctctttttttttttaggaaattggagcggttgaaacacatttaaccattgtaatagcatattatgaacagatatctactggcccgtagataaaacccaatccaacactgaaatcaaccaaaatcttcatgctaatcacagttcccctgaacaccggaagtggggatttatgcacaatgctctggagcacatgaacaaaatattcagaattaagacatgaatgggaaaaaaaaagagatcaagatcatgatcatggacaattgtgctacatacatcatacatcatgttttgtttatcttagatggcctacaaaaatatgtaatacgattcctaggatattgccctgatttcacatactatgtgggatcagcttaagcaaacacatgctgtgatttctgtgcaactcttttagcatgctctctgaaaatatgaattctggtttttactgttggtggaagaattcagtaatcctatgaatgaatactatagtgagatacacatcatctaatcgcatcccgtaaattgattttttttttaaaaaaaagaaatttggaggctcaaaccggcccacaaaagtttgcacacaacaagagcccacactaggacagagagaaccacataaagtatggccgaagaaaaagttttaaacgtttcagaaaaaagaggtaagtttttaaggaaaagtatgaccaatagaattgatggaatttctcaatctgagtcctagatagattcatgtttaccaccaaaaagcacatggtggcaacatgttgcttttctctggggatgcagtttcatcattcaaatcataggccattgttttatttttctcgacgtaagaaaaattaataaaagaagaaacataatctccaaacaattgtgaaaggtactatatattcaaacaatataaatcatccaattgctctagacacagtgatcacaatagaagattaattattcttcccctactacaccactcttgacaatcttcctaccctattgcagaaacaagcatcctcgcattttgcacaaacaaattaaggggatggctacacacagatgaaaatgtactgcttttgagaaattaatatatttcgtggaataatcaacaattccacacaggatattaaaactggatcagatgcatgtatgttaatcttagaagatatcaatacagaagcatgtgcatctctatgaaaaacatttttttaataaaaggtaaataataaatatatgataaatcgacaaaataaatttctgggctagtcatgaattggcttagcccattactctctaatccacctataaaatggctttgcaatcgataaataacgtagccctcacgccgccgccatcgccggagtccgccgccgccgccgtacacttccgccggcggcaagggcaaccatgaagtttttgattccgccgccgctggttcggccgcctcctcctgacctctcctacatcaaccgatcgtaccgatctgtccgtcgacgagaagatcgagatgataatctaaggtgcgttaattcgttcattccttcgtttcaacgagatcgtacttacgtgccaatgcaagctgagatcgatcgatcgatctcagattcagttgccctcctaattaaaattaactagtagtaataactagtggggattttcttcttgctgttcttcagaaacatagtggtgcacctataccattcgaggagtcgcaaatccttgaatattacaagaaatttttggcccagtactctgactacgaggatgaggattcagaggaggattcagatgaggaggattcagaggagggggagaaaggcaagaagaatgtatgttaaaaggggggagatgtgattttatcacaactgtctgtctgagtgacagtttagaagaaatcagacgattggagtttagcgtctcccatttatctatcatttatcagttaatcggcgtatataagatgctatcaaattcatgagtaaatttcagaaaatctcaattattatggtcaaagtttcagaaaaccacgtgaactttgacatatggcacataacctcaggtattatggtcctaacatttcacaaagccacatcactaattgttttgacttgatttactaccttttaagttctacaatcacatcttaaatttatgagcattttattcctaactagaaaggtagcccgcgcacatgcgcgtgcaactaatttaatatgtgtgaaattttattacgaatatctatgtatgtgactttgtattaaaatattactttactatatataaattattatttaacttatttaatgtgctttcaacgtgggttatgattttcttctaattacccttgcagcacataaattctaaactaaaattacttaaaatcgtacagttttcactttatgagataatattatgtcgagacaatagatgtagttcctatgaaaaatttttgggtatttcaactacccatggggatatctttccccaaacatttgctcaaaaagtccaaatttttatcagattctattcgaaattttagatattttcgttctattagtcctgctaaaatatttgaatatttccatttagaatgggttttaaacccaacaattttttaaaacatttacataaattttgaattcttatcatgtccatttttaataaattggagaattccattctaccaagcatctttgaaatgatttgatctctgcaatttgggttataaatatatgtgggttaagcctacaacctgacatggggtaaaatcatctattctaattatctctctggaattgagtaagaatatgaaaatagaggtcatataataaatgcacatttctatattattctacagtaaatattatgaatttacgatgtagcatagcaagttttaccaaaaagaaataaatgaacatggtctttaattccatatggaattaactcactatattggtaatgccacctcagagttgtttcactgctaagatttcttggtgcatttcctcaaaaaaaaaaagatttcttggtgcaatccacatgtttggtactatcagttggatgttcaactgagcatgtttttttacttttaaaatgttgtctataaaaaattaacgctagatggagtacacattatgacataaaaattgttatcatttaaagatttttttctctaatttattagtgacttcatagattatatataattttatctcctaaaaatatcatttattgataaaagcaccaaaatcaaattgtataggcaaattaccccatatacatgttgagagaaattaattaagttgatagaaagttgttatgtgtctaatgggatacaagtaataggtctacaggctttattaaaaattaagatgtgatattttgatttataatgatgaattttcatttttgttttactaagtggatgcctcaagatggatgtgggtccggaatgtaatttttatgttaacatttaaatatactcaatatggatattaaagttgatttcactaagaaaatacaatagttcaaacaaatcataagttgaatatatgatttaaaagattatattattttatttatattgttcccataaatgttagtaagatgagaaagagaagaaaagggatcatgggagagctagctagacctgttatgtggaggtccatttgtggttttttcccatgaagataattttaatttcaattattataagaataaaaataagagaaaaggatgaacgatgcacaccatatagggataaggtgggcgagatgtttttcttaaataaattattgatatatttttttcaaaaaaataaaagattgatataatgactaaaataatgtgttggatgtttaatgtataaggctttaacattgttgggtgggggagagaggaaaggaggtttgtttctttttttaaataaaaatctcataacaacctaaattctatgcccatcgatttaagtcgaaaccaatgattagatgttttattcttaaatttttattatttactctatttacgaagtgttacagagtggtttacaaacatttataaggatggttaatgggttttaacgccacatatgaacgcgaggggagtttgggatgttttacgtaagaaaaagatatatataataacctaaaataatgtaaatcgatgaacgaatgttttatatctttttagattttctctaatttaggtgtcaaatagatgttcggtaatatttatatgatgtttaatagacttattaggatgggctagaggaagaatagatctagtagattgatggattttttaggcatgcatttttctaatttaattattatggaaataaaaaaacgaaaaaaaaatggaaacggagggatcgtacgtacgtacgttgctgatggattgatggaaagtacgtacattgcggaggcgtcggagggggattttattttaatgtaaaaataaatctaacggtcaaaattaatgagtccaccaatttaaatgaaaatcgatggttagatttttctattttattagagtgacatgtggcgtctcgagagcgtttataggatgccacatggcggcttaggagtgtttatagaacgtttaatggacttttagtatataatagatagaagatataaatattacatccgttttttctattttgatatagcagtatgttaaaatggttaacaatatgattttgtgaaactttaggatcataatacatggggttatggtgtcacgtgttaaaatacatgtggttttatgcaatttggatcataatagttagggtttaagaaaatttactccaaattcattcgtttgttcgttcattcattcaatgtgtattaattcaagtgttgggtgatgaaaaggaaccgggtatcgtgaagcgcccgccggaggcggctcctcttgaaggcgagcacgagtgcaagatggcaagaacagcaccaccgcaaggaggagaacataactcgtagtcccctctgtaggtaaaccctacctccgttttcccaatctgcaacgtgtatagatgcaatttatttaaatgatctacactaaatggttaaacaagcgtgtgtcttctctattggcttggcttgttcatcctaaaataacccctcaaatctagttttaaaattatcctgcctatgcctttgtttatggacaaataatagagcagtactgttgggttcttatttgaatgtactttgatatggccatggttgtgtggttgttagcattgtaccatctcaaataattagcagtactccgaactgtctgaataaaaggtcccagaactcgagttagctgaatagtagattttttacatgttggactctttaacagaaacaatggtgcagtttcatggtctttaaccaagaaattaggtgagggcaggaatgtagttaaagaggggaaaaacataaagtacgtgtttagtgtcaaatcgtttggttgcggacattttcttaacctgcaatgctcaattgcacaacttttgcaagtcattgcatcacttaagagtttatgcagtagtagaatattttttctgtgtgtttccaagttaagagtacatgctctataagtataaataaatgaatcaaatcatcattgtaatacagacaacaaacataaaaggccaccaaatgcattattgttccggtgatttctcctgagggagagggaagaaccattttttttttcgctcagaatcaagttcatagctgcagttctttgttaaatatgacctatatttatcttcatcgcatgatatggtgtttttgtttagagcaaatttcacaaaaccccatgtttagaggcaaatatatcaccaagccctagcatttttttgcccccacttaacggcaggcacacaaccaatatactgtaacagctaatccagttttttgacattacacatagacacatgggcactgagctggcagcacaatccttgcaggcttgaggcaatcttgtcctctaaacatggggctttgtaaaatttactcttgttaatcttttcatccatcgacttcaaaatgtttctatccaagcttcgtgcagttcctttttaacccagccttgaggtttcgaactgttgcttacatagatttggtttggtttgacaggatttgatgaagacaggagaatgcaacaggagacgaacttgtgacaattttctgcattacttgtgctccgttacgtttcagtggcaactgaataccgaaactcctattgggcgattgatcgccaggggccgccaggagcgatcggatcgggtctccccctccctctacctagttttcttttttggcaccacattactttcctattttagtaaatttatgcatctaaagtttatacacctcaagtttacacatctaaagtttaaagaccaaaagtttataagtcaaaagtttatatatccgattcaaatttgaatttgaattcaattttttttatatatagtatttctatatatctaaagtttatacacctaaagtttatagatccaaagtttataaatcaaaagtttacatacccgtttcaaatttgaatttaaattatatctgattcaaatttgaatttgaattcaaatattttctatatatagtatttttatgcatctaaagtttatacacctaaagtttatagacctaaagtttataagtcaaaagtttatatacccgattcaaatttgaatttgaattatatctgattcaaatttgaatttaaattcaaatagtttctatatatagtatttctatgcatctaaagtttatacacctaaagtttatagacccaaagtttataagtcaaaagtttacatacccgattcaaatttgaatttgaattcaaatatttttatatatatatagtgtttctatacataaattttttcaactttatttttttatttttttttaatttatagtgtagtaggaagagaagaaggggaggaggaaggaaggagaggtgtgtacagggggcgtggggatcgatcgcttgatcgatcgcccattagccacactgtaatcgtaatgttgggtaatagcaattgtgaatcttattaggtaaaccttttattaggtggatcttgaaccatatgctactgatgtcgtcgtttggttttcagttctcatgcaacttaattatggcacttgtaataatgtgttcatcaagcattattgtagctttattgctagcgttgcaaaaaagttctcatgaaacaaagagcgagcagatctgttcacgagtgtatgattggtgctgtagccagatggctaatataatcttaacaaatttcacttaaaattttccggtatttcagatgtcggtacgtacggatccttataatcgtattccttcgggttatcgagttactgaagacggccacagtttgaacccgagtgatttctgtgtgagctttctccgtcttttttttaaggaaaaacaacactagattgtactttttcgtgggagaaaaaatacaacccctatcgtgccaaaaaaaaaaaagctctttctccgtctattgtctcaaccaaatgttagttttgatttatatttaagtaaggagcttaagcttactgtgcatggtaattaacaaattttaccaacaatctattattatatacttaaaaattcattaaactttttacaaacttttctaagacatcatgtgatgtttctacatacatcctaaaccgccacgtaacattgtctaatcccactattgattttcacttaaattggtggacctattatttgacattattagattagatctatacatattatcaattttcacttatattactatcggtggacccatagatcattagattatgtaataccttcctcatatataagagaatatataccgctgaagggagaaaaaaaaacatatatacatacagtatgtatgatttggaaaaaaaacaataaagattaagtacagttcggtggaaaaaaaaacatgtccacatacataagataaaaaaaaagataaagccacgtgtaaaaaataaaaaaaataaagccaacggaaaaaaaatcgaaaatagaattttcgaccatatacgataaagtaaaagaacatataccataaaaaatgatgatatttataatataatttatatataaagataaatatattatttcataaatataggaagttaaactagatcgataatataaatatcaaatatcgaaccaatggtctataaacgttcacatttgaaaatatttttaaattatatatccaatttgtgatatttgttgtatacctttaattaaatgaactattgatgtattataaaatttatattattgatatttgtagtatgtcttatttgctagttccaaactactatgctcagtactattattaatgttaaaatattaaaaaatatataacatacgaaataaattgtttttcaaagtaatagcttatttttttaaaaaaaagggttcatttcaattagattgttaatattaattttagaaataaataaataaaattcttagttgagattttaatatggatataacttcatatttaaaattcattgtttttttaaaaagaaaaactaaagagctaatttacaatggcacaatatatttaacacgattagtatattctgtaggataaaagaatgatttaggatattatatttaacacgattttatattctttaggtataagggtttctatgttgcgataaatattcatgatcatatttgtttcagtttgtattcactctatgactatattcgataatatttgattatgtttcgaaatccaaaatagaaataaaaataaatatggtagataccttccatccgttacaaagccgttttcatccctaaccggggctccactgaccataggcctggatggcggttggtaggattgtggtggggtaactgaggcaccaacaagttaagttgcgagggacagaggatggcgacaaggaaggggactgtgcagcaagggaatgatagaagttcaggtaaccattatatatgggtctcatcgtgtgaaggaagatgaatattgggtcatcaggtaggcggccatgggactctcaagtcatggctcgagagtagaagagaatgaggaagggaaaaaggacaaaccgtgtgtgatcacgcgtttcacgcagcggcgcatgaattaaaatcccctggctcatgttgacatagtaactactactaactcaggaccaattttttaattaataataaataatattatttaaattaaattattagtaattagaggataacatttaccaaaataagatggacactaatagaaacagcgtccagatgtggacgctattaccattaacgtacagatgtggacgccaattggatcgacgtccaggttggtgcggtcataacctggcgctaatcatcgcgattagaaaaaagaaaaaagaaaaatcccccaacgctagggcagggtgcctctgccgccgtccaaatcgacgccgggagtctgccgccgccgccggcgtccgcctcaacctctggagtctgttcctccttctaactgagcgtagggactacccacgaggcaaatggcgcggcagcgctaaggcagggggctgccgccgccgccgccgccgtcgtccacctcgatgccgggagtccgccgtcgccgtccaccaccaccggaagaccacgccaccgcctgaatcgacttttgaagttctgagaggtggctgccgtcagccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttgggacacaatttatggatggtaattacaggagatggagaatcaagaaccggcttcacaacttctaaaaaaaaaagaaccggcttcaaaaatataacataggttcatcctgataagtctaatgtataatagagatctttataaaatatatgtcaactgcatcagagttgtcattggagttccaacttcggaactggaattacatttattcacacagtagaattgaaatactaatttagcttattgattgttaacattttgtgcagctaaaaaatggctgatagtgatcggttcagtgatttactatggatgcctcatgggcagcacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctcaacaaaatattagtttctatcaaattgcaaagatgaggagtatcaaaattgacaaatatttgatatctgctttggtagaacgttggcggcctgagacaaatagctttcatctaccgataggggagatgacaattactttgcaagatatcagttgcctttggggtttgccaatcagtggaaaactaattgtgggccaatctgatggaaattggaggatatgattgagaggtatcttgggattccaccagaagatcaagaaataaagaagaaaaagaggaaaaaggaagatgatacatttgcactgagttactcacgatactccataactctgagcaaattgcgtgatcactttcgtgtcatgcccagtaacccaacacaacgggagatcgattggcatagtcgagcacttgtcttagaaattcttggctccattatttttactgattcatctggagatagtgtgcctgcaatgtacctccaatttatggataatttagcgacccgcactgaatacaattggggaggagctgtacttgctatgttgtacaggcagttgaacaatggtgctgagaaggcaagatcaaaaatttttggccctctagtattgttacaattgtggtcatggtcacggttgccattaggtcgtccaaaaaatataattcaaaagacggatgaagtggaggagcaagaagaagaagaatcagatggctatcctatatttggggccaaatggtgtagttatcatgaattccccaccccacataattgtggtaatgttttacatatcttttgaattatgtctcattgtatattcttataacaaacaacatatatgtcaacatgcttatctttttatactaatattatacaggcactcaatactaccgaaaccaaattgacttgattcgagaaggtactgtacaatggcaaccatatgaaggtctcatagagcagatgcctatccaaattcagaatgaccgtacttggtggtttgctagactacctctcatccatttttgggttgtagagttccattatccagaaagggtaatgagacagtttggaagaaaacaattaattccaccatcgcctccacatggtgaggttgagcttcggaagctacgcaaagtgaagcatgtaggaggaaaagtgtgcgattggaataaattccatgccaaatatgtgcaacaatatgatgggattgaagcaacaatcgttcaagaggattgtcctttcgacgtagctagcttaaaggagtatagatgttggttccaagcaaatggtatgttcactatgttttttgattctcaatgcttgggaggacttgaaaactctatcccataccctcgagataacatggagtggactgggtacatgcctagtggtccacccctagctcgcattgtaagttatagatttcttccaattactctttatattgcagtgacaacctagatctgattttaactcataattgcagggattgcgtgagattaaaaatgcagcatggggaatcaaatgttgtataactaatggatgcaagaagataggtaaatctatattgatcacatgtcaggggaatattagggatcttaacttggaatacaaattgcaaaacatgttatctgaggctggactaccaattaaggttgaagaaattccatctgatgacgatggcactactgcttgcacgccaagtcctccaaatgaaagttccgttgatatatttgatgagtggatgatctcaggaaaatgttttagtagatatattgatctaggtgtggaaactactaatagagttcccacaacacaagatgcaagccaagtgactcaatgtttggaaaatgaagatctggtaaaattctaacacttgtgtgtatgcaaattaactttgtaatgtatttaatatatgatatactattgggtgacatgacaggtggcttcaagagaagcatcagctccattgcatcctggtgaaagaacgtcaagtcattcagaaagttctatccaagtggttgattggactagtactgagaggactcctatgttcaaaaagaacactccaagttaggaagaccatatattctgttggatataattttgtagaacttttggagctatatgttctaaatatatgttaactagaaatcagccactccaagttaggaagaccatatattcctgttgacatatatgttcttttcgaccactgtcttatatgggtgctatactatgtaaaatatggtcatgctgtcagtggttgaatggcgtgttactttactttgtactgacttactatattaatggatttttatgttgccaacttacatcccatttgaatgagcgcatgctatttacttcagtttattgccacgatatgtgtgtgttgtagggaacaaatccctgtttaaacatgtgctcagatacatcctacaaatagcagtacagcagcaattctgttgtgtaaatcaaatcatatgaaaaattgataaggtaattcaaattgaactgtctgtactctcaaataaatacttcaaaaacaacgttcgttgagctccattcatgttcaaagccaaccagaagaatgtcctattcctggacaactataagctaaattgacactgtaatttatagatagactacacgatgcgtaaaactatatggtgccagagggtccatcaacatgtgttctgctcgacgttgcacctacaaaacaatcaaagagagtcatatatcaagtaaaagttaactaaccattataatgcatataattcccattgtttgctacctaaattgtcactatctcttgtggaacggtgtgcctggtgtccaagtcgtcttccttgcatttcatccatgtacattggtatcctgttatgctgacgacggcctagatttatctgtctaggatcaggaacaattattggaccagtaaatggtggccattcaatttgatttccataaggaagaaattgtatagcccaggtactagcaagtgcttgagaagagtagaatggattgatcaactgattttcattaagatttctatgtttgcaaactgccaagacatgagcacatggaacacctgtcaaatttggcttttgacagtcacaagatggtgtgttgttgggttgcaaaactaccttatacttgaagtccctccatgtgtaaacctcatggtttccttgttgcattgggactaactcattgtcgacctttacctcatatattccaacttcatctccatacgagattacattcatatgtccagccttatttcctcgcttcactaatagcttatcaaccctttgagaccattgcttgccattgttaagtaaattaacagcatttcgccttctctcaacaaaccattctaagcactttgaaaatgtttcctccacaatggctgccaccggtaacctccgagaaaacttaaacacattgttcaatgactcagatccattgcttgtcatgattccccaacgatatcctccatccttgcattgaaataccttctcgagcttttcttgctcatctttatcttcatgcaagtactttccaacatttttaatatatgttattgcctcaggacaaatatttgcaattgatcacattccttcatcaaattttctaggtttctttttcttcactgtccacttaaatgtcttgagcattatttcattgcgacaaaatttccatagattctcagctacatgctgtgagcaaaggcggtgcacacattcaccggcgctctcattccatccaatgtggggctgcttaaacaaccatttcatggctttatgtcgatcagatataacacacataaactttccatagcctattacctcacttcgtagccatctcataaaccacccctagtttgcactatcttccttctccacaatagcaaatgcaagagatagtagttgattgttagcatcatatccacaagcaatcaacaatctatccttgtacctccctgacaaaaagcatgcatcaacacttataactggccgtaggtagggaatgacatcgatacaaggtccaaatgcccaagcaacacttttaaatgctcgccgtccttcctgagtcattggctttgacaaaaggacatactttgtacctaggtttttagcttttatagcctgtaagaaagggatgaggaggccatatgaaccttcccaactaccaaaaagttgtgctattgccttctctctgcctcgccataatttactataagatggcttcacatttctatatctctgttggactagtgacctcacattttttatactcaattccagatcatcccttaatgcatcacgtatcacattagcaatcatagaagatgataactgagcatgatcaaatctatcagccggtgctcaacaggtgtgagcatatggacatttccttatcatccaacctgaacctatctttgtgggagttgcatagagcctccacatgcagctattatccgtgcattcagctacaagtttagattgactacttgtgttgtacttgatttctgaatttttacatatatgaaactcacctatagcaatttgtaggtgcttttttgaatcaaaagactttccttctgctagtgggttagaaaattgattcttacgtccaaagaaactctcgtctgctgttgtctccctcaatatagatatatcactaaatgcttttataggattttgtccagatgcacgcataaaaggaaatgcattgacagaatgaacaactcgtggttctggtggctcatcatctaaactattatcaagggcaccatcacaatcctgctcgttgtcatcgtccagtccaaatctatcctcaccaacatatgtgtcttctgcagtattgtcatcatctatagttggttgtgttttggaaaccacattatcctggttgataggttatcctggttgataggtgaagacaactgaactgttgttgaatgcagaccatctactaaagtgggtacaacctttgcttgtgaatgaactgtacctggctccaacaaaacacctgagccatccctttccgaatgcctagttgatgcaaccaaggttgtactattaacctgacttaatcttgcttccgtataggcgcattcaacataaagctcaacaacctacccacatgtcttctcaaatatcatcctccatcccctgtcttcataaataggaatcaattgaaaatattgtggtccaggatttccgatatcaaaccgagcttggatattcattgcacaatgatcctcagtgtatccaagggcctgaaaaatttcttttttgacttcctcaaaggttgtagcctccactgccggaaaagttatttttggaggaatattatattctgcacccttagctccatattgtattctcccatcaacatacactagaacaataatcattttttctcagtcaaatctgcaaaacaaactaaacaagttagcaaaacaagttatataattaactttaagttagataataatctgctgatatatcctttcaagttttaaaaaatgttgttttgcatattaaaaatgtcaatgaacaatagtcattttatttcctggctgtgtcttccaaacgaactcaacaattaacaaaggcatggtatatgtctactagttggataataatctatacatatattcaataaaacactcatgtcatatatcaagtatagatatgaacaatgtagtacatatcaattaatgctaattagatgagggtgagcaaagacatgctataagtgaaaagacatgcatgcgtgatataaattgcagggcaaacctgttgctcacgacgagagagctgccaatgcacacggcgccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcaggatggtggtgatcatgcgggtaagcattcgcaatctaagaagcaagcaagagaagttaggagcttatggttcttccacacttagaattgaactatcatcattactttcacccttattttgttgggattctcctgatctatttttagatgttctcattgccgcctcctttgtttgcacacaccccaacaacaaccacaacgcgctatggcgcctcctatggatagcgcaatgtctctcacgagctcccccattgccgcccctttctcttcctccttccttccacctcaccccaaccccaaccccaaccctggccccgtcccgcgcgtacggaggaggggcccatgcatgcatgcgggtgaggtgacaaggacgcggccacggggatcaccggcgcaccgaccgggatgttgaaggtgaggtggttgccgttcaagaagacccatctcgcccgcagcaacgcctccgacgcgtcctcccccacctccgccgccgccgccaccgccaccgccgtcaccacccaccgcctctaccaagtctggaggggcaggaacgtacgttttcaaaaacgaattcggacaaaattcgtgcgtttccacattaaaaggagcccatatattttgttgttgttgttgtgtgtagagattcctgtgcggcgggcggctcatcttcggcccggacgccagctccatcgtgctcaccgtgtcgctcatcatgacgccgctcgcgctctttgtcgccttcgtctccttccacctcgccgccctcatcgggaagccgctcggccaggccgtcccggccgtcgccatcgccgtcggcgtattcgtaagcccggccaccaccatttctgcgtcgctcgagcaaaatgaagcaattgaccgatcactttgcgtgcatgcgtgcgtgaaggacgtgatcgtgctggtgatgacgtcggggcgggacccggggatcatcccgcggaacgtgcggccgccggagcccgaggacatcggcgtgtcgtcgccggcgttcggcggcggcgggtcgctcccgccgacgcgcgacgtgtacgtgaacggcgtggtggtgaaggtgaaatactgccacacctgcctcctctaccgcccccctcgctgctcccactgctccgtctgcaacaactgcgtcgatcgcttcgaccaccactgcccctgggtcggccagtgcatcggcaaggtaggccgtcttctccgtctccggcggcgaccatctccgacgtgctgaccaactgttcgatccattgcctcgcagaggaactacaggttcttcttcatgttcatctcgtcgacgacgttcctgtgcctgtacgtgttcgtcttctgctgggtgaacctggcgatgaccgcgaggcagttcggctgcagcatggggcgcgcggtggtggagtcgccggtgtcggggatcctcatcgtgtacacgttcgtgacggcgtggttcgtcggcggcctcaccgcgttccactcctacctcgtctgcaccaaccagaccacgtacgagaacttccgctacaggtaccaatgttttaaatagcgggctaaaacatttagcggttacttcttaaacagctatagcaggctaaattgagctatagcggctaatttgtactctctccgtattttaatgtatgatgccattgactttttgataaacgcttaatctttcgttttattaaaaaaaattatgtaattataatttattttattgtgacttaatttatcatcaaatattctttaagcataacataagtattttttatttgcataaaatttttgaataagttgagtggctaaacgttggttaaaaaatcaacggcgtcatatattaaaatatggagggagtacacgagagcaaatagctcgaatccttctcaaacagttatagcgggagataagcagcagtttagcgagagattttaaaccttgacaggtacgagcggaaggcgaacccgcacaaccgcggcgtcgccaagaacgtcgccgagatcttcctctcgccgatcccgccgagccggaacgacttccggtcaagggtcgccgtcgagcactactacgccgccggcgccggggcggcgtcggggcagtacttctactcctactcgatcgggccgctctcgtcggagtccaaggcggccagcttcaacacgcgggggagcctcagcttcgacatggccacggcgagcttcgacctcggcggcgtcggcgtcggcggcggcgtcggaggatactccgccaagcgcaccagcgtcgacgtctgctccaactcctccgacttcggcgacatctacggcggcgagcagcagccgccgcggcactccatcttcggcggcgacggcggaggagggaggacgagcgtcaggaaggccgacgacgtcccgacggagttcgggcactacggcgccgccgctgccgccgccgccggcggcggcggcggccggcctcgcgggagggagttcgaggccgtgtgacgtcgccgccgccgtcgtctccaagtgcgttggcgccattttcttgggagctcgacgatgcaacgcagctaattaatcgatcaattaatgtagcgaatttttctctgtttttttttggtgatcttgtgcttccgctgctcgtgtgttgtgtagtagctttggttgatcagcttcctcatgcttgctaatggagtagtggtttccatagcattctagtactacttgcttaacttgatttagtgaaggtgatgtatacacacacaaatgcacacacacatgggtttaattttgtgtaattaggactgtgcatatatataaacggtgttcatgagttatccaaacattatcttttggcatgtactatgtttcatattataagtcgttttgacttttgtcaaattcaaattattttaaatttaacttaagtttgtagataaatatagaaatatttacaacacttaattagttccgttaaattgaaataaatcaatagttgaatatatttttataatatatttatcttagattgaaaatgttactttttctataaatttgatcgaatttgaagtagtttgactttgacaaaagtcaaaacgacttataatctgaaatggaggaagtaatgtttctttagaatacaagaatttggcctttctacatctgattcctataaaaaaaatcctacaaaatacataaaaaattatgtgtaatgaggcgttgtggatggatggaagaaaatgagaacaaagaaggtgttgcctgacaaaaaaaattattcaactgtttcagtgggagagagaaatgagacattatgagtatgtcagctcctaagaacataattttgacacttctgttgacctaattagttggtagagatacataatcctgctatgccacttcaacttacatttaatctttttacatatcatgaaagaacatatagccaaaacaaggaacagcatgaacccagaaagttgcttcgctggattatgggctaaaatgaacaactaagagagttgctgcttgttgccttcacaatttggtatctgactgaatccaacgatcagcttgtccctttcataccacttgccccagaatggctattttactagcatgcagttcaacaagcaccccatatgcataaagtaacctgaggtgagggactgattaatgcatttagcgagaaagctcggcgctaattagccaactaacactatgttattgtagtgcacctacaatttcatactgatcatgatcaaccttgtaacagaaggaagcagagtgctactatctttagagcaccttgatgcaatgcgtgcagatccatcagcagcaaaacttgggaacctattagtcctcttgtattccggctattttacctgcggacttgtaagggagatggttaaaagcacccattcaatatggccaagacaatagtataacatatatatatgcatgtctaaaatattctcggcagtttttatgtggttctatgtattcataaaatgattggatagaaatacttaggtaggcatttcttgactgcactccaaagaaattaatccatctgtctatgaagattaaacttaccatattacgagaaaacaatcaggtaatctatatttttgaaaaataaatcccaacacccaatgaacaaagtatgttgcttaactccagtagccatgcagcatttcttgttacttgagctaatgcaactatgcaagctgtaaatttagacactgtggcttgcttggcttctctcctcccccgaaggctttctcagtttcttaggcaacaatggtgtacatcaaacctccatgagatagccttcaagggagagagagatccaagaaaaccgtgccgtttaacatcactttgaatgtagtaagtagaagtactaaccaatgcttttgcagacacatgaatttgtatctgcaaagcacatggagtggaatgactggaatataagtttgtggcagtatatatagtgtccacaaagctactatacatacataaaacaaatgagaccaaactaaaagggacaacagaatcctgcactaaataaaggggagataattgtattgtggagtgataatgtaattaatgaagaatcgactcaactgcctagaaagcagaaagagatacaaggccatgaggataggagagctttgcctccattagttctagaaaacttacatttagtacaatggcacctttccttcatgatcttttggacaatggtatctgactatgccgaacaattggtccaactcatggttacaattgattcccacccttaacacataacagcagtgccaattaacaaatatcatctataaagaggttagaagacaacgtacatgtcaccacaggttcttaatgttgagtgaaatactagctaatcttatggtgatacaacattagaaaaaagtctatttaatactccctccgtttcaggttataagacgttttgactttggtcaaaatcaaactactttaagtttgaccaagtttgtagaaaaaagtagtaacattttcaacccaagaaaaatttattatgaaaatatattcgattattgatttgatgaaactaatttagtattatgaatattactacatttgtctataaacttagttaaatttgaaacagtttgactttgaccaaagtcaaaacgtcttgtaacctgaaaccagtggcggaactgagggggggctggcaggggccatggcccctcccaataaaaacaatttttttattacccccatatatcatagcagattcagtgaacaagcaatagagcttctcaatttgtgtacgtctttggatccaagtgattcattcagttcattcaacattgataaagtgtgctctctagcttcaaagttctatcctgctgattttttagaacaagagagccaatttgagatgtcaattacgtcactatgaacttgatgtacccaccaatcctaaatttcaaaatctgacatctgtagctgatctttgtcgtcgacttttgcaaactattcgcttttatgtattgccaatgcatgaaaaaaaagagaaattgctaattttttgaactgtcaaaagccggctggcccccctttgattttctgtccagctccgccactgcctgaaacggagggagtatcaaattgcttaggatagatgtcctccaaaatttagaaaagccataaaagaagcttgttaatggtcagactgaaatgttcagtacaagtagctatatgtatatagttctcaccagtcaccatacagaaaattctaagagacttgtgtacagatcatacacaggtgacactgttctaaaccaacaagttttgatcatattgtcagcaaaagtctaaccacaataccacaaacactcaccaagccgcattcagctgcagaagaactggatattctcatataacattgacaacggaatctgggagatcaatcgatcatcacattacaggtacaagtgaccctttggacactagagaagccaaaggcttgtccaccaatacaaagtagcactaagtaataggtccctaaagtgttagatttggaagataattggtaccataagtggttactcgtcagtgtcagacagtcgatcagtatgttccaggggtttcttttgctgcccaccgtatctctgaaaagtttatagcagatcaactgcagctaagaaaaggaaaaattccagctctataacctaggaaagaattagaaaaggccccaccactaacaggttttacttcatttctccaccaggtaaaagtgattgcacataactaaaaagttagaatgaaaaagaatgcatgaatggattttacaattctaaacagagagagtatatgatccagttatgtcatagaaatactgcagaaaagaaagagtcaactctacaaacaaatggaactctattccaaaaagaaggaataatttctttaggcaaaagtcacccagataaattctaggagaaagaatattatcatctgcagccagtatgaaggtttaaagaagagaatcaaataaaaatgaaccaaagatgcatgtagacaagtctagtctagaagaaacattcgcttgcattagttaaggtgtaaggtttgcagagaatcaaactgaatatggttcttgtcaatgctctaatgaattaattccacttagttggatcaccattttcttctcttttcaattctatatgagtatcataaaggtattgctgtcaagttaggaattaggcattaggcaaattgcctggataatgaataatcctcttgttcaaaaccattttaagtttctcttcttccagtcagtacaatagcctatattttgtagcacttgagttatgaaatgtaatatgtacaaacacctagtatcatcatggggccaccggcaaagttatttctcacttttgtagaaaatattccatccaagggtaaatccatgcaactgagtttcatccatatccacgatgtgacacattgtgtgtattggaccatagacccacatgacagtgagacatcattggcgcatcgtacacattggattaagaatctttcaaatcccaaatgatgaatctttggtaagtccgaatcacccaaaaacagatgcaaatataggtttaaaaaatgtctaaaggaattaaatggaggccccatattcaccagagatcgagaactggtatgcaattttttgcaaattacaacacgtatacacaaaatatatatatatcagaacctcaagaagattccatgaaatgaatatcaagcagtatggaagtaggagagcgataacgcagctcatatttggtttagcacaactaacagcatgcaatcatgatgaagttttacatctgtaacaaagactactgtcttaatgataaagagttgtgcctgcatgcaacagctgaatgcgcatgtgtatgaagttttattaaggaaatgggatgaatgtcggaaggttcgaagcaaagcacagattttaaacgaaatgtgaggacaattcgaaactgcaggtgatcccaatccggaatagttctttgggttttgcatgcttgcagccaagggggccaatagaaaagaaatactgcatagcagtaaattcaccatgatagagtatataaagctaccacaatagcataatgtgaacaaactacaaaactatgagatcattgaatgagttacaacaagtggcctatcctacatttggatccattgactgattcaataagataaaggttaccacagtgttcatcccaaaacccccataggccatacggctaaatatttcaggggatcagcatgtgaacatatcacattacttgagaatgatcaaaatgtacctacttaatcaagcacaattgaagcaacacaatcttattcctgcgcaatgctcttgccgacgacgcccttcatcggcaaatgttccatctccgcctcggcagacgccaccgtgggcattgcatcgtacgacccaccgacgccattatgcctcctccctgtccccatccccgccccggcgccgccgtccaccccgcaccaccaagccaccccgaggtgcactcccacggccaccgccgcgacgaccacgcagtgcacggacagcgcgaggtccatgagcgccacggcgcggagcctggcctcctcgacgtcgcaccgcgtggcgggcgtggccacggcggcgtccatgaggcggtggcacccggcggggacgcaggcgtcgacgtagaggacgaggccgctctgccccacccagaggccacccacggcgccggcgcaggcgagcgcggtctcggcgaggagcccgcggttcgggggggagatcgcggcgagcagcgaggcgacggccgcggcgaggaggagggccgcggcgacgtggagcgcgtgggactggaggtcggagggcgggaaggaggcggcgacgagggaggcggcgcgggcgatgaggaggagggggagggagaggaggaggggg

SEQ ID NO: 81964 - DNA, 45482 bp, Oryza sativa
aatgcaatatacagccaatggagtttgaatggtttcaatattaaagatcattttcatagctctcccagtcccaaatgtacagcctgatattccaatcgtcgtattagttaatttattgcatcaatttgaatttgttaaaaccggtatcacaaacgccaatgatgtcatgataagcatagacctccaatctgtttgcttgatcgactaggcattgctcacagtcacggaccttatcacttacacactgattaattcaatattagcaaacgagttttttctttttttgaaacgaaatttgaggcaacgcccaccgtccgtgctcacttttgacggaatttgaggaccaaaccgtgtcaagattttgctgcgttacaacttgctttcgacgagtaatggatgtccaaaaaccaacatactcactgggactcctttattggcaaatgaaaaacacttacataagctcttcagcttggtttcaattgactgggattttagttcaattttgcttttattatgaatggatcctagatactctcaccaatttacaacaagctctctgagatttcatcgatctgtaatagacctatttagtccattatatccaagaaggttactgtgatatagtcatgtttatttttactagaatcgacagatcaaaagtaatggaaaattataaactcccaagattatgattgtgatagaccaactgagtggcagccaaaacaagctctgatgactcacagccttgtcctgcatttctccttaatcaccatcaggagatggatgttttcagttccttgcgctgcttgagatttcttctaggctagttcatcataattgcacagtgggatatcctcattaacactatacattctgccaccacagtagagcaactctctcccacaggcaatggcttttctctgatctccaactatgagcatcgagcatcacagtttcgtgatcttgcacagacaaagtatgggtgggcagatcattgaaaatgcttgctgattgaaactaacttctcggtgcctccatttccaactaggatgtaaaactatgatccacaatattcctctaccatatccagcagtggtcttcaaaccattacagaagggagcgcctctgctatttatctttggttgattattctttgtacaattttcacagatcggattaaataaagtcatgaacgaaatgaacctcgaatgacgacacatgtgctgcacaactatacatggccataaggcccgaggcccgacaacccagcccaaagtgcggccatttggcccggtccaaacacgacatggcacgattggtgtcagacccaagccagctcgggccgacagttgggtaaaatagacttattttatagagaaacacgatgggcgcctgtcatgtctttgggctggcccaattcctagggccatgggtgtagcccgtggacaggcacgacacagcacgacgtgtaggttgggccatgccgggcttggtccgggtggcctatttggctatctatatgcacaacaacttacatggaataaaacacccagcaaattatttaacttgacgacaacattatttgcacattgcaggcacactataaaagttacacatttaaagagagtttctcgtgtgtgtgtgtgggggggggggggctaaaatctcaaaaattttgcgatgaaaaaaaataaatttaaataaaagtaaaatagtgaactttctatcctgccattattcagctcacagtagttcggatgaatacgaactaatggcatttgttttgacatatttggtatgatgagatacgttttgaacattcataaaagttgaaagcaggtcttctgaggtaaaaaaatgactacatttaataaattgtaattattagatttggtcgtattgtgtattatacaattatacaaggaaagtaaaatacaggtgccttgatcacaatttggtgccaactgctaacactgtcgggttacaaatgtgctccgttttttttggtttgttttggcaggaacagctctgacgagagtgttgcatcaggcccccgtcatgtcggattggacactaattagaagtattaaacgtagactaatgacaaaactcattccataacactggacttattcgcgagacgaatctattgagcctaattaatctatgattagcctatatgatgctatagtaaacatgtgctaattatagattagttagtcttaaaaaatttatctcacgaattagctctcatttatataattagttttattattagtttacatttaatacttctaattagtgtccaaacatccaatgttacaggatccaaaaaccacctgatgaagtaaaacttctccttttatgtttggcactccatttacattttatatcctctctgatgtcttaattatggcaaaagatattcctgtttagacagaagttatcctgaagcattcatccaattcttagaactatttctgttgtcattagtgacattagtgagtaatgacatctgttgtgcatagcattttccatggagcagaacagggatcatacacatcataaagataacttcataattatctcggtaacaacattgttaccgccaaataaaaaaataacaaatttatttcatgttccatgggaagataccagaaggcaccaattattttttgtgtaaataggtatcaggaggcaccataattaattaacactaaaaagtatggtactatctgatgtcttccgagactagtttttaggaaaaacctttaacttcttcatgtagaagagatcaactccataaagaagttaaaagtttttcctaaaaaaaagttagagctaatgcttcaggtttagagaccaaagaattacacaattgaatcaaatcggaacgctttctattattgtcgttaagcaaatcctgacaaaagttgaaacaatagcgacttaaaaaaaatgactatgcagcaaaggagtacatctcaatacaacacccataaagctgctaaaatatttagatttaaaccttccttataatatatacttccatttcagttggttgttttagtatgagaaattttgaaagagtatattagatcatttcaaattcatgaatttctaataatccctgtgtactcagctagtctggtctgatcttggtcttgctgttcaagctacccactgctttgcgaccggccatccattaccaaggctgtctgctaccaccaagcatccaaaggtgaggccagtgcaaccgtagggcttgcaaggacatatcttactgtcttgtatagttgtaaggtgggcagtatcaatccccttatggctcaagcagtctagaacagccggaagcacaaccctgtcggttgaggatcttgtagctaaatataatcaagtcctacctttatacctcgtcccaatgaacccaataggttgaaactgtattcccaatgcctccttttcccttgtatatgcgatagttagaatgttgttttagtgtgagtacggaaacctaatatcgatgtcttgggaatatgatgaaaaattgaactaacaagacctagatagcatgctgattttgcgtatctacactagagctagcttgttgccattctcactttgttatcctaagagagttctggtgttctacatcagagcacagggccagttgcaagcaggttctagtatacatttctatatatatggaagtcaataaaagtaggcaatgagacgacacatgcatgcaaatatggtatttatcatgaagaaaagatcgcaatgtaattaagtaactcaaccgaccatatatgcttctgaacgcatcgatgtattattgcattttgtactttgtagaaaaacaatgggttgtgtccatgtgtgagctacctacatgtatgcactcgaagctgtaaaattatttgtatattggacataggatctcggtgcctccttttccaaaccggagtttgcaattaaaattgacgatagcatttgcttcccatctattatctacaagaataaatgttatatatataccccaaatggcttcacctatctgcaagagatcaaagaggcttcttgttaatttgcatgaccatcatgatatatctgttgtttaattttgacaagaaagaaaacgagtcaagttgcatatttcaggttcttcaatttgaagtctcaaattcgacggagaaattaaaagtcatcaggttcatgaagaaattaacattcctcatcttgcatttgatcctaaacttattgaactttgccactgaacgagagcctgctagagctatacagatcgcgggaccatttgatatatttgatgagcaaccgaggacacacgtcattgccggtcggcaaatactaccgcagtgttccattcacgttgtttgtgcccaatggagtttcttcacaagagcgctgtgtagtgatgccgaggttttagcagcgtccaagaaaattttacgggacgactctagcataagatcttatacctcactctccggttcacggactgctctttttgttcaaacctcacgattaaaccgattgccttgatcattgaaattgaaggtagcttgaaactttgttccgggtgcctccatttcctatggcatgttcgacgatgagacccattatcattttgtaagcacctccatggccgcaccaaaatgtgtattcaagcatcagggtcttcttctatttatcatgggttcacacaactctcaacataatttctgcaccaattctcagcacaattttgtgcgtaagtaagattaaataaagtgttattaattagtgagtaacgacatctgttgtgcatagtattttccacggagcagaacactcaaaggggatcatacaccacttcacaattttcttggtaaaaaatattgctaccgccaaataaaaaatcacaaatttatctcatgttccatgggaagataccagaaggcatcaatatttcttttgtgtaaataggtatcaggaggtaccataataaattaacactaaaaaatatggtaccatataatgtcttttcaaaaacaataaaaaaggctaaataaatgtgaaggaacgatactaatgagttaccaactcaatccaaaagcagagctcatgccattttgcttctgagaggaaaacaaaatactaaaaactgaataaattaaaacagcgcagtgcatagcaattaatcaaaaaaaaaaaaaaacagcagtgcatagccggccattctcagctgaaagacagtttcaatgaatatgatctaaccatcgagtgccatttggttagactgtgttgtttcttgataatggttagacctaaaaccaagatagagctaaactccataaaataagttagagcttttcctatagaaaaaaggttagagctaatgctttaggtttggagtgtggaaaaatctaattggtgtattctattgttttctaatctattacattgactctcttatagggatagaaacttagagtgcaatacaagtaagagtagatttatctctaagattctatctctatgatatatcttatctctatgtttgtatttgaatcttatctctaactaacatatttgtacttctaacaaagagaccatagaattaaacaattgaatcaaatctaagctttctattattctcgtatgcaaatcctgacaatagttgtaacaatagcaagttaaatatgcttgctgctaactgtagagaaagtggaatagatgcctcaccaatgtggggaggtgaactctcatatatatatagcagaattacaatcaatgctagtgctgagttacaatcaatactagggagttacataagaccaaaggtctaggagagtaactatctaggagtgtaaaagtttaggagataaacagcctatagattaataaataatcctaatacccgcccgcagtcgtagcgggaggagcatgaacgcacagactggaccgaaaatcagtaaataactgaaccggcaaacctttggtcatgatgtccgcgaactggtgcgatgaagggacatgaagtacccggacttgtcccaaagccaccttttcacggacaaagtggatgtcgatctcgatatacttcgtccatcgatgatgcacgggattcgctgtcacgtaaacagcactgacattgtcacaatagacaatagtagccgaagcaattgggacatgaagttctagtagcaattgccgcaaccagcagcactcggcgacggcatgagcaacggcacggtactccgcctcagcactggaacgagagacagtagtctggcgcttggaggaccaagaaaccagataatctccaaggaagacacagtagccggacgtggaacgaggagaatcgggacaacccgcccaatccgcatcggagtatgccgtgagggactgaatcgggccggagccgatgtggaggccggtggagaggctgcccttcacataccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacgggcaggccgtcggtggcggagagcttggcacgagtgtccactggtgtcgatgtagagtggcactcggccatgctggcccggtgaagaagatccacagcgtactggcgctgtgagaggaagaggccggcggaggagcgcgtcacagagatgccgaggaagaagtggaggtcaccaaggtctgtcatggtcgaagcagtgaggatgatgtcatcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttaataccatacagggacttctgcaatagacagacagcatcaggggcagcggggtcaacaaacccagagggttgctgacaatagacggtctcctgtaggtgaccatgacgaaacacattcttcacatccagttgatgaattggccaagcacgggatgcagcgatgctgagaacaaaccgtatggtggccggcttgacaaccgagctaaatgtctcgtcgtagtcgatgccatgctgctgcgagtaaccacagaccacccaacgagccttgtgacgagcaagagtgccgtcagagtggaacttatgcttgaatatccacttgcccgtcacaatgttgtccccaggggggcgaggaacgagacaccaagtgccgttgtcaaccaacaccttgtactcatcagccatggcagtgcgccagttgggatcagccaacgcactgcgataattggccggaacaggagaagcagcggtggcgtgggtagccgtgtaggtcagcctgtcaaccggccgtaaggagctagtctgggagcgcgtcaccatggaatgcggctgaggagcagcagccgtgacaaccacattgggtgaagatgatggcgggaccgtcacggtgggccgacgggtgtagacatggcggaatggtgacacggtgccggctcgggtggcaccgaccgacggggcagcgccgatcgaggaggcgctgaccaagggcgtgccagctgatcgggcgtcacgtgccgcagggacggtgttgttcggcaagcgtcggccgaagaggggaacgtacggttgctcaacctccatggagggagccaccgtaaggcgtcgcggttgctcaacctctgtggagggagccaccgtgagaggtcgcggttgctcaacctccaaggagggagccaccgtgagaggtcgcggttgctcaacctctgatgagggagcgaccgctggagggagtccctgcagcaaaaaatcaaaagacgagggagcagggggagttgctgcgaagggaaatcgtgattcgtcaaacacgacgtggcgcgaaatgatgatgcggcgagtggagagatccagacatcggtatcccttgtgggaggccgggtacccaagaaaaaagcaagttgtcgagcgaggggcaagcttatgtggagtcgtggcactcaagtttgggtaacaaagacagccaaagacgcgaaggtgggagtagtctagggtggtgcgatgtaggagctgaaaaggtagtgagtggtgaacagaggaggagggtctccggttgagaaggtaggtggcggtggcgagagcctcagcccagtaggacggaggcatagaggcctgtataagaagggtgcgtatggagttgttcatggtgcggagcatccgttcggctttaccattttggggggaggtgtaagggcaagagagtcgtagctgggtgccacgactagtaagaaatgaagtggtggcggtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagtggaagtgcgagacaaagacctatcgaaaggtaatcgggtatgtttgcctaactgatacgcatgacataaagaggtgtctattttattacaggaaatagaggacatatttcgaagactgtggatggcggctggaccagggtgaccgagacgacggtgccaaagcgtggaagaagtggcgagggagcaggacgcggtgttggagggagtagcagctggaagggtgtagagttccccgtgactattgcagcgaagaatcacgcgctgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgtgccggtgtccaaaacttagttgtttgggctttggaaggccatctggttcagtgctgcaatgaggccagcttgctcccaattgggctggcctgtaggagcaaatgtgggcgacacaaatggcctagcatatgtggtattggcctgggagtagtcggccgtcggagccggcccaagaaggccggctgaagaggggcgccaggcctgttgctgggccggccaggggttaaaacaaacccaaggcccggccggcctccagctagggttggccacccagccggtcgaactccctccagcagagaaaccgccgccaccagaggaaacgccgctgccaccgccgccagagaaggcctggcgagtgccaccaccacccccactgccgccgccgttccctcctccatttccgccgccgcgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccaccgggagggcaggaaccggagccgaagccgccgccggccaccagcgccgtggctgccgccaccttggcttcgttggcgatgcgcaactccttcagcaggagggtgttgcgcgctaaggtgaagcttgggaggacggctgcgccagcgatgttatctccggtgttggagaagcgctcgttcaggccttggaggaggttaagcacgagttgggattcggtgacggcgtggctgatgtcgcgaagagcgtcggcagcggtcttcatcttctggcagtaatcgttgatggaggagtcgccttgaatcatggagtgaaactggtggctgaggaagatcgctcgaggctctttgttggcgtggaacatgtcctcgatggcgaccgagagctcccgcgcggtctgatcgggctccatggcgaggtcaaggacgttgtcggcgactgacccgaagatccagctgcagatgcagcagtcggcctgttcccaggccgggtcattggggcgtggaagagcggaaccgtcgatgtgagccattaacccgaacttgccgcacaaagatgtgaagaaggccctccatttgttgtaattcgggtgggtgttttctagggtgatggggacgtgggatttgatggcgaccgtggcgtaggggtggaggaattcgctggtggtactggaagaagaaaaaccactcgaggccgaggaggtggaggactgagttgattcagtcgacatggctgggatgcagctgcgatggcagcgtgctagagcagcggaaaagaaggtaagagcctaggctctgataccatgtagagaaagtggaatagatgcctcaccaatgtggggaggtgaactctcatatatatatagcagaattacaatcaatgctagtgctgagttacaatcaatactagggagttacataagaccaaaggtctagtagagtaactatctaggagtgtaaaagtttaggagataaacagcctatagattaataaataatcctaatactaacaaagtacatcataaaacacaacactcgtgaagctactaaaatatttaggctaaaccttccacaaaatacttttgcatttcagtggatttggtctagtatgcatgagaaaagagaatattataacatttctaattcgtgaatttctactgatcgccaagtcctgcatgctggatcctttcctagaccttgtagtcagctagcatagtctgatatgatctaagtttggtcgtccaatctgctcaagtagctatcattgtgaccggccatccatttctaaggctgcccgttgccaccaagcatccaagggtgaggccagtgcaactacagggataggtgtaggaacttgtcttactgtgttgtatagttgtaaggtgtgcaatatcgatccccttagctgtctcaaacagccgaaggcgcaaccatgtcggcttaggatcttgccgccgaatccattctaagtcctacttatatgtacgtcgtcgcaagagtgtatccgatgggttgaaacttgattcccaacgcctccttttcccaggatcttggttttagtgagtggggaaaaaccggatgttgatcgatatgccttgggaatatgatgaaaaattgaactagcaagacctatatatatagcatgaagattttgtgtgtacccatcgacactagagctatagcttgttaccattctcgcattgttttcgtaagagagttgtggtgttctacatcactgctgggccagcttggaagcaggttctagctagtgttctacatatatatatgggactcgataaaagtaggcaatgagatgccacatgcacatatggtacgttatttaatttatcatgaagaaaagatcacaccgtaattaaacaactcagccaaccatatctgcttctggacgtacgcatccatgcatcattgtattttatttgtatactcgtactcgatcttggaaaaaaagatgggatgtgtccatgcatgtatgcaccccgagccttggaagcttgaacgtttccgtatattagctagtgtgttagaaagttgggctcagtctgataaaaaaaaggttggactcagtagttaggaaaaacaaagtaattaagaagaactcactactacaaaaacacccataggtgtcggtcacaaaggtgccggttagctaacaaccggcacctataagtcatttcccgtcaatatagcaaaaaaacagcacctataacgatttattggtgtcggtttttgttgggaaggtcattggtgccaaaaatactcccgccaacggtccgaaaatcgcataggtggcggctgtggataaaaaaccggcacctgtatgaaaggtggcggttatttaaccaaaacgacacctaatcctaggtttttttttggatgaagggagtacttgattgtaaaggtcaaggtagactaattgtatctaggtccttagcaacaatgtattccatatactaggctgttcaaacatgagaccaagatgagtttgactaagaagatattagtgctaattttgcttcagtgtcacacatcatagatacaatagagtcactagaacggataccctcatctcaatcgggcggtaagccccatctcaatcgggcacagcgtccgtcacagactagaagtcactgatgtgaagagttatctcaatcgggcaaacagccgtcacgaatgaatatatctcaatcgggccctaagtaaagcccgtcaccgatagctttgacccagataaccagtcaaactatagcccgtcacacatgacctatctctatcgggccacaactagcgcccgtcacagatgactactaacctttatcgggcctaaactagagcccgtcacagatgacactcatctcaatcgggcctaaactatagcccatcatagatgactgatgacctcaatcgggactaaaatagagcccgtcacagatgactgctgacctcaatcgggcctaaactagagcccgtcacagatgacctcatctcaatcgggcatttagttatggcccgtcacagatgactataatccacaaaaaaaataaattttgttttttggctagcctcaggcctttgctagccatgcccgctgcaaaaatgacagaaacaaacacagatatccaatatccccagctccccagcatcacccattcatatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcatcacaattacataataagtgttcatcattgcctaaacatagaagttcaacattgttcatcattttagtttaagcctaaacattcctttggggttaattatttcgcggaagatgaagctggctatctcctcgcgaacctcctcaaagctggtaggcagagacttggttattgtgccctacattgtcataattccagattagtttatcgatcatatataattactaaatcacgtgttccataatcagtgtctactttctgttgttcccattacacaaaccacgatattaatagtgctaataagaaatattactacagttaatgaaacatcatttcatgaaaatcgatcatatattcatataaaaaaacttcctataatattgtcctacaagtaattttgcagttattaagaaggtatcagaaggtatgacacatgttctagtataaaatttggtatccctcgatatctctaatactataagatatcaaatcttacactaaaaatattggtacctcctggtacatatattaaaaactgtaaaattaccattgttacatacttcgtatagctcagcaccatcctggtacctccttcatatgcccatgatgtccaaacacacacccaatctcaaaactatttacgtacaccacccgccactagggtttacgttactgctggtaaccgcgcggttaccgcggttaccggccttaccacgggggtacggtaatagaaataccgcggtaagccggtaacctccttaaattcaaataaatttaaaatataatttgaatttttgataaattttgcacggttttgtatggtttttcatggttaccgcggtaaccgtgcttaccgccggggcatggggttaccgtgctccggcggtttgggaaaccctgcccgccaccactgaggttggaaactgctatgaggtcgtggatggtagcggtgaggccagtgtagccatgggactaaaagaaggcggctgcctcctgtacagcagcattgcaaccatcaggcggccggcatccatcctctaggcgcttgagtccagccggatgcacaatcctgacagttcaggaccctcatgcatgtgtactctcctatcgttttacttcagcagaccatagcgctttcagaaacttgaaaatctgctgctggcacctccctttccctatgtatggacggacggtttaagagcttgtttgttcgggtaaatttggatttctacaatccctttagagtggcatgaaaactcaactaaagaaaacatcaatctgcggagggtttgggtgttcttttttttttctttatgggttcaccaaacaacacctatgtgcgtcgtgacatccagatctcagagcttgttgaagagctcgtctttggcattgttttcttaagagttctatatatcatagaagagccagctactagatgtctagatgcaggtttcatctatagaactggatgagccgtggtatttatcatgcatatgggacgcaatgtcacaacgtaattaactactccaccaaccatgcttttgtgtagacacatggattatttacttaaacattttctgtagtcgatcttgcaaaaaaaaaagccatgtctcatgtgcgagctagcttcagggactcagaattaaccacacagaggtgagcatgtacatctccgtaaactattgtgttattagagcaattttacggtacttgaggagataccatgaggtaccacttttttattgtacatttggtaagatttgctacagtctagcaaaaagtacctcgaggtactgctacctcatggtaacaaatcgtttccgaccattcgatctagctgggcaggatcggcattgttagattcaatgcttggaaacgatttggtaccgtgaggtaatgctacctcgagatactttttgttggatcggagcaaatctcaaatttggtatctcttggtacttacgtaccatgaagtacctgtaaaatcaaagtgtgtttgattcttattctctgatgaacaattggcatatgagtattggttttgatatttggagattattggcgaagtggttttggagatgattggatttgcaggtgatgaacaggtgctgctgaagatttggtccgatcagaccgggcaaggcttgccggtcagaccggcatgtatcgagcggtcagactgtctagcccgcggtctgaccggctgactctgtgtcggttttgttttcgggttgtttcgttggatattcatggatagttcatatttatggcttctagatggatactatgcgtatgtaaaactgttgtttgctaacaatgagtcaagttggagatagcttggtctcggaatatggtttttttgtttgattcatgtgtaggtgtcttgatgcctcaggagagtattactggtgatggatcgggagtcaacttggagataaggtgatgtccagacggtcagatatatatcatgcggaatacttaggctaaaagatcaatgcacttggttggtgaagattccatatagcataggatggagatattgtgtgcgcatggaatgcggagtcgaatttagaaggagtctaaatttggtatgattggagtttgtaaagttagtttcttgtaccggaaggtttcctaggtggattaggactttttatatgagtttggttcgtggctttaggctacctacctcatatataaatagagagggaatgtgaggcctcccgggatcgctttagagagcattgagttgagagaatagttagggtttcgaatttagtcgagatttttgtgaggagtgctgttattgcactttgtaaacacagagagaagtaataaagttgtcatctactctgagagttctttgatttgtgttttctcgagttcggtggtccaaccgactgttgatgcaaaaaaacacacattggcctgggagatctgcttaactccagtgcaagtccaaatcttgatgagatgtgggcgtgccagtcagtttgatcctgcaactgacaaaatatgcaaatagtagatcaatgagccaatcggctgacaagccgatggagtagttccagccgatgccgataccagccgatggcgatagggttttgagctatcgacaatatgtccaatctagataatgatataaaggcaatcggctgatgatgatgcaatataacaataatataattcaatagacaccaatcagctagcagtatgatataatagaataagcactgatccgaaggttaaagcatacatttactggagatccgatgtcataaaatccacaatattagataaacaataaagtctttgttgtcatcggctaaatccaacttatatgtatatgcaatccttataagccgatgcaacgtctagataacttatcggctagcaacccgataaaacattagcatgaacctatcggcttaacaagatttatattatcaacaacaatctagtaggtcgaacctaaccgatgcagcacgagattgcatatgataatataatactcgatgagccgatagatctgtctagcatgatggatataacaaatctatttacaacaacgttgtgattgtagagaaatatcggctaagacagaagatcagacctaaccgagacagttccaactaaaccgatgcttctctaaacacaatgcaattagagatagaattgagatatcaggtaggaaaatatatcaaccaaaccagagcgatccaaaagatcaaaacgatgcagccttgaacaacaccaacatagccgatagattctccagggccggcggaacataggacttaccccttcgccggagatcgaactgaaccgatgcagccccgcgaaaagtgccaaattccgccagatgataagtaaaatcctcaggaaagagggtggcgatgcaccgagattagttgtattgatcgagagatatattacatagaccccgggtgtatatatttatacccgtgggtagatactagtccttgtcggacaagaaacaaaccttcctaaagataaaacagaaacataaagtcattattagacactaaacacacttttctaaagataaaaggaaactaacaaaccattcctataaagtcattattagacactaaacacactttcctatagataaaaggaaactaacaaaccattcctaattaataaatacaattgccttcttcggactcaatccgcacgtggcaatatctcatgaagcacgctaactcaatctggcaatgattccaatctcaccttgccggaatcagctacatcggcttaccttgtccgattcagtatccgccgatgcacaccgtagccaatgcagtcccgaagctgatttatactctggttctgttatcaatttccttccaaatccgcttcggccataactcgaaatccgttgcatgatttatcaaatttggtcgttaacaccgacgagacaccggcggtcagatcgatggcatcgcggcggtcagaccggcgggtttactgcggtcaaactggcggcagcaataggcgacgatgataggtttcggcggttagaccgggagatcaacaccagtcagaccggcggaataggaacggtcagacctgtagatcaaccccgatcagaccacaattcatcgatttgagagtaacttttaattgcactaaatgttttggtttttgggcactacaaccatctggtcgaattagttcttgctgttcgatcctacagtaccaaattttacactaattttttggttccttttggcacctccttaagaacagtaaaattgctcgtgttataaagtaggactcagtagtaagcacgaccgattggtttaagacatcaaacaatggaatatactgccaatggagtttgaatggttccattatattgaagatcattttcatagctctcccagtcccaaatgtacagcctcatattccaatcgtcgattagttaatttattgcatcaatttgaatttgttaaaaccggtatcacaaacgccaatagtgtcatgatgagcatagagctccaatctgtttgcttgatcgactaggcatattgctcacggtcacggaccttatcacttacacactgatcaatccgatattgcaaacgagtttttttaaaacgaaattcgaggcaactgcacctcacttgctgtcaagattttgctgcggtactacttgctttcgacgagtaatggatgtccaaaactaacatacttaaaaaaatatctttaaaaaatgtgaacgacactaatgagataccaactcaatccaaagcagagctcctgccattctgcttcagagaggaaaagaaaatactccctccgtccctaaatatttgacgctgttgactttttcaaatatgtttgactgttcgtcttattcaaaaacttttgtaaaatatgtaaaattatatgtatacataaaagtatatttaacaatgaatcaaatgataggaaaagaattaataattactttttttaaataagacgaacggtcaaacatgtttaaaaatgtcaacggcgtcaaatatttagggacggagggagtactaaagagagaataaaaagagcagagagtaccaattattcgggaaaaaaaataatagtgcatagccagccattcttccgctgaagacagtttcaatgaatatgatttaagcatctagtgccattttgttagacatatgttgttgttaggtaatggttagacctaaaaccaggataaagatcaactacataaagaagttaaaggtttttcctaaaaaaaagttagagctaatgattcaggtttagagaccatagaattacacaattgaatcaaatcagtacgctttctattattgtcgttaagcaaatcctgacaatagttgaaacaatagcgacttaaaaaactgactatacagcaaaggagtacatcacaatacaacattcatagagctgctaaaatatttagatttaaaccttccttataatatatacttccctttcagtgggttgttctggtatgagaaatttcggcaaagagtatattagatcatttctaattcatgaatttctaatgattcctgtgtactcagctagcctggtctgatcttggtcttgatgttcaagctacccactgctttgcgaccagccatccatttccaaggttgtctgctaccaccaagcatccaaaggtgaggccagtgcaaccgaagggctacgtgcaaggacatgtcttactgtcttgtatagttgtaaggtgggcagtatcaatccacttatggctcaagctgtctagaacagccggaagcacaaccctgtcggttgaggatcttgcagctaaatcaaaccaagtcctgccttgacgttcctcattccaaggatggacccaataggttgagactgtattcccaatgcttccttttcccttgtatataggatagttagagtgttgttttagtgtgagcggggaaactgatattgatgtcttgggattatgatgaaaaattgaactaacaagacctagatagcatgctgattttgtgtatctacactagagctagcttgttgccgttctcactttgttatcctaagagagttctgttctacatcagagcatagggccagctgcaagcaggttctagtgtacatttctacatatatggaggtcaataaaagtaggcaatgagacgacacatgcatgcacgtatggtatttatcatgaagaaaagattaaacagctcaaccgaccatatatgcttctgaacgcattgatgtattattgcattttgtactttgtagaaaaacaatgggttgtgtccatgtgtgatctacctacatgtatgcactcgaagctgtaaaattgtttgtatattggacataggatcccggtacctccttttccaaaccggactttgcaattaaaattgacgatagcatttgcttcccatctattatctaccagaagtaatgatatatatacccaaatggcttcacctatctgcaagagatcaaagaggctttttgtttgcacgaccatcatgatatatctattgttcaattttgacaagaaagaaaattagtcaagttgcatatttcaggttcttctatttgaagtctcaaattcgacggagaaattaaaagtcatcaggttcatgaagaaattaacatgcctcatctttcatttgatcccaaacttattgaactttgccactgaaccagagcctgctagagctatacagatcacgggaccattcgacttatttgatgagcagccgaggacacatggcattacgatcggcaaatactaccgcttcactgatcaatggccatcacctgcaaccatgaaagcttgggattgccgtcatggcagtgttccattcacgtcgtttgtgcccaatagagtttcttcacaagagcgctgtgtagcgatgcggaggttttagcaacgtcaatccatgaccgcagcaaactgtgtattcaagcatcacaggaagaggggcttcttctatttatcatgggttcacacaactctcaaaagaatttctgcaccaattctcagcacaattttgtgcataagtaagattaaataaagtgttattaattagtgagtaacgacatctgttatgcatagtattttctatgtagcagaaccctcaaacagctggaggcacaaccatgtcggttgaggatcttgccgacgaatccattcgagtcctgcttatatgtacgtcgttgcaagagtgtatcagatgggttgaaacttgattcccaacgcctccttttcccaggatcttggttttagtgagtgggaaaaaactggatatcgatcgatctttcttgggaatatgatgaaaaattgaactagcaagacctagatatataacatgatgattttgtgtgattcgatcaacactagagctatagcttgttgccattctcgcattgttttcctaattaaaagagttgtggtgttctacgtcacagctggccagcttggaagcaggttctagtgttctacatgtatggaactcgacaaaagtaggcaatgagacgccacatgcatgtacatatggtatttattaatttgtcatgaagagaagatcgcaacataattaaacaactcagccaaccatatatgcttctggacacatcaatgcatcattgtattttgtatactttgtagtagatcttggaaaaaaaaatatgggatgtgtccatgcatgttcgcactccgagccttggaagcatgtacatttccgtatattagtgtgttagaaattaaaagttgggctaagtccgataaaaaaatgttggactcagtagttagggaaaacaaagtaattaagaacaactatcgataaatcttgttctgtcgatcgaacataatctaagaaagcaaataggttctgaaggtttaggttataatattccatgttaattaggggctgtttgtggatggggctaaattttttttaagtccctgtcatatcggatatttgacactaattagaagtattaaatatagactaatgataaaacacatttcataattctggactaattcatgagacaaatctatatattgagcctgattaattcatgattagcctatgtgatgctatagtaaatatatgctaattatggattaattaggcttaaaaaattgtctcgcgaattagctctgatttatgtaattagttttgtaagtagtctatgtttaatacttcaaattagtgttcaaatatccgatatgatagggactttagtctctagatccaaacacccccttagaatattattagtcatattgtaaattttgatctcgattctctctcttccacctaggaatgtgatgatgtggcatttgtttggagcctgctgactgagtttattgtacctgttctaaagaacttactagtactactactttgtttgttgtgccaaggataactttttaacctatagatgtattcattactcctccttgatttatactattttgggcataatcccctatatttattgtgggtataatcctctatattccggagggtgtatgatctagcctcgatcatgtcgattggagtcaaaatgatgctaccatacataccatacagtgtactcgatgatcagccacccttgagaatggggctctctctaccttcctacatgctagtatgaagcacgctagtcttctcttcgatgtcagcatcatgtatgccgaatgtggaactctacaagtacgaagaccctatgttctttcactaggatgtactaatacactaccaaagccatgccacccacactagcataaccttgtcaactcttgaaactagtcactctttccatagtagtagctgtctattgatttcatgggacactccaaggttatgccgatcgaaaagtggaccgagagctgtgcgatgaattcctgatacctccatttcctactagggtagttcttcacttttgttcagagttttgctacaagagcttagattttgatctacgtaataacttgcacaacaaaatgactagaaaagacatttcttttatatgtcttccaacccaactacctccaccaaccatgcatgtgcggactgagctcgtagagttaaatcatttaagaattcttttcaacaccattatatatcttttattcttcctagtaacgaaaagcaggtgaacagattctgctagctagggagcaattatttttgggggtttttacacattagagtaaattaccgtgctatggagaaacgctcaggttcttccggctagctctataaggtgatgggctagacgacttggactcgaagcatcaccccttctaattatttgatattaggtccttccctaatattcgcgtttttaattaccgtgctatctcattcagacagtcaggtagataaatacagtggcgtgtatatgaacaccatcaggtttcccctaacattgagtttttctttgcttgattatattgaattattggcatcaatgtctttgcgctcagtccacacatggttatatatatcaccgatagtggtcggaaaggctaatgggtgggtgatcgctcccccaccagcccagcgatcgccgcccaccctctccccgatactactagatgtatgtcacaccccaatccagcaccgccgtacaacgacacctgacactggcgtgtcgtaggaaaaacggcgcgaaccgcttcctacgaaaccgcgatcacagtaccagtcccaggacatagtgctggtacccacggtgacaaatatgattcattgcaaatccttaaaataaatagaggacttatttaccttaacttaggttgcagctcaggacagcctgagaatacaaccaaagacacagacgaggaaacaccagcaacagcagcagcagcggaaccaacggtctaacaccccacaccacaggcgacggctgggaaccaggacgaaaccctaatcttcactttacttcatcttcaacttccgggtggaggaactatatatatttatatagagcaagggtgagtactttcgtactcagcaagtcacaggaatttaggtgtttaatgcaagcttgaaagagaggcaaagtagttttgcaaaatcctttgtttgaaatcattttttgaaatctctaagtgatttatttctttttaagtttggatcaaaaaggagacttgcgtctcgattcgacttaagagatgcttttcaacaactcaaatggtaatgtactgacccccgggtcagatcattacttatcggctcccatagccatttcacttgattaagcggctcctagagcctttttcatttttgcggactcccagagtccagctgcccagcagcaaagcaatccgcttccactcgggaagcctagtctatgatgcccacagacatcccgaatcacacagattcgtttctgaccactcaggtcatccatctgccacttaggctgattctggttacgattcccaatccacaacaactgttcacaaagcacaggcaaacaaatctacgcaacgggaaccacctcacatccgcccatgaccgtgggcacggctgtttgaacagttagttaacctctgcagaggggtgcactttacccacaagacacgaacttactccagacactggccggtgtcagaggtttgcgacaaagcctttccaaagctaaatttgggtcacctcatgccacatagagggtctccctgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgaatttcccaaaggaatcggtccttatatgcgaatacgggacagtgccaccaaggcacagcacccgcatcgcgagctttcacaattcattttattttcaaacacgccgacaccacatgtcgggttttaaaggcttctcaaacccatttcccagattatcgacaaacaacggtgtatgtggaatagttggtatacgcgctcagagagcacggataccgaagtaccacaaaggtggagcgacaaggaatcagggtagtacagcctacaggaattagtgcgactactaggtaggtccgtcggtttggcacgcaaaccgaaaccaagcatgctataaatgtgtgttgctaataatgcgagttgcaaacaaattaataatgattttccaattataggagcaattggtcaaagggtgcttgccttgctcaaggtcttcacgaagcttcacgaatcttcgagaaaacccgcgatcgacgaaaatccggtaactgcaactatacgcaaacaattaaaaacctacacaagacccaaaataaagatcctatttagactacataatagtaccattagatagatctcaattttacggaattattggaagttgaacggagtcaatcggatgagcggttgagaagatatggattttctaaggattaaggaatttctgtctaaaggaaaaaggatttaataatttattaaaccctttttggaaagaaattgaaagagggatatgatttagacttcctcgggcggcttgggtgcggcccaagaggagaggcatggctcggccgaactaatgggccggccggcccggagaggcggcccaagggggcgcggggagagtgagggagagagagggccggcgggccgagtccaccttgcggggtcccgagtggggcccgcttgtcggtggcgcggctcaccgtgggagcggcgcatgagggtggcgctagggtttcgggtgagcgcggttcacgcgcgtgcaccggatggaccagggatgcggcgggcccacgcgcagccggttggcgcaccgtgggccgcgcgcgcgaggggggggagggaggaggcagctgaccggctcggctcggtcaatgccgaggtggcgccgacgtggcgcctacgtggcagccacgcaggccggcgggtggaggaagaaggggaggccgagatggacggcggacggcggccgtgttcaccggagcaagcgcgacgggtttggtcttcgaggagcacaccggagtgacgagggcgtcgagaaggagcgagccaacggctcggattcgccggagggtgttcaacggcggtggaattcgacagcggcggccggcggcgagagaaaggggaaatcaccgaggggcgacaaggactcaattaaaggcggcgggagcatctccggggctcaagggtttcgttcctgtaatcggatagggtggggaggcgccgtggaggtccggcgacgagaggcggcctccgggagcaggcgctgacggtggcaaggccatgccgagcggcggcagagctcggggcggcgtctacgcgcgttcgaggggctaaccgagctatcatgcaagctagagagggcgagggagaacgaggaaggagaacggagggaggtactaccgagccgggcgtagtgatgggcggcggcggtgcggggcgagctctctggcctcgggccggggaaggggaaggagagggtgcccggagtcccgcgtcacgcatccacgcacgcaccggtctccctggtgcttcggcgacggacagcgagggcgactgcagggcggggtggcaacaatggcgcggtggaggttgggcaaggaaacgaggaggaaagggaggggctcaggttgggttttatgggtgcgggaagtcggttttgggggaggaaaccgacttagggcggtcaaggggaggagctggcggtcgcgcccgtggtccaggcggtggcaagcggtgacgccgatggtggtcgggcaaaaggaaaaaggagagggagaaagggagctctgctccttgctgtttcgggaaaagttgaaggagggagagggagtgagagaggggctgcctctctcggctttggaagctagcggcgtggagcggcagagcggcagcgcacgacgcaagcgatgctagggcttgacgcggcggcaaccgggcggctgcgcggcgcaggcgcggcagggctgacggcggcaacgaccggccggtcggccactcgtgagcgccggaaagagcgaaggcggtggcgggttttgggcggcgtcggcacgcgagagagaaaacgagagagagagcgagaaacagagagagcgagagagctctctctcggctcagctcggcacgtgcaacgcacgtgcgaggctgagggagcagaaacggctgagggagggaggtgggctaagggggaaaacggcccacaacacccgagggaagtaaaatagacttttgcagagaagactgatttggagtgtattcgaattggggttttggattcgaattcaaatttgacattcgaactcgatggtttagggaggaatcaagggagactcgaggagaagtcaaggaagagattcaaaacagaaacttggatatttttttagtagtcggagcgaatattcggcaaggattcaaaggaagggattgacttttggaatttgatttcggagacttgaattttggataggaattcttgaggtggaggatttttgatttcgatgagagggaacaacgggattgagttgagatccatggcacgacttagactctcactcaaagaacaaaaattttcgcaattagtattttgccgaattagtgtttaatgtctcacgaaaagcggagcgttacaatgtactcctccctcttctcccccttcctcctctccttctcctctttctactgcaatagaccacacaaaattttttgaaaaacaaaagttagaaaaatttatgtatagaaatactatatataaaaaatttgaattcaaattcaaatttgaatcgggtatgtaaacttttgacttataaattttgggtctataaactttaggtgtataaactttagatgtatagaaatactatatatagaaaatatttgaattagaaaatatttgaattcaaattcaaatttgaatcgggtatataaactttaggtctataaactttaggtgtataaactttagatgtatagaaatactatatatgaaaaatatttcaattcaaattcaaatttgaatcggatattcaaattcaagatcaaatttgaaacgggtatatataaactttaggtgtataaactttagatgtacagaaatactatatataaaaaaatatttgaattcaaattcacatttgaatcggatatataaacttttgacttataaacttttggtctctaaactttagatgtgtaaactttaggtgtataaactttaggtgtataaatttactaaaataggaaaataatacggtgacaaaaaaggaaaccaggtggagggagggaggggggaggtggggagcgaatctgatcgctaccccatccccacggcgatcgatcgcccattaggggtacccgatagtggttgctttcatcgttaaaatgaataatcaaacaattgcatcacttgtttcttatcaaaataaagatatgacgaattgttaaacatgttgacatatcttacacaccaaattccatgtgagactccaaagtcaaaacccaactactaggcctaagaaatcatcagcacaagaagtaagcacacggctgctctgctcccagctatcttcttgcttcaagaggtcagcgtaggtgggcacggttttcctggctagctttagctactggtgcaaaggaaaaaacaaactccttgcctactggcaagctccaaaacacggacttcgactgtgcaatcgttggccttgccatgttgccatccgcatattatattggctagtttacacattatgtactctcagcagctggttgagagtatagtagattgcaactttgcaccgaattcctgatgcctcccttttctattggacttgattgtccatcgtctcaagtgagacttgtaaacattggaacacttgcatccacctctacagcatgccctacaagaatctagctagagtgatggatgatgcaggctgtgttttgaaggactatgtgcactgatacttttttaaaaggacaccactaggcatcagacatgattttttacagatcataaggcctgtgtttcaccacttgtaaggaaatgcgttttagattatatattcatcactcagtgaaaatgtttctacaataatttgtttatgatgtttaatcacttagtgaaataaatattccacatgtagtaaaaaaaatgtttcgattagatgcaacatcagaaagtttgggttgcaaccccaaaactttacgcaaggtcggaaaaaaaagtgcgtgtcgtcatttggaacatctgaccaaagagggataaatactggaatacaataacatgcaacaagataaacaatagtgcaacaaacctatcgctctagtatgctgagtttgtgtatctacatagtagagctagctaagtccgcgtggtacttggacaccatggacttaatgccaagcgcagacattaatacaacatagtgaattaatttcacattagaattcatcagattatctgacttcaaataattcttggcatctcttccactagaactacactggtactctcctaaagcgatgggaataggctttgaaatgatatttttcttagataggcttgaaacgatatgtacagtaagatcgatgttgccactgctatgtgtggactgagctttgccaagtgaagtcaatacatatcaaggaaaacggcataattgcactgagctacggcttcattgcatccatggtacacaatcactatattatgttattaactgtctgaaggtcaggtgcacagtattagtgtagagagcccatctaatgttacagagtttgtgtcgaatatatatatatgtagtttagaacttggagttgtacttggtgttaggactagagtaagagtcagactctatactagactctcttaaatagaggggtggacctattgtaatcgcatggcgacttagcatagcgagaggaagcggttgctggcggtgtcctagtactgctagagctttacactaaatatagttttagtatgcacttcccgcactgcaagagcaattttacagttcttgaggagataccattaaggataaaaatttagtgtaaaatttagtagctcctagtacttaggtattaagaggtaccaaatttacaatagaaaatgtggtacctcctcaaggactataaaattgctcgcactgctgactgcagagcagtgtgacctttcacgaactcaactgtaatatgtcgatcaaaacagtgttacagtaccaattctgtggttctaagcaacaaattatgttgacggctatgctctactgctcctagacttccatgtcttcaggatgcacgtacgtaactttgccctgctggttttgtactcttacttctgctggtgtaatacgaatgggtttcagcaaaagctgtgatgaatccacatgttctgcagctgcttcaggtaattcacatgcgatactaagtcatggtgcacagtgttgtcactacgccgcgtccttcttggactctcctcccaatcgtttccctcggggctacactattcaaagcctcctaacctaagttctcagtgcctcccttccctatgcttactgggttatacagtggcatgatcagtgattgatattcgagttttcctccatattcttctccttgagtttttgcgagtttcatgaaaccaaaaatgctactctcgacatggatatatagagataagtggttattgagcattcagaacaatgaatccaataatgatttaatttacatcgtatataatcgagtgcacatacacaccaacaacctccagccactatggtttctctggatctctgtaattgatgtcatatggaatttttttttcttttgcaaaacaccatacagaagaatatatttatatgcacgtcggctatctcatacatccatgagcacctccacgagatctggattggtgtatcgtaatattgagtaaggcatcatacacatctcatcatcgatggacgcattgtctaccacttaacgaatagtatcataaatgtgagcaccatgtgacgagtcagaactcgagggtaggttccaccgtaagaaatttaatcaactgagagctactctctccattcatgtcacacaacagttttagtgtgctatcttgaaacagaaaagagcagataaagctaaagggttcatgtctaagcattcttgcacaactgtttctaaaaggacttctcttgcagattttcatcacaacagttttttacaaatgaagtgtcgcacatttttcataatttcattaatgaaaagttaaagggttcaggtctaacttaacggagaggaggataaagtgaatctagcctgctgacctagtcatctggacagccaaagcacaggaggcgattaaaaacaccatcaaacgtcaatcacgtagccatcatcattgttctttaactttcctcaatcaccactgggagatctttgacgatgatctttaaccattggaatcttcagttcatcgatcctaattgcagagttaagcaacctgtacatcaatctcttgtagaccagttgatgcatgattgttgcggagtgaaatatatgctcactagcacaacagtaggcatctatctcggcagtacatcaagctctctgtgtgggtaatgatgtttatccctgaataagatcataagggtttcaacaagtagcacgaaggccctctcagtgcttaatgacgtaaacactctacatctctagttcccaacatggtctgccatcagctgctctacatctctagtttccacaagttcattttggttggtctgatcttcgatagtacaagccgcctaaaactaagttcctggggcctccatttcctaccggttatgaccctttattgtgacttgcacctaactccataattcctcgaagatatacagttatacactgttttgatctttgagcattacaaaatggagtacctcttctatttataatgggctcacaacttttagcacaatttctccaccaccaaccatatggaattctgcgcggataggattaactaatagtcactctgtgaaatatatgtatcttgaatgatgactggtgtgggcacaacattttttatgaagcggtatttccaatggttctcaaacaacttaatctacaacctactacattctaagagcaaatttaatggtatagccaactatcggctccaaatcatctatagtcaattttatagctaattaattcatacaataatagttacacataaacatatactacacaattaatatctggtcccacctgtcatacatacatgcatctttgagtccgtgatgtggctagctacagatctgtagcccgctgctcctctctcctattttatctccacaaaatatatttatagctagtttataatctgctattgtacccgctctaaagctcaacatgcaaagatatcacattatcatccattagtaattgttacatcttaaacctcatacaaacatgctcttatctatattttattatattttaaagctttttaaatagaaccatgttaaatcatcatccgatgtaagttacataatatttcaacatatatttctccatcattttctacaatatcctagttcttcttcatttagttaatgttttctatcttctcattagaccatatatcacctaaattatttctagcctttagatgattaatctatagtccaaattttatccctcatttgcttcccacatgaagccacaccacctttcttttacttttaaattatcaatcaatattctactttaattattctaaaccaaatcaattctatggttcatagtcttttccaattatcgatcaaaaatataaattctataagcttaaggcatctcgctatgttacacgttatttctactactatcatactaaactcccgcagcaacgtgcggagtttcatctagttaactaggggatcgagaacgtcatccgacaagtctaaatgaagtttttctcaaaaggacaaaaatcattacaattaataaatattaactaagtagaattttctacagtacattgaagttttgtagaatttgttgtacatcactcaattacaaaacacctcataggtaccggctcatatgtaccaatttatttaaaaccgacaactattacctttttcacctctataggacgaaaaatttggataaaaaccggacatatacttatattatagatatcggttcaagataaaaactggtacttatagttttgttatcgatattttttttttaaaaaaagacaataccaatagtaagctatatgtgctggtttctaaaaaatcagcatccgagccgagccacccacgactccaccttatccactcccctcgcccaccccatcccccttctctctcatgcactcctctccatctgcccctcctctcctcctcctctccgtccttctcctatgcatcctagctccttccccctcgtcgtcgctagagcgtgtatgacattttggcgatgctggcgcgggatggcgcccttgaagttgttgtagaggaagtcgagcacaatggtgcggaagtggcggacgaggcggttgttgctgtggtcgagctcgtggaggcagtggagggtggcagaagcgggtggagttgaggtggagcagcgcgatgtcggatagcaactcgagctcgacggggaggtaatccacgatgtcgctgaccttcccagccgcagttgtcggggagcagcacataggaaacaccagtgtagccgcacacgtcaaggccaacctagtcggcagtgaggttcttggggtcggagaagatggttcttgtagccaaccagcacatgtttccaatctccatgtggcagcaaggaaggcgacggtggggctgctctctccctccggatctggacgagactgctcgcggtgcagcgacggcaccagaggaggcggaaacccgcatggaaggaggagacggagctggtggcagtagagatggcggcaacagaagtgggggttcgagttcatgacaggatatagagagtccatgtctggtggtggctccaggaggcgggcgggactgtggcggccgtcggcatcatggcgataggtgacctgtgcataggttcagcagtgacttggttgtggccctccctcctcctctccttccacctttccccttctcctgatccgacagcggtggtggagaaggctggcacagagggcgaggtggtggctggtggccgcgaaggaggtggaggtgttggccgtcgcactcctctccacgccgccagccatcggatccagtgacagtggctccatcgggctcttttttattatttcattgaatactgtaggtgccggttggaaagggatcctctgacataaagttatccctgacgtggtcactgacatgtggacccgctagtggtgtagcccacatgtcattcaccacgttcctctgactttacgtcagaggatctcaatccggtgccggttgtggggtgcggtcttggatatatttcattgaatattgcagatgaaacattatattcaattgcagtggatgcacactttttgggtacaatataaatatactggtagtatatactgtcattataacaagggcaatttagaaatataccacaaacttaaaaattggatcaagcaagaaaaacgcttcactatacaccgagaatttacgtaagtgccactgcccaatagtatataaagacaattttactcgctttaagttcatactgtaatatatttaaataagtcagcaaattaatctaaacccttaatcaattatactggctgtttatattactagaatattctaccacaaaaattctcttgattttcgttctatagctataattaattattttaatatcccaaattttgggctatatatctgcttgaaatatgagaattgagtcatttgagaaagtttatatactagcagtgacggtggttttgctttcatcggtaaagcaaataattgaacagctgcaacagttcattcacctggatatatcgacataactgttatacggatatatccttacactgaatttcacgcgagactctaaaaaccaggcttctagtccttcgaatcatcaggatgaagctaacagccatcatcgatgcttcccatactgacttgtatcctgtgcttcacatactgacttgtattttgttcttcacatatatatactgactgagctacattgtcggttgcaaccttgcatcgaactcccggtgcatcccctttctactggacatcattgtcgactacaacggttacccacatctcaatcgggcggcaacccccatctagcctcagacttgcagatgttggcccatcaccatcctcatacccctataagaatttgacgacagatatgtaagacacagctcgtgttttctttccaggggctatatacactgataccgatcgattgttgttcatattggagtgcttgctagttcatatcgatgcttgaatatatagcagagccacatcaacgttagactatgtactcctacatgaattcacaaggagtgaaaaaactggaccaatttggtataattcaggaggacctgactgtcattcaagttagtacttgttgaatggagcctactacgtactctggtatctcatcattggtcaccatccgtttctgctgtgagcttcaggcatatgaatcacgtttgatttttctatcatcactactgcaaaatcgattcttcctaacggtcagtttacgttttttacgatagctggtgctgccgccagcgactaaaggctagtgaaaatcagctatcttcacaaacggaacttcaccgcaagcggcgaggttaagctgaccactagaaaaaatgattttcaagaaaaaaaaatctccacattcgccacccatgctcgagcttctatgccgaatgcactgcccatgccctgagtcctcgccaaatctgccgctcgcttcccacgactgagctacaccaattgtggtatcctcacaacctcgagcctccggatccaccgcctgggccccaagccaccacctacacctttgccagatctaggagagggagggtgctagcggagccactgaaaccttgttgagacccagctatcgttgtcgtcatggcagccaatgtcatcatcacgatagtcgttgttgtcattgtggttgctgccgctagatccacttcctccacaaccacctcttttccttcaccattgtggaggcggatcgaccggtctggagcaccgcaagccactggatccatcccctccatcgtcactgctgctgaccactgcccgcgcgccctcccgggtgtggattggcagcccgtgcccctcacgtcatcgtcccaatcatcgccatcaccatcaccgtcgagaggaggaggggctgagggcacaggagggggtgagatgggaagagtggtggagtctgagtgagagtgggggcggaattttaatatagctatttttttggcagtcggtgctccttaggcatcaccagcgaaaatatttcgctggctgtcacttatgagatccacatgcaaaagtagtttttcaaatggatctcttaagtggcagccagcaaaaattttgtgaccaggagtccctctcaagtatcttttacaagcatgtgttcattaaacccacgagtaaaaaaaataaaagggtagtgctatccgaaatgtttttttagttgtgcatgcgatagagtggaatggaatggtggcacactttctaagatcctaaatgatgtgaattttgcaaatagtttctacatatgaaattcttataatactttttaaaattcattctttaactttttatagttaattcattcatttgtagcctcaggtaattattacaaaggaataactctacttcaccccctaaagtatcggggttggtctacttaaccccctaaagtacgaaaccagatattctaccccttgaagcgtgaaaatcggttcaaataaccccctaaagtagtttgtaggtagttttgccatgtaaatgattacatggcagcggtattggcttgcatgacacaaagattagtccagtaaacccaagttgatctaactattgcttcttactcattgatcgggaagcctaaaaaatattactccatctatcctataatataagaaatggtcaaacttggtacgattgacttataatttttcatgtgttataagatttattatgcaacaaaattataatcatatgaaagtaaattcaaatgtcaatccaatgataacattctcaacaaataaaatttaattcatattatactaattattggtcaaatatcttagaagttgaatcttgaaatgcttgtgcgcctcatattatgggttggagggagtatatattaacactaatttacaatcactctcagcctgtttcacttgtgaataaaatgcttagcatgttacaatagtctcctctatagtccaagaggccaaaaccattgccatatcatcgtgtacacagcaaaaacacatataaaaccactaaaaaacactgatgttgtataataaacacataccaaaaaccaaaaagataaccattaaaaataaaaaaacaacttaacccttgttttgatactttaggaggcagaatatccggtttcgtacttctgtaggttatgtagaccagcctcaataattcgggggtgaagtagaccttttccttattacaaatcatttatctattcagagggaagttggcgataagtatcaaatgtcggatgataaaattgctcttattgttttatggaacgaaacccacgactctaacggcgggtgttaattccggaacaaaggccatcaacagcggttaattctaattaactctgacggcatgtcttcatccccttcctccagccgagatagaagactaatcctctattctttctcctctgtttctcttggtacataacactactctgctctgagttgcttcataattcacagtcctcagtacctgtggacattggtattctagatgagcagacctccagaactccgtccatcagagtagctggcaatcaaatttccggtcgaggagcgtggttcttcacgcgactactgtctgcttcctttgcatcaacgtctctacttccgctgcatcaatgtctgcttcctctacatcaatgtggaacgattttattaactataccgattaaggactagattttcaacatggtcgatgatgctaacacagcgggatgtatcagaacgagtaaccccctgacactggtgatttcatggtcgatgatttcatgaaagatgattttccttacagttttcctttacaactaaaaatacatgtgcagagtttttctctttacattctcgaagatatcacgaaatggggtatctcctaacttgtgttaaacatgatgtatatttgtacctcttcctcgtaataattctagacatggacagtaaaaaaatttcacgatgtactgtatttgattcagatactattgagtgaaaattaattaggcccaaataaattgggcagagtaaatcacgtatctcgatcaatgcaatcttatgtgctctgctcccaaatcgtctgatcgagtgcatatccccaccgaagtactggatgtttgacagcccatgaccaaaaatgtcttgtcgataagcagtttgtgttgaggctagctggctactagctcatcgatgatcacttcaactgccgataagacaatgcactagacacttggtgctgaattcccaatgcctctatttcatagcggaattcgtcacatctgacttgtaatgacaattgccattgcctttttgaggtaagagtcctatttgttgcagtgatgggcatatcttaggctctgatgcaaaatgagagagcgatgttgattgtaagatttattttaccattcttaaaagagcaagtttacggtccttgatgtacataccaagagaagtatcatattttccagtataaaagtttgatacatctagatactaaatatctcaaagtaccagaaaatttagtgtaaaaattgaagtacctcgatacacattctctataatggtaaaatttctcttattgtgacatgttactgcagttaccgtggactgtgcttgcagggaaaattaaagtcaatattaggggaagctgatcgtgctgaactactgcatcgattgtcgcatttatacaccgcgcttctataattcatataaagttacaacccacgaattcatccatcttttttacgtatttaacatatacttttacatttatcccgcagcaaagctccagacaaattcgtggacgaatcctgcgtagccggcgccatgttgtagacgactgtgtggccaggcattcctgggtcttgccgcgcgcatcgcgatatacccgtcattcagtcgccttgcacctaaaatcggcagatggtgactgagatacacgcttgcaacctcgcactaaactcatggtgcctctctttcccattattggacatgattgttcatctagtgtgtgttgctgaattgtaggcatgcatttgaccaattattgatctgcatgccccccccccccccccccaataagggcctgtttagttggggaaaaaaaaattttaggtgtcacatcggacgtttgaccgaatgtcggcaggggttttcggatacaaatgagaaaactaatttcataactcgcctgaaaaccgcgagacaaatcttttgagcctgattaatctgtcattagcacatgtgggttactgtagtacttatggctaatcatggactaattaggctcaaaagattcgtctcgcgatttccttcctaaatgtgcaattagtttttgcttttatttatatttaatgctctatgcatgtgtccaaacatttgatatgatgtttttgacaaaaaaaaattgtgaactaaacatgccctaatgtgatgagagaaatggatgatgcagcttctgtttttattttttctcaagggactgtacactggtactgattcttttatatatcggtatgaactttctctagttggtaaggatgcttgaatagcagtggcagagccgcatcaaggttagaagccaaaacggtgcttattagaaaataaaaaaatatctattggtaaaacttttatatatttgtttgtagcgactttaaagccaatgctaaaaattacattgaaaatatctcaaaatcaagttcgaaaattcaaattttagcttttgctttggcttattatactaactgatagggctcataggtcaaggtcttttaaggtactccaacttacctttacggaacctatatatggagataaaagatattcacaaatcttgattatttaggaattgttttgtgtcgtaaaatatatttttgcacattatttatctttccaagcttatttttgcatgcatggagccttgaaaaaaattaatgcacgcagccctgaaaagtgtctagaacagaaattttacttgaaatatattagcaatgttgtttccaaaacacaattttaaagaaaaactataaattagaaatttgaagtgtttcatatgtttataaaaattacttaaaatttcataaaaatgaaacaaaaaggttcaactgattttaagtatgaactttgatatttaaatattatcctacaaataaacaaatatatcacgtacaaaagttaaaatttgctgatgccgttcaccgtataattcaagatatgctttgatgttaatacaaatatgattgtagaaagggaaatattattgtaatttgaatttcaaatatgataagaaagattagttctgttacgttattgccttaaaaacaaccatatccatgacgcatgataataaacagaaactgaagataatattcttgtttccttttttgagatgtgggatatcaagcattggatcaatatgaaatgaatggaactaataggaagtcacatggagcgaaaaaaagcccgtgaaaaaacatggccacatgactgttttagtttttgcattggagtgccctgcgtaagcttcaggcccattcgatctgatcaccaattacaatatttctggtgctgcgccctgggtcgttggaggcttgatgcaggactgaattgccgtgcggacgtcatatatccttttttttttttaagaattaccccgtacaacatatacactcacaatgcacgcacactcatccctattaacacacgcatgcaaaccctacccctatgagcatcttcgaagactgggccggcaaatccatcctggagattgacgaagtcaccacaggcacctcactgtcgacgggtacgtcgcctatcactgaaaacacaaagccattaaatcctgaaaaattcactcccataaggacactagtaaaaaacctctataggtgccggttgggaactggctataggtaccagtttcacagccagcacctattggtcgacacctttgtctcaattttattggtgccagttctaaaaccggcacctatattattaaaaaaataaaaaaaagatgacaccaacactgccgccggcctcctccaccggtgccaccaccacctcgctgggcctccacgctagcacctagccgtgcccgcctccgcgccgccacctcaccgggccggcctccgcactggtggccaccacccaacgccacgctggaggggggaggtcctccaggagagagggggctggccagatccaggcctcctccaccaccgccaccccagcgtcagttgccgcgccagtcgcgcccgcgcccgcgccacgccgcccttgatttggagagaagagggagggcccccggtccggcagaggaccgccgcgccagccgcgggagaggaccgcagtggcacaagaggcactagcttgacttcctgctgcctccatttcctatgtaccgagctatactagcttccactgccatgactacttgctctcttcattcacatatgacatatctcatttttttttctgtcgtcacgcaatttgatctttaagaggggggatgatgaagttttgtgttgcatggccactgctgtgataaatgttgatacaaatatatatgtttgctatttaatatcactggaagtagatgggcatatatggggaatatatatgaacatgtacaaattaatatccaccagctggatgcacgagaaattaagcagtaaaaactaaatgtatgaaagcaagctatccacttagagagtaacacaactacgcagtcagaaacgaacatcttggcctggagagcgaagagtacggcctgaaacattgttcacataaacaggccatctgttttcatcgaataaaatctgctaacaaatcagattaggaacttaatttatttccctcagagaatacgactcataaaaaaccagcctatctattttacgcgaaagaattcaacccacgaataaatccaacttacgttacttttagaataagaattttgtgcttaaaaattataagcggaagaaaagtccatgctttttgggccgagctaatttcttccgaggaagttagcacatcaatcggccctcctcatatgcaaaataatttagctgaataaatttagcccacctcattttcgtgaatgaaatcatctgacgaataaaatatgccgattgtatattatacagtacttccttcgttacagaataagtttattttttttctcttcctatttatcctaaaataagatcatttttaagtaatcatttaatcggggttaattatcaaagtcaaaatgtggaataattacaacgagatttcataaagtgtggttataataatctttttggttttctactggtatgtgtaggataagtgaaaaataaatctattttgggatgaagggaatgtcacctatacatgcaaattttttcctcaaaagctgaaagtagaaataccatacactgtaataaccccccccccccaccctcataattttagtaaaaagttaaaagagttcgggtctaccttaacatcaatagcaaaataaaaattttaaaaaaataaaaacaagccgcggaaaatagggtaaatgcggataccatccaaactgaaggagggccaggtctcaagctagctgacctacacaaccaaaggccagataattaaactgaaaactcagctaagaaacagaaatcaacaatcgacaacattctcaactcacaccacatatatactacgtgcctacgtcagttcgtcgcaaagagccattcaccacaatttctctgatccaaatcaatttgcatcacggcgcatatgtagaaccccgttcagttgactacaatagtaagccaaacgaatgcagcgttgtgtgccgcaatgtacgtacagccatgtgtatttgcttgacctggttagggccatggtttgaaatttcagaaatttcgtttatttcaagcccccaccggcaaaaacacatgtttcgaaattgcaaaccctgaggcaggctgagatgtgtgatctcaaagctctagagcaaagcttggcagcactgccactctgcctcaatcggtacgaaacgtcgcaacaaagcacagagatgttgcatgggaaccatatctgctactctcacctcttgttctcgcaaacccagtgtattgttgttgttttctcaagagggagtagagatgtacaatttaactccgatgcgcactccagcttatgactagttttccgatgcctccttttcctatagaagtctgtggcacttcatcatccttttcgattaacttacattgaaattcgtaacagatgaacatgtatggtggggatgaacatgttgcatgggtttttgcctcctttgcaatatagtatataaaagatatgccgcatgtatgttttatggtaagaccagcacctacaggtattacaagtcctggttcttgacaaaggtgttggttctaaaactggcacctataactttcggcattggtaccacaaaattgataccgattggtaaaccggcagctaaagccggttcctaaccggtactaatatgatgttatgtactagtggtaggtgcagcagatcaagatgcgcttctatttgcatttttactattgctagattagttaatttattcatatagagtgagaccactcacctctttttttcaagtcattcaaatgataatgaaaaaattatgaaatagaacaatatgtgattaccacttcataaatttgcgagtttaaattcgacaaaattaaaaaaataaataaaccctaacaaatatgtgcactattaacaataatatttaacatttaaatttccatgtttatggagtgatactccaaaaatctgtaattaatataagtaaaattactggttattttagagagattaagtatgatgagaaaaatacttgagtacccctctttcaaccatggatggtggagggtaagattgaagaaatttgatgagaggtgagtttgatagaataagtaagcacatgatgttgtctccacaccgtcgtttaccgcttcacatatctagctgtcacaaatgcattttgattagttattctgattaaaccaacccatccaacaatattggcatatgcctatgcctatgccgtctaaaaaccacaactgatttcaaggctcctacttcaccacccatgcatcttctccgaggttggccgcttgcgtgctcgttcttgtcagcggcgaggccattacaagcagccgaattcgaagagcctggaatcatgcctccgctaggcgctaagtccagttggaagtagaattctgtcagttgatcagttattcagattagaccaacacttctcgtgtactctacgctcgtcttccctctacagatcccattccttgaaattgtattcccggtgcctccctttccctatgcatttgacgatttaaggagcttgtttaatttgtgtctggatcatctacaattcctttggaatgggaggaattcaactaaaaaaacatcaatccgagagggttttggtgttctttggttcaccaaacaattcctatgtacatcgtgtatccagatcggaccttctcttctgaccaaattttgttgagacttctatatatcatagatgaaccacctacgcatatctatatctataactaatataaatattcgtatttttccggtcgtcacacctaattttcgtctgtttttcgtccatacacaatcctattcggttagcaatagcgatagaaaaaattgcaaaaaaaaaaccactaccgccggaggagaagagaggcggcggagggagcgccgctgccggatccgcccgcggtggccgccaccgccgacggatccaccctcagacgaagccgacgccgtcgtcgccgtcgacgccaccgtcgctgtcgacgccgacggggagagggagagggagagggggagggacggccgtctccgccacaccccgccgtcgctgcgccatgccggcgagacgctagcgtggggaaagccgccgccacagcccgccgtcaccgcgccgtgccggcgagaagggagggagaagggaagagaagcggcgccggtggtgggagaggcggccagctggggggagggggagcggcgggaaatggggagagggagcggcgccgccggaggggaggagaggggagcggcgccggtagggagagggggagggggagaggcggcatccgtagtgggggaggcacgtccaccggctgggggggagggggtgggga

SEQ ID NO: 81965 - DNA, 21828 bp, Oryza sativa
gggggaggggggggagaaaagacttttttgggtttttctttttacaaaaccattttaactttgtttatttcttcttaattatcatttgtgctctgaaaattccactaaaatttatttacgcattttaggcttttaggaaatgtacaaaaatcctccaagccttatttgacttttaactttgcacattttaattgttggaggctttcacacggattttaattattctaggcataattacgaggatgtattttagagtcgttttgggacgcgacaagttcgaggccgcgatacgccggcggatcgaggtcctcaatcgcaaccaatgcgagcaggaggggtgcggtcgggcacaggcgcaacgggcccagaagctggaggagcgggctcgagcgctcgaggagcgggcgcgtgcgttggaccagcgcgagactaccttggccgcccacgaggcaacggcggccgagcggaatccaccctttgcctccgcgaggaggccttggccgaacgcaaccggaccaccctcgccgtcgaggctttagtggcccgtcgcgcggaggagttgcggctctgagaggaagcgtggcgggaacgagatgaaccgctggcgggatggcggcgcgccggctaggcgagcagctcaccaagtgtgaggaggccgttgctaggcgtgagacccgccatctggaaagcgcccgtactgaacgcgcggcgatggcggcgagggtgtccgagctgggggccagggagaaggaactggcagcgcgcgggcagcccggcgacgccgagttggtcagccaactcaccgcggcccaagatactcttgccaatctggggcgcctggtacaggaccaggctggggagatcgcggccctccgcctcaccaacgacaccgggcccggccaactctacgatgccatcgaatggctggagcacgcaggacgccgtgtgggcatctccatgcgccgggacaagaagctctcgcccaccaggccggcgctcgcacttcggctggacgagatggcggcggacctggagaggctggagaaggaggtcggcgatgctgtgaagtcgtcgtcggtttccttggcgcgggctgcggtggagcttgtcctcatgagtcatcaagctccttgtgacctcggtttccttccgtggtgcgcgctcgaggatttccccctggggactgaggcgaggacttgggagcaggttcgggatgcggccgacgcgatcatctcaagcttcgagaggacggcccctcggttcaacctcgcgcttccctcagacgaggagagcgggagcgacgacggcggtggcgatgacggcgacgaggattggggcaaggtggtcagcggcgccggactcggaggcgggggcactccatgactacccccgcctcttctcctttattttgttatgtgcttgtggcgaacgcttgaaactctaggccatcgtgccatcctggttgtaaataaagcttcccccttgcacctttacattcttgctttctcttctgaatgtctgtggcaaggaaaaaaccaaggcgaacgcatttagttgacttctttacgatcaggttgccgtttttactccctttgtccccccccctcgggctcgttctggtaaaaaggggggaattcgcacttggtctgcggcacctaggtggtgaggggcaaggccgtcgctccgggggagccacccagcaggactagccagaccaggactacgatgactgggggtcggggatggccatgtgtaggccctttgagcccctagggttcgccgcagcccgaggcgtggcccgcgttcaggctccccttcggtgattttcaggttacccgacaccacttagggtttggagcaagcacgaatcatccctaagccaggacgagccataggaaggagcaaaaaagggcgtgcaacagcttttgattaagcagaaagatttattgctgaggaaggaagtggatacaacatatttaacagtggtagccaccggccaagcccgcacaggtcgagggatgtgcgggggttgtcccgagccctaagaaagcaaaaaacgcgcgacattatgagtagaaacggcggagatgctcgatattccaggggttaggcaactttgtgccgtcctccgtggctagttgaactgagcccggctgggggacaccaatcactttgtatggcccttcccacagtggtgagagcttgctcagccctaagcgcgactgtatgcggcgtaggacgaggtcgccgacttgtagtgatcaggtccagacgtggtgccgatggtagggccgcaagctttgctggtagcgcgccactcgcagggccgcgcaccttctctgtccttccaaatagttgaggtcatcgcggcggaggtcatcctggttggcctcattgtacagcgcgacgcgaggcgaacgcagggaaagctccgagggtaggaccgcctcggcgccgtacaccaggaaaaaaggcatttcccccgtagcgcggctcggggtggtccgatttgcccacatcaccgcgggtagctcctcgagccaagaatccccgtgcttcttcaggatgttgtacgtcttggtcttgaggcctttgaggatttcaacattggcccgctcgacttggccgttgctcttggggtgggtgggcaaggcgaagcacagcttgatgcccatgtcgtcgcagtagtcgccaaacagctcattggtgaactgggtgtcgttgtttgtaatgatacggttgggtactccgaaccgggatgtgatgcccctgttgaacttgagggcggaatgcttgtcgatcttgacgaccgggtaagcctcgggccacttggtgaacttgtcgatggtgacgtataggtgctggtatccgccgtgggccgctttgaagggccctaggatatccagaccccagaccgcgaagggctaagagagcgggatgacctgcaaggcctgggatggctggtgggtttgtttggcgtcgaatttgcacaccttgcatcgccggacccattcttgggcgtcttgcaacgcggtcggccagtaaaagccttgtcggaaggctttaccaaccgacgtgagtgaagctgaatgagccctgcactcaaaatggtgggcatcggcaatgagctcgatgccttgctcccgagagatgcatttcaagaggatcccgttggtagcacgccggtagagggtcccttctacgagcacgtactgcttagagatgcgcacaagcttctcagcttctgcgcgatcctcaggaagagtgttatcgtcgaggtacgcccggatgtcagtcatccaaacgacctgacgaggggggtcggggtcgaccccctcgggccccgaggcctgtggctcgccaggcatcggggcgaggaccgtggcgccaggctccctcagggggtccaactgcgccgacgactgcaggagcctttcctcgaaggcccctgggggagtggggctcgtgccaacgcgatgcgcgacaaatcgtcggcaattgcgttgtcgtgccggggtacgtgcctgagctcgagtccatcaaagttggggcgaaaattcaggggccaccggacgttccagagacttgccacgaaggccctgcaaccggtccctccaggggtgaacgcggggggcgggccgcctcgtgtggaggagcgcgacactccggatgaggaggcgccctcccccatgcgggcagcactgcgctcgtccctgcgtcgctcgatgttgattcgagcattgctcggcgggcgggccgtcatgacgtgtggaggagcgcgacactccggatgaggaggcgccctcccccatgcgggcagcactgcgctcgtccctgcgtcgctcgatgttgattcgagcatcctgctcctcgtagaggccgtcatgacgcctccagcttctcgagacccttgacgacgtcggggccgtcgatcgccacaaagtctgggctgaccgacggtccctcctccttgctgatgaggaaagggcggtgggggtacgcgaggtaccagtggcggcgggccggccacccgcagccagctgttgctgggcagtggtgaccaggttggccacgtcgtccaaccatcgctggacaggagtctccggcgccgagtttacggggggttgctgtagaagggctcccgccgcttgaagtgcgcctcggggcgagccgccgtcaccgtacgtcaggcggcatcgtgccccgacgctgcgcggtttcccctcgcccggcggcggggagagggccgagccacccgaccaggtgggatcctccctccgtggggggtcgcggtggggaggagtcggagagttgtggcggcggtggcgggggccgcggctcccgctggcatcctcactcccggagggagtgggggtgtgcgccaccacttcttcctccaagacctcgaccatgatcgttgaggacaaagagaaacttggggtggaaggaaacaacttctttctcaaacgcgcgaattccccctacctggcgcgccagctgtcgaggaatgatcctctctagcgggtgatcgtgagaccccccttttgtgagttcggccgggggaaagggcgcgttgatcaagagtgtatgtccgcctagagtcttccgagaccgcgcgtgagagctgggattatacaggttcgggccgctacggagcgtaataccctactcctgtgcatgggatttaggatggagtgttacaaaggttcctaaactccagggagaactctaactcttcttggtggagctcaggctaactgagagtcgtcccctcctcttggtggggaaggtcctccttttatagttcaaggggataccacatgcaccgcctctacctactccttcacgggagggggacccacaccgcctgggtagtactgccattcgtgccttcgcctagaagctaagcaaccgtccgtccttgagtggggcccagcgccgtcccccgcctgacacgggggacgcccttgtcattcccctttaaaagaatggagacttttggcgattcacctcaaatagagggagctcctgacggtacattgatgggatgaagcatacctgcccccacttcgccgagcacagggcggaacgtgggggcaccgccgcccgtccgatcggatgtgaccggtcacaatccggtcatgcccgattgacgcaggtcaatcgggcagcgccgcacgtccgccctcaccgcattaaatgtggcgaggggcggttggggcaccgcgcattgatggcggtccagcttcgaccaccacctcactcactcccccaccacgtggcggccgggcgagggcctcagggcgaggcaacctgtcacacccagaaattctcgaaccagaatttctaagctgaatgtgcattaaatccctgtccaggaccagccaggatacacaaacgacaattgttgacatacagacccacatcttacaaaaatataaaagattacaaatgtagcgggaaagattaaagcgagctaaaccgggaagcttgacttcagcagcgggcgactccactccacaagcaaaccttgacggcagcaacgaaaccaacctctctgagacgactccaactgagaagaacttcatctctggtgtgggggaaaagagagcaagactgagtactacccactgtactcagcaagtcataccggaagaggaggtatgatgcaggatataaccaaaggaagctaggggttcttttgcataaagcaggcatttcaaaacagtagttgaaagcagtaaaacaactgtagaaattaagcaatattaaccaatcactatccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgccaagggggaaatcgtgacaagaccctccacataaccctcccctaaccatccacaccacgctaaggtttcacccccaccccttaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcacccatagcccaccattcagtgtattttaattaattaacacccttgcggtggcaccaatctaaagctatgccaatagacaaagtctatgtaataatgtgatccctttttgtgtactagtggagctaagcatggctaagcatttcctaaaccaacatctaatcattttgatacccaggttatcaatggcatatggtaaacaataaatggctgagtaataggacccatcccacatgacattgtaaaagaatgcaacatttaatagaaatgcagggtgtttgtaaattgggtacaatatgatcaaatgtaaagcatgacttgccttgctctcgcactgatgagaccacagcaacgtcttcgagaaaccgcggatcgacgaaacggccgaaatctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataatacccagggctgacgtcagcgaaggggggggcggcgccgacaggtgggccccgcttgtcagcgcacaaggggagggagagggggctcgggcaagtgggccccactggcagcggcacaaggtggccggtctaccatggaccgggaccacacgggtggtccaccgccggtccacgggactgacggtccggatcggcctcaaagacgatcggacggcgcggggaaggcggctaggcacggctcggctcggcttcaaagccgaccggcagccatggcggccggtggcgacacgcgcggtcaccggcggtgaccggcggcggcgcgcgagagccggcaatggcaggcgacggtgcgggaggcggcggcggacgacgcacaggccggcggcggcggacgaaggcgatggcgagcgcagggagcggtagcgcgtgcgggacagagggaaggagggaggagaggagctcctcaccgtgagcacggcggccggcgcgaagaatgaacacggcggcgatgaccggcgatgcggaggcacggacgggcggtggcgacaccctagagaagatggagaggcgttaggagaggggacgacgaccacggcggcttgaattgccggccggagatggaggggagggaaaaactcaccggctcgcgaggggagaggcgctccggtgggattccggcgacgcgaggcggcggccgggaaagctcttgcggcggcgaagctaacggcggcggcggtttggcgcggcggcgactctagcagtggcggcgcgcggccgaaggcggcgacaagcggcggagctcgggtgtcacggcgcgggcgcggtagggggcgtgggagacgacggcaaatggggaaaacgagggaggggactcgggggagggtttttataggtgcgggagggggcggacgtggccggagaggtggccgatttggccggcaacgtgggggtggagagagagagaatggagggattcaaattcgaatcccgccccttgcgagcgcgcgcgagggccgggagatgggggggagagggcggcgacgtggggaggacgcgggagcggcgcggcgtgggcgcgggaggagcggaggaggcagcggcgcggcggtttcggcggcagcggttggagcttcggctccagcggccggaggtgggagacgaccgacaggtggggcccacttgtcggcgtcccgagagaggagggaggggcggcttgggccggcccacaaggaggaggggccgcgggagagggatgggccgacggcccaacgaagaaaaaggagggaaaagaaaagaaaaagagaaaaaggattttcctgggatttaaaattgcactttggtgatttttaattggttaaaattatttccaaggctctgaaaattccactaaaaatcttgttaatgcattggagcacggggaactcaagaaaaattccaccacgctatttccgattattaattgcatttattaactagggatttagctctaggttaattaagataatttcttcgggcaatttatttaaccaatttttaaagcaagaaaagggggggaaacttcagggtgtgacacaacccgagggcacgaggggcgcgacgtggcaccccgagtccccctggctgcctcaacgttgtccgaggtgcggggggagggcaaggctgcatggccgcgtggatggacgggaaggagacttccctacacttcgtatacccccgggcccatatcactgacaatatgtgacagtaatgttattcttattttatctataatttactcttttatctatatttgatcatgtttctacaacagtgaaactggtgtgtcgaagatacaattttctctcctaaacttttctactttcttgcagtcttcaattgattctaagttctttaccctaatttgttgtttatagtgatatcactatgtcaaatgaatcgtgttaggatgcaatagatttatggaaaataagtagactattaatgtgttgtatgctgcaaacagactgccctcgctagtgcaaagtacctcatagggctgatgttattaagactgtgtaaaaggttgctgcagtttgtgatgacctccattgtaccacattgtctaagggatctgatgatagcagcaacatcaatgaagccgtggaaatgagcaatggcaggaccttttgttgtttttgctgttgctactactgctacaactaccctgccatggtgttaacgccaaaatttagtaagccccgaggtcatcatcggcttagcaaccatattggcttcagagtcctggaattggccaatgagaattgtcactcgtcggcagtcagattcttagtggattcggttaagaaaattaatcaattaaatgaagcttatccagaaaaagttgagttcaaggaggatgcgacatgacaatttatctattaattaggaagagttagttagtttccttttatttttacgaaagtgtgtttagtgtctttaggacttgtatcttttcttttctctttagaaaagtttatgtcttgtccaataaggactagtatctacccatgggtatagatatgtacacatggggtctttgtaatctatctccatagatcaatacaatatattttcggcacatcgccacccttttactttcaacgagttcttgtttcgagttgggttgcatcggttttgatctcagacaaggggtaaagcttgtcatggcggcttgtatcggcgggattagggcttacattattttgacactctaatctagctaatgcatctgcctatttatcatatgtcttagttaatccaaatcgatgatttaattacctgtatcgaccagatcttttctagggttttgctggtatcgacaaaattgtttcatcgatttagattaggtaaggtatccaccaccctgaaaatcagttaaaggcttgattgtttagactttatgcttcttttcacacttcctgcttgttaacagtgaaatttggtaagcctcgaagtcatcatcggcctagagtcaatatccgcttcagagtcctggaatcggcctatgggaattatcaagtcgccaatagttgaattcttagtagattcggttaaggaaattaatttattaaaggaagtttatctagaagtgaccgagttcaaggtggatacggcatgacagtttatctattaattaggaagagtttgctagtttccttttatctttagaaaagtatgtttagtgttcgataaggactttatgttttccttttatctttagaaaagtttctttcttgtccaataaggactagtatctacgcatgagtacaaatatgtacacctggggtcattgtaaactatctcatagatcaatactactcttggcgcatcgccaccctcttttctcgagttttttacttatcacaaccgaacttggcacctgacgcagggttgcatcggctttcaatctccggcgaagaggtaagtcctacgttccgccagcccaagcaattatacctaccggctacgttggtgttgttcaaggctgtattgcttcgatctcttggatcgctctagtttggttgatatatttgcctacctatttattatatatcttagttaatctagtttggtagctcaatttacttgtatcggctgggatctactttagggttttttgccagtattggctaaatcgctttactagattagattaattaatgtatccataaccctgaaaattagtcaaaggcttgattgtttagactgtatgtttctttgcatactttgcgatgcatcatccctagttgtgcttagaaccataaaagctaacctgtctttgattataataagggtttcatcggcgtttcagccgatgagttatctggacgttgcatcggcttacaaggattacatacaagttggaattagccgattacaacaaagatttcactgtgtatctaatcatttggatttaatgctatcggacttccagcctctcagggttatggataccacatacataatagtagttgactaaatctcggcaggacccaccacataccatgttttatacggaaactgacttcggatatggagggagttccggataaggaaagacaaccagagttctatatggaaacgacaaggactactcagattgtatccatattggtttccctagttcaacttggataatgggacacctatgggtataaatacaaaacccctaggaggagagaggagacgatcaacacccaccacaatagacggaacaacagaagccacaacacacaagccaacatatgccaagacaagacgccggatatcgacttcagggataagtacggctagtcccatacggtgtctccggatactgtcaggggagacgaaagcgctatctctgatcttgtcgggcacggattcgaggaggaagactaccctgttgtcgactacgagtcagaccttcagactgccatgtcgacaacagttagataggctaccccaaatattgtactggtgtgattatggtgaataagagcaacaaccggcttcggccaacaggatgtagggttattacctgacaactcaggggcccgaacctgtataaaaatcctcgtccccgtctcttttacctcagtctcgcgtatatcctagcaccgacgatccccatactatacaaataccggaatcgcaacatcaaacgtcgacacagccgatgtatgatttaaccatcggatcacatattctatgatattattgtcagccgattgatttacattggattatattgttattttattatcatcagccgattgtctatatatcgatatttactcaagtatcagactctgcattgaacatatagccgattattcaaaaccctatcgacatcagctagtatcggcatcggctggaattactctatcggcttgttagccgatcgactttttgatctattgtctacatatcttgtcagttgcaggattaaactaactggcacgctcgcatcccatcaagatttaggacctgcattggagctaagcagacatcccagtccttcgtgttgttttccacgtcaacacatggtacttcaaagtaaaaaaaaatgaagtgtttgaacctgttaagaatgtcaccaatacactcgtcaagctgtttgaaagcaaaacatcaaatttcatatgttcaagccagagaactacaccacataccacagtatcctatatagcatttaacatttccgtttcactcctagttaaagaaatggtgaaaagggctttgaccacttatattctactatatttcttttattatagttgattaacttattctactatatttttattcatttcactccaagtaaaataaatggttaaaggggctttgaccacttaaataaattcgtcgtaacctgtgtttttatcacaaaacatgtcagtgttttatcaaatacaaacaaaaccatgtatacacgagagaatttgttcatctggtagtgtttacacaacacatacacatatactacctctttacttgacattttaaaaattgacatactctccaatagatacgttccatcattagtttttctattaaaaaaatggctgtgaaagtaattttcatgacaaatctgtaaatgtcatcttcacatattaagaacataagcagtattacactatgaactctttggtgatcaataaattcatgtttccttaccagaaaaaaaatcatacaccataatgaatatcttttgtttacttcccaacatgccaaacaacgtatgtgagattttcttccagttgtttttacctttctattgatgcttatacatgcattgtctatttatagtgattctattttactctttagatacaatagtaactatcaaccaaattctctcttcacctcccttatttcactatccctggaggtgcaacaatttttttcttgttggcatcaaaacagtttatactagatgatgccccgcgcgttgctgcggaacttcgtatttagaaatggaggactacatggggaggtcacagatagatgtaatagatagcaatccctttaccataaaataatttatttatcttgtaacaaaatatagttgccatgtctaaataaaccataagagattccttatctcgtaatgggggtttatttatctacaaaaatatagttgccatgtctaaataaaccataagaaaattccctatctcgtaataacattctctttcttgagaatactaaccacttgttagagtggaaatattgtgacgatggaaacaaaataacttgtagaattctggactgaaagaattcatagaactgaagataaatagttgcactaacctgatgaatctcccaatgtttgagagaatgtttaattatgctgtgacaaagaacatcctttatactctagtcataaaaaaaattaaagaattaaattacgtcaaccacaaaattgtatcttataaacctgaatgtcaagtaggaacatcatatagcaaagaacgattagcatggacagatccagggaacaatatgtacctgaattaggttcactgctgaaataatcacggtattgacctttcaatcaatcatagtcaattagtgaaaatctgatagttttgttatggaagaaattacttagcacctcttacaaagcaggtatatatcctaggataggcatataataatatctggaaaagccagtgaccattaaccaatgtgaggcaattacgcattaccgaatatattgttgatattttcttgactgaggagtcatattggtggaagtacatgttgtagttgctgatttgggtgggaatgccctggggattgacctcagccgtagcccatagctgctgctacaatgataataggcaatctactaatagcaatgatctgcaagcggaattcagaaataaaacaaattataggtgcagcaatgatagaaaattggtatgcatacctgtgatcttagcgtcctggtaccatattggctcatctaacaaaatgtaacgatcgaataaatttcaatccgtttgaacagggacggtagatacctaaagaagagcccaaatcaaatcgcttcgataatcttagggacaacaggaacaggtcaatttatcatcaatctagcatgactaacgaaacatagaggtcctctcaaaaaaaaaagaaatatagaggtcaatagattgaatgaacatatgtggttcagaagagtaagaagcatacctaggaatatatacacatgcgatttgttgaatgtgaggaggcgggtgaaggtttgaggggagggagaggcagggagaacaaatcgaacgacagtttccagtgatcgagacatggtaataagaagcaaatagaagaaggcaagtggtttggcggagcttgatgcggatttgccgacaaagaagctgaggagagttgtctccattattgtcttcatgtcagccatcaaggctgctcgttggtggacaccggcgttttccatttcctgtccctgagaagatgagcagcctggggggtggtgcctagccaaggagagggagcggagcagtcgggcgaggaatcgccggggaggaggttggggaaaacgatctattgggcttttgacacatggatatgggcctctcctggatggctcatggctctatcgtttcgcttcgggtcgcttcagcgttggtacgataggcaacatgggtgaccatccagatctgatcaaacggctgtagatcaagtagatgacgtggcttaaccacaactcagaaaattgataataactacactaagtagggatcacttgtatggtattataggatgcatagcctccacgaagctacgatggcaaacactaatacaagaggaaacaaatcgctttagagtatattgatcatcttcaccaactgttacaacacatattatacaagtaactaaaagtcaaaaagataatttaaatatgagtaatgcttacatttaatccatgtcatttgtgaactatgtatcatttacgagagaaacaaattgttgtttcattaaagtagaataccttcaatattttccaagcacttttataaaattatatgctcctcttacatttataatttctggttgaaccttacattctacaagtacaccatagttcaagcaatggttgttatgcattaattctctactagtactaataacttattgttgtaaaaaaagcataatatgtgatgcaagtaggacgacatgcatatttgtatactccctccgttacataaaaaacgaatctaaaaccatatgtgacatattctaatactataaatctggatatatgtatgtccagatttgtagtcctacgatgtgttacatccggtactaggttggtttctttggatgaagggagtatgtgagtatttttcataacaaatttataaatatcattttttacatactaaatattaatgttttattcttttcatgtattaatgatgcatgccatttgtttgcggaaggaaatggtattatacttgatggtttgcaacttcatatgtttccttcaccagacaactctttgcatacatatatagtataccataaggaacatttatgtttattttaccaacatgtcaagtaaagtaggtgataatatcttcgagctgttttctaacatctcttttcttacctatttattcactgtctatttctactgattatgttttagtttctataatgggaactaatggccaaattctctcatcacttcctacatttttttcttcgtgtgccttatttcactaaacaactgcaaaatttctttcctagttagcctccaacaaactgcaatggcaaacactaccacgagaaaaaacacattgctcgaggacatattggtcatcctcgaccaacggtaacatcacatattatattactaaaagtcaaaagattatattgcaaacatctctacaagtaacgcttgcattaaattgtatgggtttaaagcaatgcttcctttgcaagagaaacatatggctatttcggcataaaaaagaatttcatcatctattttccaaacaagtaagaaaataaaattttggtcctcctaactattgcgattagttttagtccaacccaggattatttcactaccactattcaccattgtaaaaatcctatcatatactcatccgttccgaaatataaagtgtttcctgtaaaaaaatataagtatttctagatagattctctacccgacatctattagctttgaaatcattaaaatgatgaaaactatgaaacccaaaaatccttatattttgaataaaaaggtaaaaattacaataatatgccattttttcaaaaaaaaagttaatgcaaaatgtcgaaaaataaccaatgcagaaaacctataaattctatgacgtgtagggtgaaaaggaaaaaaagaagggaaaaactgaatccctctgtccctcccgtctccttgccttggctataaacccccggaaaccacaaggcagagagaaggtccttcccttcccacataggggaaaaaaggggaaaaaaaaaagaaaagagaagaagaaatcctccgaaatggcggcgtccggcgagggggcgtcgctggcgtggcggcgggaggggaggacgggcggcggcggcgggtgagctacttctacgagccgtcgatcggggactactactacgggcaggggcacccgatgaagccccatcgcatccgcatggcgcactcgctggtggtccactacggcctccaccgcctcctcgagctctcccgcccctacccggcctccgacgccgacatccgccgcttccactccgacgactacgtcgccttcctcgcctccgccaccgggaaccccgccctgctcgacgcccgcgccgtcaagcgcttcaacgtcggcgaggactgcccggtcttcgacggcctcttccccttctgccaggcctccgcggggggcagcatcggcgccgccgtcaagctcaaccgcggcgacgccgacatcaccgtcaactgggcggggggcctccaccacgccaagaagggcgaggcctccggcttctgctacgtcaacgacatcgtcctcgccatcctcgagctcctcaagttccacagggtatgcctttgttttgttgggatgcttgccttggttgtgttgtgtacctgtcctgtgatcggaggaggaggaggggcattacgatttggaggtcgttgtctaaatttagatgcgaattggaatggttcccgctgatggacgcgaatatttgagtgcattgggtttgtgtttcggtttagtttttattttttagtgcgtggtgaagaagatgctaagacttggggagggatttggtggtttgacttccaacactgcgaggagaaattactattgttcggatgcctgattaggtgattgtagaaatttaaagggctctatctctttctgtgagtgcatgcacgcgttcatgctcgtgtgtttgtttaatcttgcaataggattccatatttgctttcagtgttaattgtttgttttcattggatttagatatatgaatgatttctatgtttttacctggcccgacatatttgaggaagtttgaaacaaatggtgcattttggggattttgctgagtttttatgagcggaggttgcttatgttactagtgacattatgggcatggttattgtcttaatgttgtccaacattttatttgtgaatgcttagatagttagattgatcaacattaaatacagctggttgagttgtctataaaaatttaaaaatgctttcagaatattataacttggttgggatgtacaaaatatgttcgaacacaaatcagctcaaggctgcatgttagaagccttaacaacacccaaaaaaactgtgtgaccgaataaagtagttatcatcttttcttttataaatcagctttgcagccacattcctagtgattttgcagctaaattttaactagtttgtatatttattgagtgtgtgatattactgttcatatggttactttttctgtcagtaagttgtttatctgatttgattattaggtattggcattagttttaactgaaaagaaggtgacatagatgtgatgtgaaatggttaatatggccaatcttactgggatgtatctttaatggtccattcatccattgttagcaagaatattttttttctgtgatgtgaactaacatgtatatcctaaatggaatttttatatgcatggattgttttggaatatgtggtattgctggtgatatagttgtgttggttactttactgctagacaacattttctttttgatatgcatgcagcattaatctttgtgatttggactttttggaaccatctgttgattgttttctgaccatttatcagtaactcagtccagtattacttcacagatacttcatccagtttgttgctcatatgactggctttaatgtaattattcgcatctatttacaataaatgttgctgctgaaatatcatgatctatatgtgtacctttcacttgtaattcatttagtactactccctccatttaaggttatatgatgttttgactttggtcaaagtcaaactgttttaagtttgactaagtgtatagaaaaatatagtaatatttataatactaaattagtttcatcaaatcaataattgaatatattttcataacaagtttgtcctgggttgaaaatgttactacttttttctacaaacttggtcaaacttaaagcagtttgactttgacaaagtcaaaacgtcttataacctgaaacggagggagtaattatttaccattcctggagaactgttttagataccgtactttccaatataataagtcctgaacatatcttttaaattttttaatcaccaggcttaataaaatttggaaggcatgtgttgcaaacttattcagcatcgtgatccatgtttcatcaagctttagtgtgttgattgtggaatacatcaagaatttcatcttggctttctaaaccacaactgcacttctctgatgctattgaatattgctgctgctacaacagtcctatggctacctaatttttctgatagttatcattcttcttttgttgtagcgtgtgctatatgtagacattgatgtccaccatggagatggcgtggaggaagctttcttcactacgaatcgagtcatgacttgttcctttcacaagtatggggactttttccctggtactgggcatatcactgatgttggagcaggcgaaggaaaacattatgctttaaatgtgcccctgagtgatggcattgatgatgatacctttcgtgatctgttccagtgcatcatcaaaaaggtaatggaggtttatcagccagatgtagttgttctccagtgtggagccgactctttggctggagacaggttaggttgcttcaacctgtctgtgaaaggtcatgcagactgcctccgttaccttaggtcattcaatattcctatgatggttttgggaggtgggggttacaccatcagaaatgttgctcgctgctggtgctatgaggtcttacttttatctcttatttcatgtacaactgattgaagttgttggtttcatgctgaacagttctgatggaatatggttgttgcaatagactgcagttgctgttggagttgaacctgataacaagttaccttataatgactactatgagtactttggtcctgattataatctccatattcaacccagaagtgtggagaacctgaattcgactaaagacctggagaacataaagtaagtggactgtttctatcaatatgctgaatcatcttttttttttctcccataagttggcccatcagcttctgtgtagggtgcctcaagcgatgttttttagtagttttctcagcatgtcatttataatggtgtttccatattcactatctatactgttcagcatatcaccattgctataaaatgttggaatgtctctgaaacttcacaccttcaattaatgtttcattttttaccctgtatgaatttgtgactgtatctttttgaagtgtgttcccatattctgtaattttcaaatgtagatcatgtgaaaaccactttcatcgctccttgcactttgttgctagggtccattttctcactgcttcttgtgttcatttcctttctgtagtggttaatgtatttttgtcatttgactgatctgcaggagcatgatattggatcatctctcaaaaattgagcatgttccgagcactcagttccatgacagaccatcagatcctgaagctccagagcaggttactctcttggcataattttgtattattctgttaattcgttttcttgctttgttgtgcaaatttgagaatgtgctcttgtaggaagaggaggacatggacaagagaccacctcagcgcagtaggttatggagtggaggagcttatgaatctgatacagaggatcctgacaacatgaaaactgagaccaatgacttatctgccagctctgtcatgaaggtttgaacttatgcttatgagaatctttcttccatcctatagtgtactttgttcttgagaatttctagttgatgccgtaatagtgatgaatattctctgttattgacgttaaattttaaccatctaactaatgaattaagtttagattgacaaagtgagcactcaagcatatactctccattccaaaatataaggcactatcatccttaacccaaagaccaagaaacaattattttcatctcttcgtttggatcactctaataaatacaattcatgcacctaataagattagagatcttgaggataaaggatttaaaaaacaataatttagttgagaagaggtgctagttaattatttgcatgcatgcacgccttgtattatgaaatatctgaaaaaaaaatggttgtgcctaatattttggaatagagggagtatatagcaataacaaataaaatagcttgcagcttgttatggcaaaactccgtatgttgctagcgctatttttggaagatcatagtgcctaaagttcagtgttattcgtgcaggatgaatcgaatgatgattcctagaagagatcctgcgattctggttctcagcactcctgatttgtacgtgcatgctgaagaacaaggaaagtatctgaagatgtctgatatctgcgcctgaccattttgcaaaacaatgaatgcttttttgggtgcttctaactttcaagcatgtcggtaattctggttagtcggcggcacatcctcaaatggtttgtgccagaggagtgtatgctagaatgattcttgcgctgatatggatttatagttcttttatgttcatacttctccgatgtgttgaactcataccgcagatccgcaatcagttccccctagcctgtccaaacttattttttgtggcatttgaaatccatctgaaccgcattgtcattcatattttgattaaagaatgcctgaagggaaaattagttcaagtgaattcccagcatagctgctgcggctgcttctttttttttctttattttttgaaatgaaactgctattatagttgtcgttggaaggcgtgttgaactgttgattgtccattgttggtcgttggaaggcgttgtccgttgtcgttgaaaggcgtggtcattcggatcaggtgtagttgggggcaacttcatgcattccactgcccgctgtgagatcgaatctaaggacattattcattcgatactataacagctactgtaggtcactgtagaagcgttgctgtagctataatctggtccgttcatcaagaaagctgatggataataattcatgttgtagcttaacttgcagtggcctgtgttgacgcaaaacgtgtcctctgctaacacacactg

SEQ ID NO: 81966 - DNA, 10290 bp, Oryza sativa
aacagaatcacttcaatcctttgctgttacttttctatatagtaaatcaaacaaagagtatgtgaaagcatgcagggtactaagagcctttagaagggcatccgcatcaccccaagctaggttcgaggtaaggctttgggacaaaccaaccccaagaccgtcattcttttcatgtctgcctccgtaatgtggaaggatgatgttcaaacttgcagctgttcagagtctagatctatgtggctgtcgttgtacaaacatcttagaaatccttcttgaggcagagtgaatgactacgaagttgttctgagatgaagtatcccacaaaagatggtaccaatattgtctccatggaacgctatgattagggtactgtctgatttatcattatttttaaaatgcatcatgattctcattgaggctactgcagtcaaagatgttgtcaacatgcctggctattattttctgctttttccgttgatcactaagtttctaattatttcttgagctcaaagaggaagttcaatatatatcttatcatgtttaaacttttgattttaaatgaattgatgaagtcaattttacccccttaaatatttaagttgtaaatgtttaaactattttctagagcacttaacccctttaaaatttatgtaccttagccccttaactgttaaatgcagtactttactcctgctgacatttttccattttgtttatgtttgtccaaataattttttattgaaacctttataggtgtaaatcaccgtgacagctaatacacgcgcctttttctctctttttttcacaagctaccgcgcgccgtttctttacgtccgcattttttccatttctttttttttcacaagctaccgcgcgccgtttctttacgtacgcattttttccatttctttttgccatatttttcgcgtttttttatttgagaagttgaatctttcatcttcaattttatttgaaagttttgaatttgagttgaaatttttaagatttgagttgaattgttgaattttgagatgaaagttttcaaatttgagttaaatgttttaaattttcagatgaaagtttttaaatctaagttgaaagttttcaaatatctggttaaaagtttttaaatccgagttgaatattttcaaatctcgagttgaaaattttcaaatttgagtaaaaagttttcaaacctgggttgaaagtttttaaatctggagtgaaagattttaaatctgggttgaaagtttcaaatctgaattgaaagtttttcaaatctgagttaaaaattctatttatgtattatttttctaaaaactaatactaaccattatcattaacgctaatgaatgtcatcaacgctaattagcgttattagcggagaggccgagagagggcgcgtgcgcagctgcgccagttagcctgatagcgcgcgcacccattaggaatccatgtaaatcacatcatacgttatgcccaaagtagggccatgtttggatcctaggcatttgaattgttggagttaggccctgtttagttcccaaacaaaaactttttaccttgtcacatcgaatgtttggccacatgtatgtagtattaaatatagacaaaaaaaaaaactaacaaaaactttttaccttgtcacatcgaatgtttggccacatgtatgcagtattaaatatagacaaaaaaaaaactaactacacagatagcgtgtaaaattgtgagacaaatcttttaagcctaattgcaccataatttgataatatggtgctacagtaaatatttgctaattatggattaattaggcttaataaattcgtctcacagtttacaggtgtaatttttgttattagactacgtttaatacttcaaatatgtgtccgtatatccgatgtgacacgtaaaaacttttcacccctgaattaaaccaggctttaatcgcataattttattcaagtccaatgttttcgttcgggacagaaattaatctagaatttgattcaagggtgtgtctgcctgtctgggtcaatgccatagtctcaaccatgccccccaaaaataatactccctccgtcccaaaataagtgcagttttgcactgttcatgttcaacgtttgaccgttcgtcttatttaaaattttttttatgattagtatttttattgctattagatgataaaacatgaataatattttgtgtgactaaatatttttaaattttttataaatttttcaaataagacggatggtcaaacgttagtcacggatatccaccgctgtacttattttgagatggaggtagtaataggttcatttgcttcgttgctaaaagaattggcatatgccaatcttttgcaagtagaactgtgtttgtttccaagagttggtaacacagctgctgcgcacggaaaatggagcggtccattagcgcagcattaattaagtattagctattttttcaaaaatgaatcaatatgaatttttttaaataacgttcgcatagaaactttttgcaaaaaatgtaccatttagcagtttgaaaagcgtgctcgtggaatacgagagggatgagttgggaacccatagaaacgaactcagactttgaaccaactttgccaaaattttggcatcaaaccaaacaatcaactttaccaaaatcttttgtatggttgagaacggctaaaatccaaacaataccaaatcattagcaaaacaaagggtagatttcaatttgattaatcctaagatgcagacttcaccttatgagcatccttgcacattgtgctctagcttttcgatggataaagtgtgttgacttgcttagaccatgcttcattatctgttttaatgtcttttgaaattcgagaaggattctaaggcctagtttagatccctccataaaatttttcaccctatcacatcgaacgtttgaacacctgtatgctaaaaaaataaataattgcaaaggttgtgactaatttacgagacgaatctttaagcctaattactccatgatttgataatatggtgctacagtaaacatttgctaatgatggatttgttaggcttaataaatttgtctcttagtttataggcggaatctgtattattttgttattagactacgtttaatactccaaatgtatgtccatatatctgctgtgatacaccaaaatttttcacccctacaaataaacagagcctaagatgaactttaaattatgtttagcattgcatcgctccctcgagaattgggtagtgatttgagatagtaggaattaaagagatccgttctaactgttggacgggattaaaccgttattctagttttatccagtatgatgaggctgcctctgcacaccggaacaaaatagggaaattgctttgcgttacgatgaaatttgtacgattttagtacgatcctaccatgaatgatttttgattgggtgggaacaggttggatcccatattttcagcacacaccagagactacgaaggtccagttcttttctccaaaagagttgaagaatattaagattttcgtggcatactttttaaactgctaaacggtgtgtttcgcacgaaaactttctatctaaaagttactctaaaatatcatattaatctatttttcaagtttataataattaaaactcaatcaatcatacgttaataccacctcgttttgtgtaaaaaaattaatattcattttcatcttcaggagaaaagaacaccatcaaagtattgtactctgatcgtatgaagttttattgtacgtatagcaattaatatagcaattaatgctcactcttagcttttcatgatgcagcaactggaacttttgtactacctccgtcccaaaatacttgtcatttaaatttgttttataatattaaattgtttgtcttattaaaaaattatgaaattattacttattttgtttgtgattttatttattatcaaaagtattttaagtatgacttatattttttttatatttacattaatttttttaaataagacgaatgatcaaatgttgcatgcaaaaagtcaaagtgatcactaattttgaatggaggtagtactaaggattagcacacccaaaaaaatccatgcatgattgctcacaatagttcatcatctctatgtaaacctccatcgcagatcatatgtcagtctatgttatattttttccgtctcagaatatagccatctagtatgatatgggacgtatcctagtactacgaatctggataagaagtatccccaaattcataaaactaggatatgtcttatccgattctaggttactatgttatgggacggagggagtattgattttcagtttaacaaaagaaaaaaaatccactggagacgcgtgatttcatcgaaatttgtgaatcagagggagctgaagatgaagatgaaggtcacataattaattaatcgtgcgacagttcataagctataaagaatatgaaagatgttcatctcgccttcatcgattcgaatgtaattcatcatcaattcctctagcaaatatatccctccgatccatccatccatccctttcgcccatgttcatggattagtagttcacgggagcagttgagcgagtgctcgcatatgcctatatagtatgtgcacatatgcgattatgcgtgccctactaccatcctctccgcaaccaaacaacacaacacatgcatagattactccctacgtctgtccagacgtttttcttagtcaatttttttaagtttaatgtaagttatagaaaaaacatatactccattcgtttcaaaatatttgacaccgttgactttttagcacatgattgatcgttcgttttatttaaaaaaatttgtcaaatatgtaaaactatatgtgtatatgaaagtatatttatcaatgaatcaaatgacatgaaaagaataaataatcacttaaatttttttgaataagacgaatggtcaaacacgtactaaaaagtgaacggtgtcaaacattttaaaatggagggagtatatagaaacatttttagccctaaaacaaacatattattaaaatatatttaatgttagctaggtttaattaaaccagtttgatattataagatttactgtatttttctataaacttggttaaacttaatgaagtttaatttagaaaacaagttaaagcgaagagagaaatgctgctactactactgctctctcactctcgtgcatgcatgctcgtgattgcaaataattcgcaacgctacagtaatctcgtgtgccctatctcgttcgtatcaggcgtgcatccaaagcaggtgcagagactatctcagtcgtctgcttgttccctagctacccttgcaggtgccctcacccctcaggaataatctctctctctctttctctctctctctgcacaactaaaactatatatcccaatccatgatccagccattcatcatctgcatatatataatcgtcttcgtcgtcatgtagcaagcagcaggtagcttcacattctcttgtctcttgtactcaccgcatcctgcttggtcgctagctagctagcttagctaaccttagctacgaactaggagtacctttcagttcagatcagcttcttacctctcatcttgcattgctgcctaagagtaagagccagagatctgtactgactactgctacggcatcgagatcagatcattggcaatggatggccgccatcttctcctcctccatgtcctcgcgcttcttcttcttgcggtggtggtcgccgccggcggaggcgccgtcgtcggcagggacagcgcagtgcttcagctgcgcgagctgcaatggggctcgtccggccaggtccggtattcccaatcaaagcgctttgagaagaagatgacaggtaattacaagttactactccctccatttcatattataaatcgtttgtttttttcttggtcaaaattcttttgatttgagtaagtttatagtaaaattagtaacatttacaacaccaaattaattttattaaatttaatattgaatatattttgataatttgtttgttttatactggaaatgttagtatatttttttctacatattaacttagttaaatttaaacaagtttgattaagaaaaaaatcatacgacttgtaatatattacaaacggaataagtagttgctaaataatgtctgagcagcagttgaattatttgtggggtttggcttttaaggttagcttcagagagaagcccaaaattacagtgataatattctcattattttatgaacctgcaggcatctcatgtaatgctaggtactgagagttgagagagttagctgatccatctttctcattcactggagaattgtgtctcccctgttatcaacatcaatattacagtgttcaccgcagtcctaatttttttagagcgatagatatatcactgtagtgtgtattgtcaattcttttcaaaaattttcataaccatatttccgatgcatttgagagaaaattgtataagggaaagcagcatcctctcgggcgatataatccatcttgttttgagggctatattttactctgctttcttggtagccctgttacctaccaaaccttctccaattatgtattcgaattgtcccatacaagttaaagctacacacacttttttctgtaaattggcaagttgtaactttgccccctccctaatacaaggatatgcaagacttatgcgtattctcgaaaataatagtgtaagttaatttcgaattttatgtgttttcacaagaagttccattcggattcagtgtaccacatcttcgctccaaatttatttgggctgtacaaattccacctgaatttggcgttccctacaaaatatatttcatgttccgagtttttctaaagtagcttcaatttcatctttttataaatccatatgcagtacagtacgttcggttatggttaattttacaaccccaaaataaagaccatcaccaatccaccatgatcaatctagatcgtgtagagcccttcttttttatatatatattagacactaatattagttgcaaaaatataaaccaatattaaattacattactctgctttatactctatcctttttcaatgtatgatattgttgactttttaaaatacgtttaaccattcaacattaaaacattttatataattattatttattttattgtaacttgatttatcattgaatgttcttttagcatgatttaaatattttatatttgttcaaaaattttaaataagacaaatggtcaaacgttgtttaaaaaattaacggcatcaaattttttctacaatttcaaatattttcaataactctgcttcattttcttaaatcaggggaacacaagaaagcagcagcagcagcaagaacgaggactaggagcaccaccgtcctagagctgaagcaccactccctcaccgccatccccgaccaccccgccgcccaagaaacctacctccgccgcctcctcgccgccgacgaggcgcgtgccaactcgttgcagctccgcaacaaggcagcgttcacgcagtccggcaagaaggcgacggcggccgccgccgccgccgctggcgccgaggtccccctgacctccggcatccgcttccagacgctcaactacgtcaccaccatcgctctcggcggcggcggatcctcccgcgccggcgccggcaacctcaccgtcatcgtcgacaccggcagcgacctcacctgggtgcagtgcaagccgtgctccgtctgctacgcgcagcgcgacccgctgttcgacccgtccggctccgcctcctacgccgccgtcccctgcaatgcctccgcctgcgaagcctccctcaaggcggccaccggcgtgccgggatcctgcgccaccgtcggcggcggcggcggcggcgggaagagcgagaggtgctactactcgctggcctacggcgacgggtcgttcagccgcggcgtgctcgccacggacacggtcgcgctcggcggcgccagcgtcgacggcttcgtgttcggctgcgggctcagcaaccgcggcctgttcggcggcacggcggggctcatgggcctcggccggacggagctctcgctggtctcccagacggcgccccggttcggcggcgtcttctcctactgcctccccgccgccacctccggcgacgccgcgggctccctctccctcggcggcgacacctcctcctaccgcaacgccacgccggtgtcctacacccgcatgatcgccgacccggcgcagccgccgttctacttcatgaacgtgaccggcgcgtccgtcggcggcgccgcggtggccgcggcggggctcggtgccgccaacgtcctcctcgactccggcacggtgatcacgcgcctcgcgccgtcggtgtaccgcgccgtgcgcgccgagttcgcgcggcagttcggggcggagcgctacccggcggcgccgcccttctcgctgctcgacgcgtgctacaacctgaccgggcacgacgaggtgaaggtgccattgctgacgctgcgcctcgagggcggcgccgacatgaccgtcgacgctgccgggatgctgttcatggcgaggaaggatgggtcgcaggtgtgcttggccatggcgagcctctcattcgaagaccagacgcccattattggcaactaccagcagaagaacaagagggtagtgtatgacactgtgggctcaaggctaggctttgctgatgaggattgtagctatgcataattagtactattccctaactagaatttgaactgcaaatcaactgttgagtaaaaaacaagaaaaaactttgaaatggagatgatgagaaaatggtttgtttctctagtctgttaggctttgtaacgtaaactcttttatttttgggatgttagaaaaaagttgcacaggtgcggaacaagcggtcaccacaactctgctatgtaccataatgtaactccatgtctacctataaccaattaggacttacatattcgacacatatttttaatatgaaatgtggtaattttcttgatatgtgtgggaatttaattgattccttcaaaaatccttatgaaatttctgctttacaaagatctaaatctgttccagaaattcagcagctcctgaatttcatattggaacatgattttttttttgttggcataaggtataaaccacatctgccttatctaccgcagtctaagtatactaaatcacacacattcaggcatgtctactaacaaatttcagaaatctaaaacaccataatttggttcaggtgttacatctaaagcaatctgacagtaagtcacaaacatgagtatcagagacacctctcaaggaaaaacaaaaggcaaacaatggtttgtgcaacaacatccatctctacagccaacacagtttgcaagtccagagaaggtgttcttccgtttattccggaaaatatttggactcccaaattaagagccgatgtcgaatgtgtccatgccatgctccactataaacttcacctgggtagatgactcctttttgtatgtcgtgaaaagaagacacgcatccgaaacgggcattatatgatgccagaacatcatgactttaagtgattcaagggatgctgccttggatagaagaagcttgataaagctcatctcccctgggaagcacttgataaaagacagggtcacacgcttgagacttctaaccaaatcttcactcatatatgcttctagaatcccttcatgaatctcatcatctccctgtgcttctttcagatcaacctacaaaacatatataggtcaagtaaatgaaatgccaattataattttacaataggccaatctacaagaaaaaaaagcagtgttctatgctgtgaaggtattttaaaagtgacttgaagagatgcatccagtgttacctcaatattcagttgttcaatctgtggagcacaacgcagtaaagaaaagattgacatgatacttgagattttgccaaaatcaacgctcaagtttgaagtccttaagttccggaacttccatgtaattctctccaatggattttcatcgacctgaaaatcatgacaaatttaagttagactgatatatgatcatcaatgcaacttgatctacttgcttgcaaacagtgtatgagtaattggagtatcatactcctatagctgagctgaaattgaatctgcctacaggtaggatagaggacacacactcacacacacactcacacacacacacacaca

SEQ ID NO: 81967 - DNA, 30063 bp, Oryza sativa
aagtggagttatgaactagctggatggaggtgcttgcagcggcacagttggacaggagtaactcttaggagaaatgtgcattttctttggtttttggttcataggaaattagtaatggcatggcatcaaacttaaccattaatcaggtttttgcatattgttgcacctgaaatgtaacataatctatttatggatgctagtattatatggtgaatgggcatggtctataatgattacatggtgaagagacccctatcatatggtaaacacaaggatgcaagtactatgccatataagtacttatttatatcatgtagcattcactaagctatattagataaccattttctaatttacatccggtttcatcatggtgtggttccagcggtgaagggtttgctgtggaaatgaaatggcgatgggggtggaaacagggaaggacatggcgataggagcggaaaacggtggaggaaacaacgcacagaaggagaggaacggaatatgggtgcgatgaaacaatattcctcaaagggtggggtttagtgtcaatcttcttcccttccttcttgagtttcttcatgagcttgtagcctccactcttcttcttggatgacttgtctccatcatcatccttggaagggcacttggaagcaaagtgtcccttctcaccacactcaaagcacctcaagttggagatagtcttgttgggtcttttatttcttctcttattggagttggagccccttcctctctcctttcttcttcccaagagatcattgaaccttctagcaagaagggcaatctcttcctccaagatcatcaaaatagtcctcgatattggtatttttaaactcggaatcattgtcacttctaatttttacaagagtgcaactaaattcattttgggccctttttgtaaactttttgaaaagctcggcaacaatagacttatcatgcaaaaagaacacccaagtatagcgagaataatcatcaacaatcacaagacaatgactattaccaccaatgttcttataggttgttgggccaaacaaatccatatgcaagagctccaatggtctagatgtggacatgatatacttagtaggatgagagcatgcaacttgcttgacggcttgacgagcactacaaagtttatccttctcaaactccacatctttcaagcccacaactagatcacgttttgaatgtttgctcaattgattcatgccaacatgggctagcctcctatgccaaaaccaacccaatgaagtttttgtaactaaacaagttttcaaatttgctttactagaactgaaatcaaccaaataaagatttccatatctaaaacctttgaacacacaagacttgtcatggagactagaaagaataacctcttgcggaaagaaagcacatgacaaggcaatatcacaaatttgagcaaccaaaagcgaattgaaatttagagattcaacaagagagacattttcaattgacaaatcattggagatagcaatttaacctaacccaatcacctttcctttactattgtctctaaatgtcactttctcttgttcttttcctcctacttcaaatatggtgaacatagccctatcaccggtcatgtgttgaatgcatccactattaagcacccaatggctcccaccgatgcggtagttcacctacaagagaaaatcaagctcttttaggtacccaaacttgtttgggtccttggaggttagagaccaaagctttgggcacccaaatggcattctttttaccaccaagtataggggaacccacatatctagcaacaatactaccatcatgagccttcttaagcatataatgagaatcaaacatgcatgtcttggaaggcttactaccggggcaatcattcaccaaatgcccaacctcatgacacttggagcaatacttaccgttgctcttgacaaaacgagtgacacggtgagaaggtttcttacccttctttggaatgtatccaagtcccttattgttaaggatgcaccgttgctcactgaaaatcttgtcaagagtgttcttacccttgaagcacctctccaaactcttgttgagcttggccacttgctccttaagctcattgttctcaacaacaagtgaggcatcacaaatagaaacacaagagctatagctagagctaggcatatccataagatcatcacaagaggtagaaatgctagatgatgcaacatgaggaatatgactagaagcactatcatcaagcaagtcacaagatatgccaacatcaatgtgagctccatgttgagtagtggaaaggaggttatcatgagcttccttaatcttctcataagaaatggtgagtctctcatgagaagtctttagctcctcatacaagacctccaaagaagcatgatccttctctagggccttaaacttgacaatctccttttcactatacgcatggagcttctcaaacatactcacaagctcatcataggaaacatcatcacaatcatcgtcactctcactatcactaagagatgctaccttagaagagcccttagccatgagacaaagtggagcgaagagtgatggagcctccttgatggctacaacggccatcttcttcttcttggagcttgcatcatcaccaccttcttcttcggacccggatgaggcggagctctcctcatttgagttccattccccgatgaaggcctcaatcttcttcccttccttcttgagcttcttcatgagcttgtaacctccactcttctttttggatgacttgtctccatcattatccttggaagggcacttggaagcaaagtatcccttctcaccacactcaaagcacctcaagttagagagagtcttgttgggtcttttatttcttctcttattggagttggagccccttcctctctcctttcttcttcctaagagattattgaaccttctagcaagaagggcaatctcttcctccaagtcatcattgacttcattcaccttgctcttgcccttgtcttcaacttcggcttggagagcaatgcacttcttggatggtgaggcttcctccatctccttcttggatggtgaggcttcctccatctccatcggtgtaggttgccccaagccccttgagatcatccacgatgacattgagcctcccatacatgtcattcacactctcataaggcaacatggagaatgtctcatattggatcttgaggaaatgaagcttggcatccttgtactcacttgtgccctcatggatctccgccaacttgttccaaatctcatatgcggtctcaaggttgctcactctatcgaactcctcttggctcaaagagttgaacaaagcattcatggcttgagcattgagttggagattgcggtgatcaatctctgtcaagggcgtgccagtgatagcaaagcctacatccacaaaactccaaatatggaagctcatagctttgaggtgagtagacattttaattttccaagtagagtagttagtgctatggagcatgggtgtcttccctacatgtttcacctcgttcgacatcttctctctaggcggtgaagcccaaacaagagagaccaagctctgatatcacttgtaggatcgagatgtcgactagacggggggtgaataggcgatttaaaaactaattgacacctaatcaaaactaacctaagttgctaggctcggtgagggtcaagtctaactaagcaactaagttatgttttgcaaacctagggtgatagaggctcaattatatctctaggaaagtaaatcacactcctatgtcattgtttagcaaacctagggtgacatgatctcaagtatgtctctaggaatgtaaattgcacaaatgtaaatgcgacaatcaaatgagacaaggagacaagagatttttcaccgaggtttggaaactcgccggtttcctactccccgttgaggcgagcccaactccaccgctcaaccacaaagccaccgcacgcccccttcgtcaaggggtgggcaagacgggagccggcccacgaagaggactacccaagcctcgatcactcagggtagttcttccttcacttcgaaggtggtgaactccaaaccactcacaactggcgccgggcctcctccacaatcttctcggagaggtcaccgggcaactccttcacaaaccgtctaggaggaggcaatctccaagagtaacaagcgatgacctggctcggagatgatcaagtgccacactagctctacaatggaagcaatgcacttgactcttggctagaacaatctcaaccactacaacggatgaacactaagctcaaatgtgtgtgagagaggtgcaaggggtgtatgcaattgaattgggtgccaagagagcccccttgctgctagtgggggagtatttatactcccaccaaccaaaactagccgttgggggggtgaaatcccccaattttgtgtactcctctggtcagaccatgcgactctgcaacggctagaaaactagtcgttgtagccctgtcagagggccccatcggcctggccggtcagaccgacattgagtgtccggtcagaccggccttggctcggttagaccgcccttagctcggtttgaccgaatacggctccgtcggctctatatcggccaaccccgaggacaccatcccggcctccagggggccggtcagaccacccaagtgccgccggtcagaccggccttgtgcaccggtcagaccactcgcttggggccagtcagaccggccagggcacgccggtcagaccaccactatgtggccggtctgaccgcccctagtcaggccgaacacagtgaatgcaagtgtgtgttgaaaagtgagcacaagtctaaatgcaatgacctaatgtggcaattaaaatcatttctttgctaggtcattacccctcttaatagtacgacgaagctaagaataaactagcaaatttgatcgccctacacctcgatcaatttaaaactaaagcactagttttaccatcttcttttcttcgcttcacgccatcaattttaatccatcaataatcatccatgcgcactcatgatgtgaacctaactcaatataaatatctcaaagacaacggttagtccacaattagtgtttgtcattaattaccaaaattaacaacgggggcctagatgcttcagtctccctccacctccacgaattagcacttaatcctatatatatattcctctataaatttctatgtacaccctctagaacaattgggttttgtttagttgaattttgccaagtgctattcaccttgtctctagtcctcgctcaattagtcatgatcgactatagattcagagcccccaatagttggtgtgttgatttgccgggtcgattagatctaccacttcaatcgcaactattccttgtgcttattcacctattcgcaatatttagattgcatcttatattgttcttgcagtgttctcttgtctgcattgcaggggtcatcaaccgcacgtcacggttggtacgacatcgtttgtggtgtagcgattgcacggcgtcctggacttgttctggttggtagccacgccgcaaatgtcgcactcgatcaaagcgagagttatccccttaccagaagatcgggccatgagagagagcgtcatcagggtaagtcctacgttccctcggccctggcaatcttatcggctacattggtgttgttcaaggctgcatcgcttcgacctcttgaatcactctggttcagttgatatttttgcctacctatttatcatatatcttagttaatctaagtagatttttcaatttacttgtatcggtcagatctttttctagggttttgccgatatcagtgttggcggctgttaaatgtcgattctataccaccaacatctgcataaagttcaataataaaacatccaacatagtgatacgtgcttaatctcacatattccacaagtgttggtgtatatttgtatgtagatgataaatcctgaagttgggaggaaaatcagactaaagtgaggagaaacgtgtatccatacaaggatgggtggtgaacttcatagaaataccagagaatcagcccaaaacaccaaagaatggatataggaggaccaggagaggagccaggccaaaggccaggccaggccaggggggcctagcccaagttcggccgaaccccctggttcggccgaaccctggtgagcaccgttggatccaagttttggcatggacgctccagatcactccctgatggcggttgcggggcagttcggatatttccccttcgccaaccgtcatacctacctctatataaagacttcacttcactcacttcaacacacactttcaagcttgagctgaattataagaggctcaattgtactatattgtatactataataggaagagagtagagtagaagaagtcgaaagaattctggagttgtcggtaatcttctcttatttcttttattctgtttattactctgaaatattcttcctgaaaatcagtcaaaggcttgatgcttagtgctgcatcaattgggattgaccggggaaaaaacgtggaaacctcttgagagctctcgcgacctcctgggcgaaaaaagtcttcctctttccttccctctcagatccctctccctcctcgtctccagtggtttgccgccagtgacaagggggagggggtcgaaggccctctattctttgtagatccacagttaggttcatcctatagattgagttctctcgtagtagtatttcttttggttgtcgaggaggttgccggcaccaaccatcgtcgtcctagcgttatggtggtcgttgccggtggtttcatcggttctcgactagcatgctgctgggtttctcattatcgtcgccaactgggttgcagccagacccagtcaagacctggtatcgccggtcaccttggctatctccggcgtgcaagcaaagaagcgggcggcctcctgcttcttctccagcgatgtaaatttgtcaagcaactgtgttcgacaagacaaaccgatgaagcttcaacctcccctcattggaggccccatctttgtcccaatttttgggctagtctgggtatgcttcttggtttccttttgtagatgtttgtgttttatcctccatcgctggcaagattgagaagacttaattccagtcggtgttgttatgaggtgaagctgtgtttctctttgaggccccatttgggattgtgcagaggctccatcagttgcaactcgctgtggtcatgcttgtcaccgtcgacatcaactcctacagggcagctatgaaggtctatggaagaagaaggacttgattgcttttcttatcctagcttttgtccttctttgcaaaaacatgacttttatgtaaattatattttcccaaggggacatcctgtaaatctggcattgtatccagccttttaaagtaatatatcggaggctttagcctctttgtctcaaaaaaaaattgggtttgatctactaagtcatgcttagaaccatgatctctagtctgctttttgattgccaataaaggtttcatcggggttttagccgatgagttatctagacgttgcatcggcttataaggattacatacaagttagatttagccgatcgcaacaaatgttttactgtttatctaatcgtttggatttaacaacattggatctctagccgatgtatgcttcaaccttcagattaatgttttttcctttatatcattattagtcgattgatttctattggattatattattgttttattacattatcattagccaattgtctttatattgttatttacatcaagtatcattatatgcattggacatatagccgattgctcaaaaccctatcgacatcggctagtaccagcatcggttgaaattactccatcggattgtcagccgatcggctctttggtgttcaacatatttatccatcttgttaggtgcaagatcaaactgactagcacgctcgcatctcatcaatattttgaacctgtactggcgctaagcggatctcctaagctgttgtgttcatccacttagttcgcaccaagcatcatcggccgagagcggatttttcgtcaacacgttcctgagctcggccgggggcaccttacaggtggcagttggttggtaggggtggcacacacccgggcatagcacaggcgtgccaaggcgtgggtgcgcgagagtagcggcacgccaatttcggacgtgccaacactgttgtaggctgcgacatccaggcaaagcggcgagcgaggaagaagggaaggaaaggcgaccggattctcaccgagcagtagccgaggagtggcacaccgggcagcgacggagggaaaatgatggctgaagaagtttcggttggggactactgagctcgcgaatcgtccacactcccgcggcaaaacaacgatgaggtttgattggccgcagttcgtccgttgtcccatgcggctacggaatcatcgtaatcgtcgtgcgtgagcgattcatccacgtgatgctatttcttgcttgctccgactttagtgttgccatggagaggcaacccgaagtggcaattaaggatggctaggcaaaacggagtggtacgcgggtttgggtggcacggctccaagcatgtgcgaagtgttcgatcgggtgccatgagtagctgggtagactggcatgatggtgaaggtgatcgatgcaaaaggaggacaaaaaagagcttgcggtggcttttatagccctagcgcagggggggagtggtgatggcttctagttctaggcgaagggaagaggtggggtggtacaactgtacaagggagtgaggatggtgggtggtgcgacgtggatgagccccgctctcatgcgaacgcacaatgtcgcactgcaccaggcatggccaaggctacaaggtggtgtgcgggcatgtggcagcggtagggccacgatgctatgcgaaactgtggttgacgcgcgtgggcgtagtggaaaaaactggaccggaccggcgattcaactggaaccagagtttggcacggttcggtcgaatagaaagaccggacatgcaattgaaccgcttcagacaatcagaccgcttgaaccggccagttttgttatgaaccggacaataaaccgccttcggtcggactgggtcagtgaatgaatgggccgcacgacggcccatttatttgggccatacttgtctgctgttggcgattgttaaatgccaattctataccaccaacatccgcataaagttcggataataaaacatccaacataattataggtgcttaatctcacatattccacaagtgttggtatatatttgtatgcagatgataaaccctaagttgagaggaaaatcagactaaagtgaggagaaatgtgtatccctacaaggatgtgttgtgaacttcatcaaaataccagtgaatcagcccaaaactccgagaaatgaacataggagggtccagggagtccaccgaccgaaggccaggccaggagggcccaacccaggttcggccaaacccccctaatcaccgttgatcctggggtttggcatggacgctccagatgctctcctaatgacggttgcatggcagttcggacttttctccttctcacaaccgtcataactgccctataaatagacctcacttcactcaattcaacacacacttccaagcttgagctgaattataagaggctctatgtcacagcttgatttttttcattttaggatttataaattatttaataaattattaatagaatttatattaaatgttcattaatttacaagtgaagttaaatgtgggaaataaaatttcctaaatttaaagcatgaatggatttaaattttaataaattctccatgattaattatactctctgaaattttctcggatttttcagagctcaattcctaaatgatacaaagaacagttcagtaattagttaatcaattaatgagctaattataattatgttaagtgcttttcttgtttaaaaatccttaaattataaattgttgtttaaaaggaattattagaaatgatcttaaaagcctaaaagagaagatctaattttaatttgttaaatctcaatataaaagtgggctagataaaattttgttaaatacttctcttgtttctatagttcctagatatttctgggatttatttgagccaaggaagtatttttaatcaatggaatatcatttcatgaataatttaaatagaaaaaggttttaaaatctcccttttggctttgggccgaaagtcggcccaagtctctctctctccctctcctcggcctgcttgcgtccggcccagccggcccagtccgccgtccctccctcctctctctctcggtgccgacctgtcagtcgtcttcaacctccggccgctcctagccgcgccacaagccgccgatctccttccaaatccggccgcctccttccttctgcggccaaatcaattgaggggaaataatctccttgatctcccattccttttctctttaggaaacccgagctaattcgtttggaaatcgtcggattcaatgccgatttggttagtttctctttcgaaaccctaaaaccttccgtctcgccgccggtcgccgtgggcctccgtcgccgcctcctagcccctataaaaggatccccgggacctcctctatccgctgccaccttcgccctagcttgccgccttctctagcgccgcctccgcgtggttctttgcgtcgtcgccgccggcgggtgtccagtcgggcgccgccgtcgcttcggtcgtcgccgtcgatcgccgtctccttcttcagcatcgtgaggaggagcagcacctcgtccacccctccgttgccgccgtttcccgctagagcaccgccgtcaccgccgccccgaagaccgccgccgcttcaacctcaccgccgtcgtcatccgtcgtcgtttgccgtcgtccaagccgctggtaagttcgccgagccgagctctacgcgttggtgccctccgtttgcgccgcctcgccgccgttcgctgtcgagcatggggtgccgaagccgccgccggtgatgacgtcatcgtcgacgtcagcgcttcgtcagccgtagacccgtggtggaccggatcgatctcggctgtccgtttggcttagattagatctcggccgttggtttcgtagaccgtctctgtgaacccggtttaccgtggatcgtctttgatgacgcaataaatctcttttccttttcaaaaataattccttattgcgtcataattcaattaaaatccatataaatgctttaatccggtttaatctttaaaaattcataattaattcatatgaagtcagaatgaggccgttcaagtctcataattcatctaaaattatgatctgcatgtttgtttactttatatgtattgtttatctggtttattttagtctttttcctcattttgcgtgttagcttgtcgtttccgtcgtttcgaaggttcgcgagtgcgccggaagtgttcaagaagattaattgaagaccgaatattgcaaggcaagtcacacagatcccaaacacaattcctttgagcatgttgatcctatatttaaattctctatttatttcaactgtgcatttattttcgaatgtcaccgggtggtgtgaattattccttagtatggccaatttgcattgattactctattccttgataccttgggttattataatttgactagttggatttatatattggttcaactagatatattagatataattgcttagccatgcttagaaacattagcacacaattaggataactaatgttttactattacttaatgatggatatttaatgatagctcacgatggctaatcgtgattggttaattaattaatttgccaactaaaacttgataaaggtgggttgtgagcacatggttttgatggtcgtgctcatgacaattaaggaccggttcacgagtttcggttgtgaaacattaaccatgccaaccacaagccagaatggacaacggctggacactttgtataacaaggctcattgcggagcaccagactgagaagtggcggaaataagcccacggtgatcgctggggaatccatgccttgttttataagggggtgattatgatccaggaacggtgcactgctttgagttgagttatgcgaggggtcttgtcacaatcactcgccatggtgacgtgtctgcacggacatggtgacatgacggtgggttgtgtcttgtgggtacagtggtacacctctggccagagtaaaactattcgaatagccgtgcccgcggttatgggcgggtcgaacaatgtctttcgtgattagtcccacactactcattaataataatgtggtaattgatggtaattaatttagctcctggtttggaatggtacattcctggtttggagatagatctgtgcagccgggtacggttgttcaggatggttgggcctgtgcagcatgagtgtgcttttaaatgattgattaatattgatgattaattactctatcgttttagaattctcaaattgtttgctaaatgctgcttttgcaaatgagccctatattatgccatcctttggtattcttgtgcacttgcatatttgctgtatggcttgctgagtatgtcatatgctcaccttgcaataatcaatcaaatctcagttgaagacaagttgcgaaggagaaggcgtttggcttatagcccagttgagctgcctgtgagagtggagccggagcttcgctagaccgtaattccgttgcagttttcttttcttttgtaagtatgtaacgtattatattgatgaatctgtatattaaattgtcagtttgtgtacctcggctgattcctggacgaggatttaatgcacaaataagttcggaaattactagtgaatttctgggcgtgacactctattgtactatattgtttactagaataggaagagagtagagtagaagaagtcggaagaattccggagttgttggtaatcttcttctgtttcttttattctgtttattactctgaattcaatataacattctacctgagtaatttagatttatcttgtgagaattatctcttggttagttcctaagtagcatatgggattattgttcactataattaactaaaatatagtgattgctttggtgagttataaacactaaagtagatattaattgcttagacgtggtgtttaggtaattgttatccagtaattgttgcgtatcccacagtacgtttgaggtaggtgtagaggtggtgacagccctcaagatcacttaagtccttcctgtccggtacgtagtagagcgacatctgggaacagggggttgctagtgcctaaagtattgcattaggattacagttaagatttccctagacactgtttctcactagaaaattatctctatcctggcctatcatttgcttggtgtccttagatgaaccggaggaagatctgaccacacacgttcccttggattcgatacccttggaagtgctacatcggtatatccgtgcgcttgcggattttatctgtgatcgtaataaatgccaacatctgcaagcttaggcttgattttacccctggtcgattggttggaaggcaactcccatagccattctatcagccgaatgtatgagtcaatatggaaatacttatgttacatgtacttaatgaaccgcggttcaactggccggttcacattcggaccgtcagatcggtgaaccaggaggggtgaccgggtcatctaccggtccgggtttttccactatgagcgtgggtacgggaggttgggacaggcgacgtgatggtcggtgtccactggtcgcacgaatcccgtgcgagaacgactcggagatgagggcgggtgcggtgtgttgaacgagattgaccactgcgtcggctctttgtcgtctagcgcgcaacacatgggaggcggtgcgtgatgcgttggcaaccgagcctcgtacgtccatcgcgtcacggcactgttgtgcgcaggcctatgtcatatggcacgacatgcggggagaacaagggaggggcacggcgcgcggagctaggggtagtgacggctcggcgatacggctacgtttagggcgcggctcggcattttctgacggtgtcgaggtgcagtggatggggcggactctagcggcgagctcgctggcgatatgatggcaatgggctccatctggtacggcgacagtagcgagcgatagcgtcagggcttcggagggagagaggaatgagccgcggtgtcggctcggcttggtcgctagctaggtaagaggggcagtgctggtaggctgcgccggcctgggctgggcaaggtagggaagaaataaagagacgaggaaaaggaagtgttaagggaccaaacttttaagaaaaggcacattttgctataggacattgcaacttcgtggttttagctgtagaacaccgtgtgaagtgacttttggggaagacactctcaaatgttggatatttgctggtggacaccgcgctcattaaaaataataatttctggttgaataggagagagaaatcgcgtgaaatgtgaaaaatatccttgggcccaatgtcagctctcctatctctcttcttttctctctatattcctccttccagcgtcgcgcacgcctccacgactcgcacgcctccacgacatccaccgcttctccctcgcgggcttccacaggctttgcgtcgcccgcgccggaggtgcgacgagagtcgtagccgaacacactccgcacagcgtcgccgcgagccatcgtgccccgcctcgcctcgcagtgcgacactggacggaggaagatagagagagaaaagaagagagatatgagagtaggcccatgggtatttttgatatttcacgcgatttctctctccttttcaaccaaaaattataattttaatgagtgcggtgtccaccagcaaatatcaaacatttgagagtgtcttcccccaaaagtcacctcacgtggtatgctacagctaaaaccacgaagtcgtgatgtcctgtaactaaatttgccttaagaaaactgctaggctaggcccactagggagcaaagttagactttagctttaaaaacgtgaaattgattttctcaaataattttagtttacaaaggtttaaattaatatgttcatttatttgtaaaataattccttaaatgatattaattcatagaaatggctcttagtaaagtaattaatatttgcttttatttgcaaaatactttcttaaatggtattaatttataatctggctctttaaaaaaatattatttgaattccataaatagatttagaatttgaaatttaatttcttatttgattcaatttggcattggcataacatgaaaaaaaaatccaaagaataccagcactatggactttcaaatttttttattattccaaatttttgtttccatattttaaatcaaaaatgttcaaggtgttagagatattcatcttgtattcacaatatatttagattgcatcttctactcgtttgcttgtgtacttaatttgtttgcaacagatagctttattggggaggtcaatcgcgttttggcttggttgataacggataagtggtgtagtgattgggagaggtttgatcaatctggttggagcctttggattatcaacatcagtctccaaaatcgaccaatccaatacctattgtaagattaggacctaattcctcgtcataaagtatacttgcgtcgttacgcatgttagccgcggcctgtggtgcggcgcaccaacgcaataatgcaaaaatagctcaagagtctgctctctctttacaaaatgcgtacacagtcagtcctattaacatacaccctacatcaataagcaaatattcaactttcaacgagacatatttttttttaatatttgatatgttgatttttttcaggtgtttgaccattcaccttatttaaaaattacacaattaccttttattttatagtgacttgtttaatcattaaatatattatgagcatgacttatatttttgctttaaattttgaataagaaaaatcaatggcgtcaaacgttagaatcaggagggagcatattttattgtggcttttgatatctacatagaagtatgaaccttgagcatatatatatctcaacccatagacgtttcctgttgccacacgatctcaaaaaagctcaccatatttgtaaactacggacggtgacaacatgaaaaatgctcctgttagtatatactactagaaaaagtatttttcccggcgtaggggtcttttttcgcaggtggacatgacccttagaaccaaataaccatctacaaaaatataaatcagggtgaagttcgctctccgcctgcgagacgaatcttatgtggtcagcctacaaaaatcgtacctagcaaaaaaaaaaaatctttactccttatctcctcctcccaccctctccccatcactcatttctctatctccctcaacacttctcctcccggcctcccctccacacctctcctctcaccggcctctcccctcccctcacctctcctgctctccccggccgccggccggaggcggcggcggctaccggcggtggcggcgtgtgctcccagtggcagcggctgcgggcggtggcggtggagggcggcagcggcaaggagggttgaggcggcgcggctcccggcccctccctcccagatctggccggaggagggcggggggagagcagtggccggcgggccggcccctccctcccaaatctggccggaggggggcgggagagggcggtagccggcggagctcccctccctctatcgtcagacatggcggcggcggcggcgaggagggttgaggtgcggcggcggcagcggcggatgacggcagggcgcggcagcgggcgaaggccccagcccctctctccctcctggcggcgatggggcggacgacggcggggcgcggccgtgaggcgacggtggcggacgatggctcccggcccctccctccctcccgttgatgtgagagtttttgctgatgaagatggatgagctatatgtataaagtgattttaggaatgattttacatgtgattttgttttctttctttgcttgaattgattcttgtgaaactgaaatatggctggtgcatgtgaaactgaattttggatgaactggtgacttctctgttgcttctctgttggatttggattcactggattagatggggaatgggtaggaactgtattaggaacggatagggaatgggtgggaactgtattaggaacgggaagctaccaccagaaacggcaatagctgcccatatttttttagcgttggaagctatttttgcaggcggatcagttacacgtctgcgaaaatcaaatatttttacagtcgttaagttgcaggccgcttgcccgcctgcgaaatggtgattggcccgcctggaaaaacactttttccagtagtgctcctgttagcatctagcatcgcagcatcttttatactctagaacattgacaacagatatatccattaataagactctatagctaggttaacatgacaaggtaaaaagagagaaatttgtagcctgcatatccacaactcccttgatcgagtatcgtaccaaatcagcctgccattcaaaaataccaccacatgctatatcagtgtaaacatctagaaaatcgtagtgtcccacaaacaaagtctgatactccatcgactagcttctttatgtacaactctctgccttctcgagaaggaaaacaagcagctggttgcacaagaacagcctcatctagaatctagacagtatagcaagttccgaagtatttcttccataatacgaaggcagcatcaacagcaggatgtgtctgacttatcagtagtctattatcagttttgatgtcaacacaacttgggagtgaagccttttggcactccattaattctccccatgcatttccataccattcgttgctttcatcgtcacagacgaaagtgacatcaaatgtttgaagagatcttgctttggatagtaaatgcttcataaagcacatttgatttgagttgtccttcaccttgacttcagtcagggaaacatatttgaggcttgcaaacaagtagctgcttatctcagaattcaggaagtattcataaatctcatcttcagaactcagggagtcttcatcaatctcatcttctgaattcagggggtcttcgtcaatctcatcttcggaattcagagggtcttcatcaatctcatcttcatcccattctgaataagcaatctacaaaacaagggtaaaattttaattaactcacttgaccaagagatgtctttaaattgtaacatatcagttgaaggtgtgaatctaatattaccgaaatgcaaaggtgttcaatgtgcggagcaaacttcagtaaagaagctaacgatagaacatttgagcgttggccaaaatctatggtcaggcgggcttcccttatgttctcaaacttgcaagtaattccctccagcatattaatgttgaactgaaaatcataagaacatagttaggcctgacatatgtccatggtgcaagtttgcatcgacctactaatctaagcaaacattcaaatattacaccatgatcctgtagttagaaaggttcttgaagcttcattttcagaacctaagagccatattgtcagcaatgttgggatttgtataggagtacatgtcttcaattcacatttgccaaaacacgacataccatctctacaatctccgagtttcacattgaccaattcagtcaaactgtaattaagttgtcaaaatactactttctatccaaaaacaagttagatcatcccaacagccttactctgagcaatcaaggtgaactagaagcagtaaaagaattgtcctccgacaactatcacaaccaaaatttaggagagagatcagtccttctcagaaaatgatgatgaatacaccttttgttctgagaaggagtattcatcatcatcaaggccatgacgcaaggtacttcacgccagtctgaaaatagtcagttcagggaaatgactcgtgagctactatagcagtcaggtgcggatccaagaacaaaaaattaggggggctcaattacacaatttcttcaacctacagcaatctagagatctttagtttatcattcatggtgaaaaaattgaaggggtgctccagggggtattcatgagtcttgtgggtgtagggggcacacgagtcccccctgcacccacgttggatccgcccctgatagcagttgcagtgttactgtgttagtgagtgaaactcagtggaaatgcagaacatactacatatatacaagacataaatgagatcagcagtgcccccaatcaagtctgcaaattacctgtgtaaatgaggtaactaaaattcataaatgtggatgaacatgtacatgggattcacaagcagacaatgaggcaagcaaagataggcgtgtaatgaaaattgggatccaacgaggtattcaaatggtttgacgtcgtaacttatcactgatgaaacagagcttattgacagtagaaatattctggaaagcatcgaggaagtcttgggttccgaagaggcgatcgaatgagatggtcgcctcctccagcatggggagcggcattggtattcggcagccgttgtcgtcacccatcgccatggtgatgaagagttcccggagtttgggcgctctgatggcccacgtgtccacgccgccgccggtggtggtgatcacgagtgacaacttgagcacggcgagtttctccgccgcgacgatgaggtgttcgagctgcgtgccggcaccggcgaacgggagggtgacatacacgaggtcgaggcgctcgaggttggggaagcccggaaagcccggcggcgccgccggcatgtcgcattgctcgaggtcgaggcggacgagtgcggcgcaggagaagagggcgggtccgggaaggcggcacggcttacggcctaacgagaactccaggctgagatcctggacgcccttccgcgccatggcgcggagccagcgggcggctcggaagacgtcgcggcgggcgacgcgggcgcggaagccgcggacgggccgcgcgcaccgccacagggcgcggccgccgccggagtaggcacggggcagctcgatctcgaggttcttgatcgactcccagcggcggcgctacgcgcgggagaggcaggaggtgcggaccagcttgtggaaggggagcagcacgaggatgcggtcgtcgaggatgtccgacgggagcgccatcagcatgtccgtcctgggcggcggcggcggcggtggcgcctgggccggcagtcgctggcgcttgggggaggacggggaggaggaggagcccgaggtcgccattgttttggaggtggaggtggaggtggaggtggcttgctgacgacgctatgatccaacggccttcttcttgaaccttccccaagatattttatagggtcagccaacgagttggaggataaaatcgagctagccatgtttagttaccaaaaacttttcacaaaaatatcacatcgaatctttaaacacatatataaagtattaaatatagataaaacgagaaactaattgcacagtctacaaatcttttgagtctaattagtccataattagctataagtgctacagtaacctacatgtgctaatgacagcttaattaggcttaaaagattcgtctcgcagtttccaagcgagttatgaaattagtttttttcattcgtgttcgaaaaccccttccgacatctggtcaaacgtccgatgtgacacaagaaattttcatttcaccaactaaataggccctatgttgtgttttactattgcgttttacttcccacgaaaggaagctacgaaatgtgaatgtaccccgctgaaatggttctcttcttttcctttgattatgtaagtgtagctatttgcgatgtgagtgtagctcaactgattagaatacttgtggtggaatcaacccacccaagttcaagtcctatactttacacgggtgctcacattatggctaatattcttttggtggtagacgatatgacacgggtgctagctcacatttatggctaatattctttatgaggtgtctgtgatgattacgggcagatcgagcgcacggcgtggtgcttgcttgccgacgtcgacgctgtggcggcggagcgagacggtgatgtgggcgctgtcgtagagcacaaagagaccgcgcacggctgcacacaaatcaccatttcggacttgcctccctactgcctcgggaggtcttggtatcctgaatcttgaaaagttcgcaagggctatttgattgcgatggctcttgcacgaatagaagtcgccggaaaaggctttggtggggtcagaaacaccttgtaatgaaactgacaagctactgtttgcagtggcaacaacaatacaaattggagatggagcgaaagtgaagttctaggagttggcttggcttcaagggagaagattgaaggatgtcgcaccactagtccacgcgacctctaggaaaaagagcaggaccctcaaacatgccgctttagcagatcaatggctgcacgaccttgctctaccaacaaacgaaggatggacaatggatctgattgaccagctcatcaccgtttggagtgccgttcggaatgtacacttcatggaacatgaagaccagatcacctggaagctcaacaaccatggcgaatacacggccacctcagcctataaggcgcagctcctaggtacaacaacatcgtcgaattttgacacattgatatggaggccttgggcaccgcgcaagtgcaagacctttgcctggctgaaactccaaaacatagtgtggacattagacagactagcaaccagaggctggcccaacggatccacatgccttttatgtcgccagactcaagagacagctctccacctgctagcggaatgtagatacacaagaagaatccagaatgaaatcgtgcaatggacaggcaatgaccatctaagaccttctagctggcaaatatctttgacggtacatgagtggtgggaggccaccgtaagcatacgggaaacacctaagaaggcactacgcacgttaaccttgcttgttaattgggagatatggaacgaaaggaactggaggactttccagcataaagagttgccggcgccaactctgctagccaagataaaggaggaagcaaaaacatggggttggtgggcacagaaaatctcaccacttagttgacaacgtaactacctataattggtttttgtttttttttcgtacattatcctttcttacagttttcgtctcctctatccaatgaaattgggggcctcattgattcgttaaaaaaatggaggacttgattagttggttaggattaagtacatcacgggaaggatcgagaataaaggaggcgatcgatggactgatctggagacgacggtgaggggcgaagaagcggaggtagacgaggtaggcgacgatgatatcgaggggaaggccgacgacgaagccgaggaggtttcacgcccagaaattcccgaatagaattccaagcagaatgtgcattaaaacccccgtccaggaccggccagggtacacaaacgacaaagttgacatacagatccacgtcttacaaacatcataaaagtcttacataaatgcagcggaaaattaaaagataactggagctaagccttgacttggactgcagtgggaacaccactccacaggaatcctcgatggcacggacgaagcctactcctcggagaacccaccatctgacacgtactcaaactctgggggttttggggaaaatagagtaagactgagtacaactaccgtactcagcaagtcataccggaatagagggtatgatgtagggtataatcaaagaatagctagagcggttcatttgcataaagcgagcatttaaagacggtagttgaaagcagtaaaacagttgtaataattactcaatattaaccatccactgtccagcgctacaccacgttgtaacaggcccaaccatccacctgaactaatcaattccattagactagactagggtgagactaatcacagtgaatctggttgaccgcccataaccgcgggtacggctattcgaatagttttactctgatcagaggtgtacaactgtacccacaagacacagccccacgacacgtttccgtgcgccgacatgccaccacgacataccggaaagaggccgtgacaggacccttcgcataaccacctctagccaagcacaccacacctcaggtttcacccccgtccccagcgggcaacgggcagtcccctctcgtgcctaggtgaatccggaagcgacagaggccgtcaaagggcccgccccacttcatcacgcccacccttgcctggatgcgtcaactagaggaaaactacactacaagcccagccgttgcccacgctggcttgtggtaagtacgaggaattcttccagggtttcccgcgaaccggtccttaagtgccatgggcgcgaccatcacaaccatgcacccatatcccaccatatggtatattttaattgactaacaccagaacggtggctttaatccaacaccaacactagaacctgaagtctatgcattaatgtgatttcccccatggtgcgctagttgaactaagcatggccaagcaatccctagtccaatctctagtcatgttatatcctaggctaacaaaggagcatggtacaaaagtagcatggctgtaacagtaggtaaacatcccatagtatcattataaagcaatgcagtatttaagggaaaacggtagagcatttgtaatataggatcaacatgttcaagtgacaagcatgacttgccttgctctgctgctggaggaacctcggcgactatttcaaagtacaccagagcgttgggagagccggaatctaagtgacatataaagaaaacaatacaaacaggctataagactactgaaacagataacaaaaccatttttaatggattctatgcatttttcttgatttactgagacttgaatgggctcaaacggagctcggatgaattagatatgaattttagaagattcattgtgtttttactataaacagaaaaatccttaattgatttattgcgcaataattaaaatcccggggagagatagggcggcgccgacatgcgggccccacatggcagtgactcgggggggggggggtctgcggtggaacgggtccacggactggggaaggagcggcgcaccacgtggtgcatacgtggcggccacgtggcagccacgcgggcggcggggttggacggcctcgatctaccctcgggtagatcaggcgggtagatcggacggcggcaggagcgcgtggccggcgcgcacgggcggctcaagccggcccggcagccatggcgcacggcggcgcggctcaacgcagcggcggcgcaaggcagcgaccggcggcgaccggccggcggcggagggcagcggtggcgcggacggcgacagtggctgctaagcggcgcgggagagagggaggaaggggaggaggtggctcaccgacggcgattgacgacggcgagcgacggagcgcgacgacggtagcgggacgagctccggaatcacctagcgaacacgaagaaaggggttagagagagaggaagatggaagagggcgaggacgccggccaaaggtggtggccagggcggagctcaccggcgcgcggtgtgaacggggttcccgcggctgaaagcggcggcggaaaggcggacggcgtggccctcgggcttgcgaacccgatggcggtgtcggcgcggctcggcgcggtggctagcggctaccggagcggcggcggtggcagcggcggagaggagggcgaaggcgctagggcgatagaaggcacgagagagctcggcgaaatggagaaaaagagagaggggagagcggggatgcttaaataggggagagggggctcggacgtggccgggagcggcccgatttcgtcggagtagtggggagggggtgagagggcatggccggcgggattaaaattgaattcccggccgtttcggcgcgggcgcggccggggaagagagggagtgggcgcagggaaggcgggcgcaggtggcgacgtgggcgacgacgtgggcaacgtggcccggaaggcacgggagcgagggggcggcggcggttgcgggacgcgcggcaacggctggaggttgggggaggacccgacaggtgggccccacctgtcggcgacctcgggagagaggagggggggctcgggcggccggctgggccgttgtcccgcccagaaattctcgaaccagaatttctaagctgaatgtgcattaaatccctgtccaggaccagccagggtacacaaacgacaattgttgacataccgacccacgtcttacaaaaaaaaataaaagattacaaatgcagcgggaaagattaaagcgagctaaaccgggaagcttgacttcagcagcgggcgactacactccacaggcaaaccttgacggcagcaacgacaccaacctctctgagacggctccaactgagaagaacttcaactctggggtgggggaaaagagagcaagactgagtactacccactgtacttagcaagtcatatcggaagaggagatatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacactagttcattaagctaaactagggatgagactaatcacggtgaatctggttgatcgcccataaccgcgggcacggctattcgaatagttttactctggccagaggtgtacaactgtacccacaagacatgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtgagcacggtaagtctcccagggtttcccgtgaaccggtccttaactgccatgggtgcgaccagcaaaaccatgcactcacagcccgccattcagaatattttaattaactgacacccttgcggtggcaccaatcttaagctatgccaatagtcagagtctacgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacaatatgatcaaacgtattgcatgacttgccttcctctcgaactgatgagacctcagcaacgtcttcgagaaaccgcggatcgacgaaacggccgaaacctacgcgacaaacaaagcacacaagcaaaacatgctataagactactgaaacaggaaacaaaaccatttttaatggattctttgcatttttcttgatttactgagacttggatggacttaaacggagctcggatgaattacttatgaattttagaagataaactgtgtttttactaataaagaaaaagtccttaattaattattgcgcaataatacccaggactgacgtcagcgaaggggggggggcggcgccgacaggcggggcccacgggtcagcggctcaaaggggagaggaagggggtgccggcaagcggggcccgcatgtcagcggctcaaggcggccggtccacgggaccaagggtctggatcggcccaagccgatcggacggtgcagggagcagccaccgggctcggcctcggcttcaagccggccggcaagcatggcgaacggcggcggcatgcggtcgccggcgacggcaaccggcggcgtgggaggcggcggcgggcggcgcgaaaagcggcggcagcggccgaaggcgacggcgcacgcgcgaaggacggcggcgcacacgggagagagggaaaaaggggagcagaggggagcctcaccggcgagcacggcgaccagagcggaggatgaaaggcggcggtgacccggcgacgaggaggggcggacgggcggaggcgacacctataggaaaggaggagagggattaggggtggagaggacgaccgcaacgaccaaagtggccggccggagatggatgaaaaaggagagctcaccggcgagcgagggaaatggggcttcgggggtgattggcggcaaccaagcggcggccgaggagcggacggcacccgcgagcgcgacgacggcggcttcacggcgcggcagcggctctagcggcggtggcgcgcggccgaagacggcggtaggcggcggcgcaaggggcgagcggcgcggcgacgataggaagcacgggagggcgcggcgagtgcgaacaacgagagagggggacgtggggagtgatttataggtgcgggagggggcggacatggccggggtggtggccgatttggccggcgacgtgggggtggagagagagagagaatgggggggattcaaattcgaatcccgccccttgcgagcgcgcgcgagggccgggagatgcgggggagaggacggcgacgtggggaggacgcgggagcggcgcggcgtgggcgcgggaggagcgaagaagccggcggcgcggacggtttcggcggcggttgccgtcgtggggcgggcggctggaggaaggggaagacctgacaggtgggccccacctgtcagcgtcccggagagaggggagggagggaggacttcggggaggggaaaggggaacgggccggcccagaggaaggaggccgagcgcgggaagagagatgggccgacggcccatctagagaaaaaggaaggaaaagaaaaagaaaaagaagaaaggatttttcctgggatttaaaattgcactttggtgatttttaattggttaaaattatttccaaggctctgataattccactaaaaatcttgttaatgcattagagcatggggaactcaagaaaaattccaccacgctatttccgattattaattgcatttattaactagggatttagctctaggttaattaagataatttcttcgggcaatttatttatccaatttttaaagcaagaaaaaggggaaacttctgggcgtgacagccgtggccttcggctggcccagtggggaggggaggaaaatgggctggcggccaattaggaaaaaggagggaaaaaggaaaaagaaaagggaaatgaattttcagggattaaatattgcttgtgctcaattttaattggttaaaattatttctagagctctgaaaattccactaaaaatcttgttagcatatttcgacatgtagaactcacgaaaaattccatatgccaattccgattattatttgtattaatttattaggatttctctcatgcttttacaccgatatttttttagttgatttataaatctaatttaggcttgggaaaagaactttcagggtgtgacaggaggccaccgacgagccccatcccgcccactcgcacgaatgcagaagcgtccgcggataaagaaatggccggccagcgagctcgagctcctcttcctcagagacatcgcgcgaggcgggagctagcaatgcgccaaagcttagtttattgggaggtagcggagaaccagacacggcagagacaacggcatgggcggcttagcttatatgggtcgtggttgcggccgcgcaccgccgtggcaaaaatccgcggaaatatttgcgtttccagcctcgccacggcgttgcccatctttggccgccgcggggctgccgccgtgcttccccgctacagccgctgctgcctgctttcgcggcgccaccctcctcctctcccgcctcgccccgttgatcggcctacggcagagaagactgaaagagagaggaaggaagagagatgacgtggcatcctgatatgttgggtctacgtggatcctatgctaactcagccgccacgtcggacaaaacccatgtcaaaaccaccaaaaaacctattatgatcggttttgattagttaagagatgcccagatacgattttgataaattgagggatgtttggtgtactttttcctcctactaatgtcccaaatcttcgcgttgtccccactccccacgcgagaacttcccggcgcgccaagttaccgtcattgcactccgactcccgatttttggtttcgatctggtcgcatcgcaccgcctcgccctacataaaaggccgcgcccctctcgatcccctctcccatttcccaccccgccgcgcctcgctcgatctaccgcctccgatccgcttcttcttcttcttctcccccgcgatctcgtgctctgatggcgatggcgatggcggcgtcctcctgcgcgtcctgctccgccgccgcggattctttctcctcatcggcgtcctcctgctgctgctgcggctcctcgcggattcaggtacgtggtgatgcccctttcttgttcttcttgcaggagctaggtgtcggtagcggcggcgaggggtgcttctgctgtgcttcgtctccggggtacacgccgtcga

SEQ ID NO: 81968 - DNA, 17224 bp, Oryza sativa
atatttgtgcttcaagaaataaggccaaacttttcacgaataatcatcaacgatagtcatcatgtactgagcacctctaaaagatgtcttacgagcaggcccccataaatcagaatgcacataatcaagaataccttcagtagtatgtgtagatgtattgaacttcaccctcttatgcttgcaaaagatgcaatgctcacaaaatttgagcttcgtgatgctttgtccatctagcaatcctcgcttgctcaattttgccaaaccaatttcactcatatgcccaagacgcatatgccaaagattagtagcatcggaattagataatgaatcagaaactgtagcaacattacctaatatagttgtacctcgcagatggtacaggttggcagatttaatatcagctttcatcacaacaagagagcctttaattaccttcaaaattccgtctccaccggaatatttgtaccctttgcaatcaagagtacataaagagatgagacttctcttcaaatttggaatatgtcgcacatctgacaatgttctgatacagccatcaaacatcttgatctgaactgttccaatacctgcaacctcacatggtgtatcatcacccatcaaaacagtaccaccttgaacaacttcataagtggcaaaccaatccctattcgggcacatgtgataggtgcatgcagtatcaagaatccactggtcactagtttgtgcacaaccagcataagcaacaagtaattctacatcagacttctcatcagtaacaactgcggctttaccttcctcttctttcttaccttttggtacatattttccggttctcttgtctttgtcctgcagcttccaacactcagagatatcatgtccatctctcttgcagtatttgcatgacttatacctgtctctggattttgatctcccacggtagctacttgagcttttatctcttgattggttctttgtgttcttctcctgttgcatgccccgaacaaccaagccttctgcttgtgaatttgaaccttcagagggtaccatcttcttcatcttttctttggcatgcagagcatcataaacttctttcaaagttagagtatcacggctataaagaatagtatccctgaagtttgcatatgagctaggcaatgaacacaatagaataaggcctaaatcctcttcatcatactttacctcatagactcaaggtcaacaacaatttctttgaaagcggagagatagtccatcatagacccatcatcttgtaacttgtgcaaaaataatttttgcttcaggtgcatcttactggtcagatccttagtcatgcatatctgttccagcttcaaccacagcccagcggctgtctcctccttaagcacctcctgcaaaatattgttagatagatgaagatgaatatatgacatagccttacgatcccttttcttctcatcgttggaccaatcctgtgtcctcttgtcaaatccagaaagcgcatcatcgaggtcttgttgtgcaagaacggctcgcatcttcacttgccaaagtgagaatcttgtgtctcgatccaggagcggtagatcatacttcaaactcgccatgggaattaatcctgaaatttgctagaaagaaattagggtaaacctagcaaaaacgcgaaacctgggtgcacttcctgtgtgcacttcctgtgtgcacaaagcgaagtatgtagatttcctggtacacaagctttggtgcgcttagcaaaaaaaaatcgccaagaaattccttctcaacaggaacgatgtagtccctgacttcctcgggtcgcgtgccctacagttgcagtaggccggccctttttcctcctcacggctgtgcggttgctgcagcttctgcttttctcgcgcgggtgtgtgaggacggcgcgactcggactcgacggggtactgcaccgaacagattgattcggcgacgacgaaagcgaaacaggcggcggcggcggtgtggtgtagattgatctccaatgctctgataccacttgttatgaaaatagatgtataacggagacacgaattttacgtggaaaacccttgcggaaaaaaaccacgggcgctgaccggcaatgatcactgtagagtaaatgattacaaacatagggaaataacaatgggaacgtcaccccttcccgtacggcttacaagagtatatatagaggataatagaaagacacctaataggatatacatgaagtcttactaggaaactaatccgaatatattgtgggcccaaaattcggatcacatatttaacacctcgcgtggtggcgatggcttcctgaggagtgaggacgctacgcgacagtggccaccttcttctggaagctttggaccgcgggataaatgggctgaatttcactatgtgggctgctacgtcaccggtagattcaacatctgacccattcattttttgtattgtgcagccaacacaaacagtaagttgagtctacagttgcagcagcaacggctgcatacagtggctgtaccagccagccgaacaggtccattatcgattggaaatcaggacagaattcccatagcatatatactacgaggtgtctaggtgtataactaattttttgcgtgggtttgaaagtcaaattcgtgagaatcacgtagaatctctatattccaaaagatcccttcatgggtgacgaaatgccaatttactcccttcccttaatattacaagtcattttgtcttttcttaagtcaaaattgttgaaaatttgatcaagtttacataaacatataacgacacttataacactaaattactaaatcagtttataccccgcacatgattagtttaggccacgctgcccaaccacccaaaaaaaacatgattcagcttgagcttaaaaaaaagaagatttggagagagagacaatatattttaaaaaaaatgatatcgcgttggggattgaagacgggacctcgggcttaaaataacacaccccttaccacttcaaatgctaatacagtctccgatcaaatatacattggtgccaaccgtgcacaaatcatttgaacgaagccttttgattcatacataagaatctgaaccttgaggtgccccgtaagctgatctaaaatagcaccctggcatctgttgcaacacgattttcagaaaaacctcagaaaattttgaaccctgattgtcgacaacattcagttatgtcacttcaaatgctgttttatactcgttccgtttctaaatatttgatgccgttgatttttttaaatatgtttgaccgttcgtcttatgcaaaaaaaatttaagtaattattaattttttttcctatcatttgattcattgttaaatatacttatatgtatacatatagttttacatattttacaaaagtttttgaataagatgaaaatatcaaacgtgctaaaaagtcaacggtgtcaaatatttagaaacggagcgagtatatattttgaaccaaatcgtcaaacgtgaaaagtgctcctgctagtacccagtattaattgcaacatccttcaaaactctaggatacattgacagcatttgaagatcaaggaaaaaaagagacgcaaacatttctagcaaggcatattcacagctctctttcatcatgctaaatcagcctgtcattcaaaaataccaaaatgctaaatcagtgtcagcctgtcaccaaattatagtgttcaactcaaaaaaccgtccactgatacagtgaaattctatgcattctgccaacagaaggaaaagtagcagctgtatgtacaacagccacatctagaatgtaacagatcaaagttcaaaagctatgcttccataacagaaaggtggacatggcaaggacaagaggtacaacactctgtaattcctcaagaaggaaaacaagcagctggttgcacaagaacagcctcatctagaatctaaacagtagcaagttccgaagtatttcttccataatgcgaaggcagcatcaaaaaggacaggatgtctaacttacgatccgtcttgtgtcacttttgctgtcaacaaaagttggggtgaagccttttggcactcgattaactctttgcatttattttcaaaccattcgctctttccatcatcatcaaacataaaagtgacagcaaatgtttgaagagagcctgctttggacagtaaaaacttcataaagcacatttgattttcgcggtgcttggcaccagtcagggacacatgtttgaggcttgcaaacaagtcactgcttatctctgaatttagggagtcttcatcaatcttttctttatccaattctgtatcaagagtctacaaaacaaggccaagtttcaattaactcaattgaccaagagatgtctttaaattgaacatagcagttgaaggtgtgaatctaacattacctgaatttcaaggtgctcaatatgcggagcaaacttcagtaaagaatctattgatagaacacttgagagttggccaaaatctatgttcaggctggcttccctcagattctcaaacttgcatgtaattccctccagcatattaatgctgaactgaaagtcataagaacattgttaggcctgacatatgtccatgacgcaagtttacattgagccactaaccaaagaaatatgcaaatattaggacaccatgatcttgtagttacgaaggttcttcttggaccttcattttcagaacctaagaagccatattgtcataaatgttggcatttgcatcagagtacatgtgtttaaatcacatctgccaaaacacgacataccatctctacaagctaactagtttcacattcatcaattcagtcaaattgtaattaagttgctcgcaatgaccaatctattatctatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgtttagtactttttttttcgtttgttcctttcttttctttttccaatcctaattaaaattgaacctatctttatagaaaagaatacccccacaaatagacatcaaatgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttttacgctttattagttagaaagaaaaatcttctattatatactaaaagttcattaaacttcctacgaacgctcctaaattaccatgtggcatcctacaaaacgtttctaaaccgctacgtggcgttctaataaatcggtggatccgctatttgtttaataaattgctagactcactattttcaactattatatttatctttataaaaaaaatatcccacaacccaccccttctctcctcagtacgtatgtatgtacgtaatacaatgccatgctttctcccctcttccaatccttctcttcctatttctagatgaaaattttaacatgaaaaaatattataataaaacatctaacctttgcttttcacttaaatcgatcggtgaaccaactattttaaccattgtccctaaaaaaatattttaacgattatttaaaccggtgaacccattaatctatatataaaagaaacacttccctaaattttaccatagaacattgtgctttgcatgaaaaccaaatataaacaaacattaaaaccattagatttaggtatatagatggtttaaaccggtgaacctatcaaatctatatataagaaaaacgctttcctaactttgaatatatactatttttctttgcaatgcaaccaaataaaaacaaaatattaaaaatggaaatatatattatggagtaaatttcacaaacccacgtagatatatctatctattatataaaagtccattaaacatcctaaaaagctcctaaactgccacgtgagattccaagaaacagtgcaaagatgacacctaacgctctaattaattcctagaaaatctatggaaaaaggagaacatctaaccattggttttatttaatctgatggacctaatattttttttaccatcagataccattagatttatctttagtaaaaaacttaagatcaatctggcggtacgagtccgcccaacacatatacatgcttccatccatacgcatgataagagtctgtgtgattttttccttgctcgcctcccttttttcgatggtaattaagttaaggcttaagggtatataatatcttctatattagtaagttaattttatcatactttcaaagattgcatacacttgcaaatataggtatagataatatatctcatacatattgatcttggtatgttttataaataaataaagaatcttcaatagctgtaaatcttaaattatatattcaatttatgatctgtttgaaccattgtgtttttttaattaaatcaatagtttaatatctataccaaccatatttaattccattgtgtttttttaattaaatcaatagtttaatatctataccaaccatatttaattgctaataaaattattatattttggacccacatccatacgcaaaaaatcctaaaagttctcattacaaatcaaaatatccaacttagttttttaataaaatcaaaataacttataaaccgctaaccttaaccttaattatagcatcaatggacctattgactcacaaccaacttaattatatctctcgacatatatgtggatgctatttacttaattccaatgccctgataaaatatatgatcttcttttaaggataaatgtacgatcttatgctgtgttcggtgctgagggttgggaaaccttaatcctttggaagttggacattaacttatatcccaaaatacctatatcacgttgcttaaatccaactaatacaccaagaaaagaagaagaacagagggtgtctacagatcagtccttatggatattttactaataaaaattgatttcaaatacttatttgtacttattaaattatctaatcactagaacaaaggaacataccgtccatggagtgaacaaattggagggctaaccggtgcatcccggtgtgcatgcatgggtatagaactttttttctttaatgaaaagaggggcatgaggtagttacatgtatatacatgaagggcacttttttttcttctaagtatgatgatgtgagcatgctgccggagacacgaattaacatgtctaccatccatggtgagggaagacgaataatttgcttagttggactctacacaatatgttagatcttctacatatccaatggttacaaataatggtctaaactcgagggtcatatattatgtttaataaattaattaccaatttttctatataaatcagtagagccattaattatatatggtttgtgtatgtaatgtcttttataacttaagttttttctctttcactatggaatcacaatttcctatgaggaattatccatagctatgaccaatcaatgtttgccgtcaaataataaattaattatcatttttttctaaaaaatgggtagagccattaattatatatggttgtatatgtaatgtcttttataacttaagttttctctctttccctgtggaacctcaagagtcatatatatcttaggtaccattttttataccgtaagataccaatcctaatctccaatagataattttataaataacaattaaattcgtcatgcaattctaacgaagaaaattcatgggaaaaaaacataattttaaaacattgcagatattaattcgctggtataccgcctttataagtttctcaaatttatcctacgtacggtgcatgcccgcgcgtatgcgcgggctaccttcctagttacttttaaaactattaacaagagataggtatattttccccaatgatttctagttccaactcagagactacttaactgactgaaacatcttagtagccacaggaaaagaaagttcggaacaaaaaatacagactaccaaaggggttgagccatgttcttctgtagcgatgcatgcaaaatgaacaggcctaaagatgagtttgtgtaaagcatgaggatgtgtgccaactacacctaaaccactcaatcaccttacaggtcgttttatcacaaacaagtaagcgcatctctactatttatttgtaaatattttaattcttgtaatattttgtgcacacagtttctctaccgtctctcaatgagctctgtctcaactctcaaacaaaattaaaaggtggggcccaaaagttccgagggaatgagctttcgaataaaggagctgtcttgaaataccaggaaataatcaaggccattgtgccccactgctccatcactaagtggaatatcatgaggtagggagggagataaagagctagtggctatactgtgtgaaggaggttgggttggggaatggtaaacaagggaaaatattcctacaaattggagaatgctaacaacagaaaatatccctacacacacaatataggagatcttgggtttgtgttgcatggtggtattcggttgaacacatatgatgctgtatttattggttagttgttattacttcctggttttgttgaacttgatgaagctttgagatttcaaacttttatattattgagaaatttccttgtgcacccaaaaaattttgatcaaactctttcatatatatcctttggtctcaatctctttcatatccttcggtttttgtctcattccctagtagtccttatatttttatcctctacacaataattctattatgtgattgtgtattgaccatttgtttcagaaataaccatattcccttcacttgtttttttttctttttggactggattacccttgatttgtaaatgtcagtgctagcttatacagttaaatcataatcctcatgatgaaatagaatcacttatgaaataatttacaggaaataataatttgaataaatttcactcaaatttgaataaattttaatatttttacctcaaatttgaataaattttaattttttagtcaaattcataaaaaaaatggatatatattgaaggagggtggtgaaattactaaaaaaattaggtaaattattaaatttaagtgaaatacaaataatttactcccttcaaatatgactaaaattttgtgattctaatttacaaatttggtgaaaatttaaaaatttaatgatttagtttattttccctccttgaaaatgatatagctaaaacattttcttgtgagggatttatttttagtgcggaggcatattgattattgttatgagtgatggcaatatagtcatttcataaaaatattacgatcaactcaataacaacataaccgaacaattatatgaggaataaaattgaaaaatatgggtcatgaggcacgtaggtatcggggcaaaactcattggtatagaaggaatcgagcgaaatcttgagagcatatagtgaaatttagcatgtagtaagaactcttatgtggactatttgggacccaacttatggcaattaatttcaactgacgggcaaaataggaatttatttgtccgtattatgtgtgttacggaaggtctcggaccaaccatagcatgcgtcagtgtgatttgttcatacaaatagcaccgtggttttgtctacaatagaaggttccttgcgaagtggctaacatgatgacaacctattgcaccatcatctatggacatgggtccacagttcggcccgaaatggaaggtttcgggcttgggtggcaaacaaggcaccatagcatatggtgtcttaccacatagcccctagcatttcttaccacatagcccctagcatttctagacatggtgtcgtggatctgctaggaaaacaaggttccttgcatgggtagaaaccaagtgttgttgtttctgctgagtatgataggctccgcaccatatataggatatggtgttgcacgtagcaccgttgaatccaacactgttagcaatggagtcatgctttcgtaattccttgaaagcatcatggaattacaaaggggcaatccttctttgccatttggaatttcatgcgatcatttatttgccccgatgtctcactaacacgtggcccttggaccaacatgacattattgattaagtacatgcatagagacatatagtgcgagcaaatacatcagccatgtaccatatgacaccacaagtattattactaataccgagcatataaaacacatcacaagtgtcaatacaaatttcgatgtgtacaacacaaagttgacacatgatttcttcatcattagcctctttcccctccgcaaggaatttgtaccaaggatacatcacttggttgatcatgattgttgtgcaaggaggaagatgtatatattcacatcacttggttgatcatgattcgctaaagcatagtatatattcacatttcaagttcatgcaacaacatgtaccttctacggatccattcaatatgaaattacaattgttaatcctactaatactttgaatacggcatactgctaattaattaagtcactgccacctcaaattcaagccgatactaaaccagggactcgagatctctcattacgggatgaggaaggaaaggggagatatggactctgcaggatgcagtacctttttaagtcccctctaatatatatgttgctagggatcacgtgatcacactatatatagaacaaaacggtaaaggttgtcgtggtaacttgattcacgttgtctgtgaccacctccacattaagggctcattcggatcacgggatagaaaaaacgtaggataggaaaagtataataaaggaatccaaatgtaaaatagagggttggaaatcaaaggaatatagaagatgggatcattgggagtagaggatgggattcataggaaaggaacagtaattaatccaactccgtttttcccacactcttttgtttcccgttgattcttcacgagccgaggagcagcagccctccatcccgtcgccatcgcctccgtgtgcaggcagccctccatcccccaactccatgccattggccgtgcggcccgtcttaattcttccccagcctggcctcctccaggaccacttcgtgctctaccccttctcttcgactccgacaccgagctcgctggctgccgcgccatcactgaccttctcatgcggtattcgctccacgccggacgccaccctcgatacccatcgcgtcggcctccgttcgccattgacctccgctcgcaacctccacgccaacgacctggcctctcctccatgctcatcgttctcctatgagatgtgcttctttgtttctttgttcttcactgatggcatcagttattagtgtttgattgtctcctttggatgcgaaggaaacgggaaaatgaggttggagtggatgatttctttcatgtgttttcccatggaatgaggaaacgcgaagcaacaatttttttgcatcgaattcaagcaacacttaaagtagtaactgatggaaaatttctataaactatggtgaagagatcagtttaatgtatcttgttttgtcttgccagcgagtttacagtccagttaaagaaaaatgtttcctagagatccgtttgcaaatattcgaattgaaataatttcactctcctgcgcaaggcctcatttatttatttatttattgccggaacagggcctcgtttgttgatcaatattgcatttaatcaattaataaactctcttattcattagtacctatgtttttgtatcatatgttgctttgacttttattctaatcaaacttctttaggtttgatcaagtttatataaacatttagcaacatctataacaccaaattagtttcattaactataacattgaatatattttgataatatgtttgttttgtgttggaaatatttctttcctttttttataaatttggtcaaacttaaaaaagtttgacaaaaataagttaaaatggcttatattatgaaacagaggaagttataagtttatctgattgaggagtagttttttttagagcgagtggttttctctttattatctcccaatacacaataaatgatttctggtttattcataggtttgaaaacatgtacctaaaaatattcaaaaattgaactattaaccaactaaaattagctaattagtacttgattaacattagataaactggtctatggattaattcaagtaatgttaaaattggtgtaaattatggtggagaggaccagtttaatgcgtcatatttgtttttgcaagaatccaaattgaaataggcctcatttatttacttatttattttggcctgaacaaggcctcatttattgttcaattttttgtatttaataaattagattaataaactcttctccattaacaaatctctacaaagatcctcctcatcatctccaatatacatagtccaaaaactactactaaatcatactccttccggttctataataattaacgttttagaacaaggttgaggtcaaacttttataactttgatcatcaataacattaaaaatatttagtttaaagaaactagaacagcatatgtagatttgtctttcaaagcactataataaaagttaaaatgtatttatttattgtatatattataatagaaaataaggtcaaaagtatattttgtagaccgtgtcattgtctgaaatgtcaattaaaatgaaatcggagggagtagaaacttattaatcggagtaaaatgattccaattgattcaccaatttaaaattaagtgttgcacctaaaaattctcccaaatcaaactatgtgtttttttatggttaacacactcctcaaaccggagatttaaaacctcgttaattgcacgattaaaatcgatcaaacagattcatggaataattcaagcaaagctaataaataacttatgaaacatttcgtgtaaattattggtgaagaggatgatcatgcgtacgtacctccctgtctctgacagagaacttgagcaccttcacacgcgaaaccagccagagagtgtcgagaaaatcttcagttccgaggaaggcgtcgacggagatgttcgccgcgttcagcagcgggagctcgccggcgacgcggcagccgttgtcgacggccggcgtccagagcgtcagcgagtggagcttgggcgcccggatcgcccacgcctccggctcctcctcctccaccttcttctcgcccccggcgacgacgccggtgatcacgtccaccaggagcaggtcggcgaggtcgggcgcgccggcgatcacgcgctcgagcagcgcgccggcgccggcgaacgggagcttgacgctgttgagcgccagcctggtgaggcgcgggaacccggcgaacaacgacccctggcccggctgcggcggcggcgggcgcgggagctcgcagtagcggaggtagaggttggagagctcggcgcgggcgtagatggcgcggccgacgccggggaagacgccgggctcgtcggcgcgggaggagccgaaggcgagctggagcgagcggacgcgcttctccgccagcgcgcggagccagtaggcggcgcgcgggcggagccgcgggcggacctcgatgtcgaagctcgccacgggcgcggcgcaccgggcgagcacgccggcaacggcgccggcggagtagaacccgcggaaccggacgtcgaggcccgacgccgactcccaccgccgcgcccacccgcgcgacaggcagcacgtgcggaccacctccttcagcggcagccgcgtcaggatgtcgtccaggatctccggcagcagggacagcagaatgtccgtcccggcgacgtccgacgccgccgccggcggtggcagcggcggcgacggcggcgaggaggatgacatcgacatggccatctctagtgacgcgggtgcgagtgtgctgcgagtgacccccaccgcctacttgtattgtatctgcaccgaatgaactgcaccttttgcgtttacgtcctttgataaaagaagtattcagtttcacgccgtttagggggctatttgtgattctgggaaggaagagagaactgttcaagggaatactgaaatttgggacgtacatccttgcaaagttgctcccccgttcgagcgtgagttgtttggaaggaagcgttacattttgaattgaatgtagtggtgacgtggaattttcttgctgaggcacaaagtgccaaagggaccaactgatcgattgtaagccttgtaggcgaggaacttgcacgctgagtacgaatttgtgactgtgaacgatttcaccatggcattgagtcgtggatcgatttcggagatcgatggtatgaatatctttctcgactaatatctaatatacgaatgaactattttaccaactaggaaggtagcccgcgcatacgcgcgggcatgcaccgtacgtaggataaatttgagaaacttataaaggcggtataccagcgaattaatatctgcaatgttttaaaattatgttttttcccatgaattttcttcgttagaattgcatgacgaatttaattgttatttataaaattatctattggagattaggattggtatcttacggtataaaaaatggtacctaagacatatgactcttgaggttccacagggaaagagagaaaacttaagttataaaagacattacatatacaaccatatataattaatggctctacccattttttagaaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttgatgtatatacatgtaactacctcatgcccctcttttcattaaagaaaaaaagttctatacccatgcatgcacatcgggatgcaccgtttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagatataattaagttggttgtgagtcaataggtccattgatgctataattaaggttaaggttagcggtttataagttattttgattttattaaaaaactaagttggatattttgatttgtaatgagaacttttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaagatttacagctattgaagattctttatttatttataaaacataccaagatcaatatgtatgagatatattatctatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatcttaagttttttactaaagataaatctaatggtatctgatggtaaaaaaaatattaggtccatcagattaaataaaaccaatggttagatgttctcctttttccatagattttctaggaattaattagagtgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatatatagatttgataggttcaccggtttaaaccatctatatacctaaatctaatggttttaatgtttgtttatatttggttttcatgcaaagcacaatgttctatggtaaaatttagggaagtgtttcttttatatatagattaatggg

SEQ ID NO: 81969 - DNA, 20514 bp, Oryza sativa
ggtcgatgacccagtacggcggggtgtcggggtggccgcggcgcaccccgtcgcactcgatggcgagctcccggacgcccttgctcgccagggcggggaaccaggtgggcaggtggtggaagtggcgggcgtggacgcaggcgcggaagccgacgacgggcgccgcgcaccgccacaggtcgcgggcggagggcgcgccgcggcagccccagccgaggcggatgtcgaggtagcgcacggactcccaccggcgccgccacgcgtgggagaggcagcacgtgcggaccagcaggtcgaaggggatccgcgcgaggatgatgtcgaggacgtccgtggggagcgacatcagctcgtcctccctcgccgccgccgccatattccggcggttcggattcgccgttgcttcttcgcctcgtgttatgaaaatagatgcacaacggagaaacgaattttacgtagaaaacccttgcggaaaaaaactatgggcgccgaccggcaatgatcactatagagtagatgattacaaacgtaggggaataacaatgagaacgtcaacccttcccgtacagcttacaagagtatatatagaggataatagaaagacacctaataggatagacatgactagaaaactaatccgaatatattgtgggcccaaaattcggatcacatatttaacaatctccaccttgagacgaatttcctcttgtagcataaaaacatcaatcaccaaaaaatacctcatgtaggtaaaatcaccgcgcgccaaatagtctctaggactatgctgtcacacccaccaagcttgagcaaagcttaaacttagtagcaggaactggctttgtcatcatacttatcttgcataccttgacatcaccttcagcaatcacacctcgaataaagtgatatctcacatcaatgtgctttgttctctcatggaacatttgatcctttgtaaggcatattgcaccttgactatcacaaaatatattaatgcaagacgtaactccacaaagctcagtgtacaaacctctaagccaaatagcttctttacaagcttcagaaatagccatatactctgcttcagtagtagacaaggcaacagttgcttgcaaacttgccttccaactaacagcacatcctccaatagtgaaaacataacctgtgagcgatcttctcctatccaaatctccagcaaaatctgaatccacataaccaacaagtccatctttagatctcccaaactgcaaacaagcactagatgtaccacgtaggtatctgaaaatctattgaacagctttacaatgctctttgccaggattagccatgtatctactgacatcacttaatgcatgtgataagtcaggacgagaacataccatggcatacataagtgaaccaactgcacttgaataaggaactctagacatgtactcaatatcataatctgactgtggacataaatctgaagataatctgaaatgtgcagctaaaggaatactcactggttttgcatcatgcatattgaaacgatgaagaactttttcaatataacctttctgactaagatataacttgccagaatgtctttctctagtaatttccataacgagaattttcttcgctgcacccaaatccttcatctcaaattcactactcaattgtgccttcaactttgctatctctgatttatcttttacagcaatcaacatatcatcgacataaagaagcaaatatatagttggaccatcaacaactttgagataaacacagccatcataattggatcttctaaacttctgagaaagcatgaaagagtcaaatctcttataccactgtctaggtgactgcttcaacccataaagagatttcttcaacctacagactaggttctcttttccaggaacaacaaaaccttcaggttgctccatacaaatgtcctcttctaactccccatgtaaaaatgcagtcttaacatctatttgctctagttcataatcatgcattgcaacaatactaagtaaagtgcgaattgaactatgcttcacaacaggggaaaagacatcattgaaatcaatacctggaatctggctataacctttagcaactagccttgctttgtatcttgcctcatcacttggagacataccttcctttcttttgaagatccacttgcaacggataggtttcttctcctttggcaacttcaccaattcccaagtataattcttttcaagtgattccatttcatcatgcatagcagttatccatgtattgcaatcatcagaaacaatagcctcagaatatgtagaaggttcggcattaccttcaatttcttctgtcacactcaaagcataagcaactatgttcgcttcttcaatatatcttcgaggaggtttaatatttcttttgggcttatcttttgcaatagaatgttttggagactgctgaacaatagaagaatctgaatcttcaataacaggtgcatcttggttaatagcaacatcttctttttctggtgcatgccctgaactgatcaagtgctccacctgcacacttgctttctcatgattctcaacaggaacattagtagaaggtttgtcatgtaacataactgattcatggaagacaacatttctactaatcacaacctttttggtttcaggacaccataactgatagcctttcacaccagacggataaccaagaaaaatgcacttaatagctctaggctccaatttaccattatcaacatgagcataagcagtacaaccaaatacttttaagtctgaataatttgctggggaaccagaccatacctcaattggagtcttcttatcaatggcataactgggtgatcgattgataacaagcagtggaaacggcttccgcccaaaactatttaggcaaacctgcattagacaacatacaacgggcctttgatataattgtcctgttcatacgctcagctacgccgtttttgttgaggtgtgtgaggaacggtgtagtgacgcacaatgccttcagacttgcaatatgatttaaatatcttagaacagaactccatcccattgtcagtacggaggattttcaccttcctttcagtttgtctttcaaccatagttttccactctttaaacacattaaaagcttgatatttgtgcttcaagaaataaggccaaacttttcacgaataatcatcaacgatagtcatcatgtaacgagcacctctaaaagatgtcttacgagcaggcccccataaatcagaatgcacataatcaagaataccttcagtagtatgtgtagatgtattgaacttcaccctcttatgcttgccaaagatgcaatgctcacaaaatttgagcttcctgatgctttgtccatctagcaatcctcgcttgctcaattttgccaaaccaatttcactcatatgcccaagacgcatatgccaaagattagtagcatcggaattagataatgaatcagaaactgtagcaacattacctaatatagttgtacctcgcagatggtacaggttggcagatttaatatcagctttcatcacaacaagagagcctttaattaccttcaaaattccgtctccaccggaatatttgtaccctttgcaatcaagagtacataaagagatgagacttctcttcaaatttggaatatgtcgcacatctgacaatgttctgatacagccatcaaacatcttgatctgaactgttccaatacctgcaacctcacatggtgtatcatcacccatcaaaacagtaccaccttgaacaacttcataagtggcaaaccaatccctattcgggcacatgtgataggtgcatgcagtatcaagaatccactggtcactagtttgtgcacaaccagcataagcaacaagtaattctacatcagacttctcatcagtaacaactgcggctttaccttcctcttctttcttaccttctggtacatattttccggttctcttgtctttgtcctgcagcttccaacactcagagatatcatgtccatctctcttgcagtatttgcatgacttatacctgtctctggattttgatctcccacggtagctacttgagcttttatctcttgattggttctttgtgttcttctcctgttgcatgccccgaacaaccaagccttctgcttgtgaatttgaaccttcagagggtaccatcttcttcatcttttctttggcatgcagagcatcataaacttctttcaaagttagagtatcacggctataaagaatagtatccctgaagtttgcatatgagctaggcaatgaacacaatagaataaggcctaaatcctcttcatcatactttacctcatagactcaaggtcaacaacaatttctttgaaagcggagagatagtccatcatagacccatcatcttgtaacttgtgcaaaaataatttttgcttcaggtgcatcttactggtcagatccttagtcatgcatatctgttccagcttcaaccacagcccagcggctgtctcctccttaagcacctcctgcaaaatattgttagatagatgaagatgaatatatgacatagccttacgatcccttttcttctcatcgttggaccaatcctgtgtcctcttgtcaaatccagaaagcgcatcatcgaggtcttgttgtgcaagaacggctcgcatcttcacttgccaaagtgagaatcttgtgtctcgatccaggagcggtagatcatacttcaaactcgccatgggaattaatcctgaaatttgctagaaagaaattagggtaaacctagcaaaaacgcgaaacctgggtgcacttcctgtgtgcacttcctgtgtgcacaaagcgaagtatgtagatttcctggtacacaagctttggtgcgcttagcaaaaaaaaatcgccaagaaattccttctcaacaggaacgatgtagtccctgacttcctcgggtcgcgtgccctacagttgcagtaggccggccctttttcctcctcacggctgtgcggttgctgcagcttctgcttttctcgcgcgggtgtgtgaggacggcgcgactcggactcgacggggtactgcaccgaacagattgattcggcgacgacgaaagcgaaacaggcggcggcggcggtgtggtgtagattgatctccaatgctctgataccacttgttatgaaaatagatgtataacggagacacgaattttacgtggaaaacccttgcggaaaaaaaccacgggcgctgaccggcaatgatcactgtagagtaaatgattacaaacatagggaaataacaatgggaacgtcaccccttcccgtacggcttacaagagtatatatagaggataatagaaagacacctaataggatatacatgaagtcttactaggaaactaatccgaatatattgtgggcccaaaattcggatcacatatttaacacctcgcgtggtggcgatggcttcctgaggagtgaggacgctacgcgacagtggccaccttcttctggaagctttggaccgcgggataaatgggctgaatttcactatgtgggctgctacgtcaccggtagattcaacatctgacccattcattttttgtattgtgcagccaacacaaacagtaagttgagtctacagttgcagcagcaacggctgcatacagtggctgtaccagccagccgaacaggtccattatcgattggaaatcaggacagaattcccatagcatatatactacgaggtgtctaggtgtataactaattttttgcgtgggtttgaaagtcaaattcgtgagaatcacgtagaatctctatattccaaaagatcccttcatgggtgacgaaatgccaatttactcccttcccttaatattacaagtcattttgtcttttcttaagtcaaaattgttgaaaatttgatcaagtttacataaacatataacgacacttataacactaaattactaaatcagtttataccccgcacatgattagtttaggccacgctgcccaaccacccaaaaaaaacatgattcagcttgagcttaaaaaaaagaagatttggagagagagacaatatatttaaaaaaaatgatatcgcgttggggattgaagacgggtcctcgggcttaaaataacacaccccttaccacttcaaatgctaatacagtctccgatcaaatatacattggtgccaaccgtgcacaaatcatttgaacgaagccttttgattcatacataagaatctgaaccttgaggtgccccgtaagctgatctaaaatagcaccctggcatctgttgcaacacgattttcagaaaaacctcagaaaattttgaaccctgattgtcgacaacattcagttatgtcacttcaaatgctgttttatactcgttccgtttctaaatatttgatgccgttgatttttttaaatatgtttgaccgttcgtcttatgcaaaaaaaatttaagtaattattaattttttttcctatcatttgattcattgttaaatatacttatatgtatacatatagttttacatattttacaaaagtttttgaataagatgaaaatatcaaacgtgctaaaaagtcaacggtgtcaaatatttagaaacggagcgagtatatattttgaaccaaatcgtcaaacgtgaaaagtgctcctgctagtacccagtattaattgcaacatccttcaaaactctaggatacattgacagcatttgaagatcaaggaaaaaaagagacgcaaacatttctagcaaggcatattcacagctctctttcatcatgctaaatcagcctgtcattcaaaaataccaaaatgctaaatcagtgtcagcctgtcaccaaattatagtgttcaactcaaaaaaccgtccactgatacagtgaaattctatgcattctgccaacagaaggaaaagtagcagctgtatgtacaacagccacatctagaatgtaacagatcaaagttcaaaagctatgcttccataacagaaaggtggacatggcaaggacaagaggtacaacactctgtaattcctcaagaaggaaaacaagcagctggttgcacaagaacagcctcatctagaatctaaacagtagcaagttccgaagtatttcttccataatgcgaaggcagcatcaaaaaggacaggatgtctaacttacgatccgtcttgtgtcacttttgctgtcaacaaaagttggggtgaagccttttggcactcgattaactctttgcatttattttcaaaccattcgctctttccatcatcatcaaacataaaagtgacagcaaatgtttgaagagagcctgctttggacagtaaaaacttcataaagcacatttgattttcgcggtgcttggcaccagtcagggacacatgtttgaggcttgcaaacaagtcactgcttatctctgaatttagggagtcttcatcaatcttttctttatccaattctgtatcaagagtctacaaaacaaggccaagtttcaattaactcaattgaccaagagatgtctttaaattgaacatagcagttgaaggtgtgaatctaacattacctgaatttcaaggtgctcaatatgcggagcaaacttcagtaaagaatctattgatagaacacttgagagttggccaaaatctatgttcaggctggcttccctcagattctcaaacttgcatgtaattccctccagcatattaatgctgaactgaaagtcataagaacattgttaggcctgacatatgtccatgacgcaagtttacattgagccactaaccaaagaaatatgcaaatattaggacaccatgatcttgtagttacgaaggttcttcttggaccttcattttcagaacctaagaagccatattgtcataaatgttggcatttgcatcagagtacatgtgtttaaatcacatctgccaaaacacgacataccatctctacaagctaactagtttcacattcatcaattcagtcaaattgtaattaagttgctcgcaatgaccaatctattatctatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgtttagtactttttttttcgtttgttcctttcttttctttttccaatcctaattaaaattgaacctatctttatagaaaagaatacccccacaaatagacatcaaatgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttttacgctttattagttagaaagaaaaatcttctattatatactaaaagttcattaaacttcctacgaacgctcctaaattaccatgtggcatcctacaaaacgtttctaaaccgctacgtggcgttctaataaatcggtggatccgctatttgtttaataaattgctagactcactattttcaactattatatttatctttataaaaaaaatatcccacaacccaccccttctctcctcagtacgtatgtatgtacataatacaatgccatgctttctcccctcttccaatccttctcttcctatttctagatgaaaattttaacatgaaaaaatattataataaaacatctaacctttgcttttcacttaaatcgatcagtgaaccaactattttaaccattgtccctaaaaaaatattttaacgattatttaaaccggtgaacccattaatctatatataaaagaaacacttccctaaattttaccatagaacattgtgctttgcatgaaaaccaaatataaacaaacattaaaaccattagatttaggtatatagatggtttaaaccggtgaacctatcaaatctatatataagaaaaacgctttcctaactttgaatatatactatttttctttgcaatgcaaccaaataaaaacaaaatattaaaaatggaaatatatattatggagtaaatttcacaaacccacgtagatatatctatctattatataaaagtccattaaacatcctaaaaagctcctaaactgccacgtgagattccaagaaacagtgcaaagatgacacctaacgctctaattaattcctagaaaatctatggaaaaaggagaacatctaaccattggttttatttaatctgatggacctaatattttttttaccatcagataccattagatttatctttagtaaaaaacttaagatcaatctggcggtacgagtccgcccaacacatatacatgcttccatccatacgcatgataagagtctgtgtgattttttccttgctcgcctcccttttttcgatggtaattaagttaaggcttaagggtatataatatcttctatattagtaagttaattttatcatactttcaaagattgcatacacttgcaaatataggtatagataatatatctcatacatattgatcttggtatgttttataaataaataaagaatcttcaatagctgtaaatcttaaattatatattcaatttatgatctgtttgaaccattgtgtttttttaattaaatcaatagtttaatatctataccaaccatatttaattccattgtgtttttttaattaaatcaatagtttaatatctataccaaccatatttaattgctaataaaattattatattttggacccacatccatacgcaaaaaatcctaaaagttctcattacaaatcaaaatatccaacttagttttttaataaaatcaaaataacttataaaccgctaaccttaaccttaattatagcatcaatggacctattgactcacaaccaacttaattatatctctcgacatatatgtggatgctatttacttaattccaatgccctgataaaatatatgatcttcttttaaggataaatgtacgatcttatgctgtgttcggtgctgagggttgggaaaccttaatcctttggaagttggacattaacttatatcccaaaatacctatatcacgttgcttaaatccaactaatacaccaagaaaagaagaagaacagagggtgtctacagatcagtccttatggatattttactaataaaaattgatttcaaatacttatttgtacttattaaattatctaatcactagaacaaaggaacataccgtccatggagtgaacaaattggagggctaaccggtgcatcccggtgtgcgtgcatgggtatagaactttttttctttaatgaaaagaggggcatgaggtagttacatgtatatacatgaagggcacttttttttcttctaagtatgatgatgtgagcatgctgccggagacacgaattaacatgtctaccatccatggtgagggaagacgaataatttgcttagttggactctacacaatatgttagatcttctacatatccaatggttacaaataatggtctaaactcgagggtcatatattatgtttaataaattaattaccaatttttctatataaatcagtagagccattaattatatatggtttgtgtatgtaatgtcttttataacttaagttttttctctttcactatggaatcacaatttcctatgaggaattatccatagctatgaccaatcaatgtttgccgtcaaataataaattaattatcattttttttctaaaaaatgggtagagccattaattatatatggttgtatatgtaatgtcttttataacttaagttttctctctttccctgtggaacctcaagagtcatatgtcttaggtaccattttttataccgtaagataccaatcctaatctccaatagataattttataaataacaattaaattcgtcatgcaattctaacgaagaaaattcatgggaaaaaacataattttaaaacattgcagatattaattcgctggtataccgcctttataagtttctcaaatttatcctacgtacggtgcatgcccgcgcgtatgcgcgggctaccttcctagtttagttaaatagtgtgaagcttgcaagggcagtaaaaattacttcgaatcgaaacacaagttaggtcattccaacagccttaatctgagcatagaaataccagttgttcttccaattaagggaacttagcagtaaaagaatagtcctctgacaactatcacaaccaaattttaggagagagatcgatcactcctcagaacatgatgacgtatgtatctttatacaagttctgaaaataatcagttcagggaaatgactcatgaacttagtatagcagttgcagtgttagtgattgaaactcagaggaaatgcagaaaataagacataaattgatcagcagtaaataatgtaactaaaaaaattcataactgtggatgagcatgtacatgtgattcaagacaatgtaatggtgattggaattcaacgaggtattcaaatgatcttattctgacgtacctcagcgaccatgaaacagagcttattgacagtagaaatattttggaaagcgtcaaggaattcttgggttccgaagacgcaatcgaatgagatgtacgcatcctcgagcttggggagcgcctctgtgattcggcagccgaagtcgacacccatcggcatggtgacactgagctcccggaggttgggcgctctgatggcccacgggtccaccacgaccgcgccatccatggtacccaggtttgacaactcgagcacggcgaggttctctgacgcgaggatgaggtgttcgagctgcgtgccggcacgggcgtacgggagggtgacacccacgaggtagaggcgctcgaggttggggaagcccggaaagcccggcggcatgtcgcatttctcgaggcggaggctgacgagttcggcgcaggagaagagggcgggtccgggaaggtgcggcagatcgtcaaacgagaacttcaggctgagatcctggacgcccttccgcgccatggcgggcgggcggcgcggtagacgttgcgcgtggcgacgcgggcgcggaagccgcggatgggcgccgcgcaccgccacagggcgcgggaggaggagaccgaggcggggaactcgatgcggaggttggcgacggactcccaccggcggcgccacgcgcgggagaggcaggaggtgcggaccagcttgtcgaaggggagcagcacgaggatgcggtcgttgaggatgtccgacgggagcgccatcagcatgtccgtgcgcgtccccgtcgtcgccggcggcggcggcggaggcggcgcctcggccgctactcgctggcgcttggggggcgacgagtaggcgaagcccgaggtcgccattgttttggcgtggaggtggaggtggaggtggcggtgcgggcggtggcttgctgacgacgatatgacccaacggccttcttctagaacctattccaagatatttatttggttgttgagcacaggagaaagtttatttttgaatcctgaacaattgggttcgcatttataatccgtcaatgtttcatgttcgatagttacatgttttaacgtgatgttttaacgtgtgtctttactgtgtttacctgtcttttctttactatatatagcgtaatatttcaccggtggacaactgaaacatttaaccacccaattattttggaggagatcgggcgtggatttgtagtttctattttatttcagcctctgcttgtttgtgttttagtcattcaattagttctatttatgctttggtagaaaattatgtatccagcaaccttagaaaatacactgaatccccatcatggctgtatcgagcactaccgcaagtgcctggcctctcccctcttccccgcctaagtggcaagcaccgccaccactagcttctcacaacttcctcgctacggcgaggcgacgagtgccaccaccgccgttggctgagagccgcaaggcagagaaagccgagctcggtgttgggcggagcagccccgacgcggtgtcatcgagcttgtctcggagtagagcaatggccggacggggcaacgcagagtggcgacggtgacgacatcctctcacctctccttctcccctcccgcggccacaagaatcgaggcatgaactcggcgccaccatcaatgcctctttcctctagggtgtttaggacaagcaaacggatactaagctcgagctcgaggatgccacaagatctggcaagcgtatttatacttttggagcaaatgaagtatcgaactgaaaactatagattgtaaggatttaaatctccggctatagctgcctctatagctggagatagatgctagaaaaggcagcagctaacaaatgccacttttgccgctacataatatatgacgctaataaccggacttagcgggagatagccagtaatttagccttcagttagctgcagctaagccttggttttgggctgaaattagctacgggccaaggcccatctacttctcatgttaagctgtaaccctaaccctacatcgtctctcttcctcgatctcagtccctcactccctctccttctcctctacaggtgacggcggctgctgcgacctgtagcgtcgacggagatggttgcggctgcgctcagagacggaggcggcggctacagcttcgcccggcggtggcggctgcggctacggcctcgcccggaggcagcggctgcgaccaaaggcgacggttgcgcccggaggctgcgacagtagaatcaataccacaagcacaatcttaaggaaaaagaaagaggcgtatgcgccctaggaagaagaaaatcaggagcatgcagtctttcatgcgtgatatttcagcacagcctggaccttcatcatcagatacagaagatggcgatgatgatgctacaatgcgatcctccgattctgtctcatactgcctctaactgatcaatagaatgcactattctgaatttctgataagtctactgaacttgatgttttgtagttttgttaagtaatggactgttagtcatgttcctatgatgaactgatgatcgatgaactattaagtgtttatgtggacttgtcaagaacttcctatgatgaactgatgattgatgaactttttatgtcaaaaactcatgtgtcatgcactcatgttcatctatgaactatgaagtatatgtatttataatgtcccctgtgatgaaatgtgatgtcaataaaattcagtacaattatcatgtgatgaactatttgctatgatgacctatttatcctgtgaagtcgtgactcatgtcaaattttcgcaaaacagctaaatggcttagctgcagctatagcctgctatagcttatcttagttattgaaagcccaagcagctaaaggccttagctagttatttatattattgataaatcggctataaatgggaacaccttcaaataattttggaattttattgaaaaagattactactcctcttttcaggctataagatgttttgactttggtcaaaatcaaactactttaagtttgaccaagtttataggaaaaagtagtaacattttcaacccaagacaattttattatgaaaatatattcaattattgatttgatgaaactaatttagtattataaatattactatatttgtatataaacttagtaaaacttaaaacagtttgactttgaccaaagtcaaaacgtcttctaacctgaaacagacggagtaatgaattaaccaccacctttaattctaattaaattaactgaacaaataaaactacatacatacttataataatatagtaaagtactcaagtatacccgcgtcgttgcacgtgttagccgtgacttgtggtctggtgcaccaacacaacaatataaaagttgctcaagattccactttccttttcttagaaacacggtataaaacacatacatacccactcctaagcaaacattcaattttcagcgagatattttctcaaaattacacttttgcttgggagaagaatgtttcccaaggacatttgatttacataaactggacaaaagttttatttatattatactacctccgtaccaaaacatataaacttttgtctatattcatagctaaaaatgtttatattttaagacggaaggaatagttggttttctagccaagcaaagttaaatgatatagggagtcaagtgacccaaataatccaataaaattattttcaaatatttatcattcattgaaagataaaaaaaatcctaacggcaaaccaaattttgcaaaagggtttttctatttttcaaaaataatccgaaaatctaatattttaaaattcaattccagtaactcttattctagcacataactgagtccagtgatgctacaatctccaattcaaagtccaatagtgcacacaacagtgccaaacatgcttaaatcttactctctttgctttctaatatttgatatgttgaccttttttagatgttcgaccattcaccttatttttaaaattacataaatatcatttattttatagtgatttgtttaatcattaaatacgtgttaagcatgtcttacatttttgcactaaattttaaataagacaaatgatatgttgaaaaatcaacggcctaacattagaaacaggagggagctcaattttattgagccttttgatttctatatatcaacccatagacgtcctctgttgccggttgccacacgatttcaaaaaagctcaccatatttgtaaactccggttagcgacatgaaaagtgctcctgttagcatctagcatcagaatacattgacaacagatatatccattgataagactctaagagctaggttaacatgtgataaggtaaaaggggagaaatttctagcctgcatatccacagctcccttgattgagtatcatactaaatcagtctgtcattcaataataccgccacatgctatatcagtgtatacatctcgagtaatcgtagtgtttcacaaacaagcctgatactccatcgactagcttctctatgtacaactctctgccttctcaagaaggaaaacaagcagctggttgcccaagaacagcctcatctagaatctgaacagtagcaagttccgaagtatttctcccataatacgaaggcaacatcaacaaggacaggatgtctgtcttacatgccgtgtgttgtcacttttgctgtcaacacaacttggggtgaagccttttggcactccgttaattctctgcatgcatttccatagcgtccattgctttcataactgtagacgaaagtgacgtcaaatgtttgaagagatctcgctttggacagtaaaagcttcataaagcacatttgatttgagttgtacttcatattaatcagggtcacatatttgaggcttgcaagcaagtcgctgcttatctcagaattcagggagtcttcatcaatctcatcttgagaattcagggagtcttcatcaaactcatcttcagaattcagggagtcttcatccatctcatcttcagaactcacggggtccaatatggaatgatcagtctacaaaacaaggccgaaatttcaattaatacaattgaccaagagatgcctttaaactgtaacatatcacttgaaggtgtgaatctaatattaccctaatataaaggtgttcaatgtgcggggcaaacttcagtaaagaaactaacgatagaacacttgagcgctggccaaaatctatgatcaggccgccctccctcagattctcaaacttgcatgtaattccctccagcatattaatgttgaactgaaaatcataagaacatagttaggcctgacatatgtccatgattcaagtttacatagacctactaacctaagcaaatattcaaatattaggacaccatgatcttgtagttagaaaggttcttgaagcttccttttgagaaaagataagagccatattgttaggaaagttagcgtttgtatcagagtacatctctttgaggccgaaacatgacaggttcgcatcatctgcctttgaggccaaaggcagagtttgccattgctttaatccacacccttcatccttcgatcaaccattacatggtttaggcccattccgtgagtaaactactatatagctatttaattgactaaacatgacataccatcggtacaagctcctagtctcacattgaacaattcagtcaaattgtaattaagtttctcacaaggaccaattcagtaaaaaaaaactactatcgatcgaaacacaagtttgatcattccaacagctttaatctgaggaatcaagggaaactagaagcagtaaaagaattatcctccaacaactatcacaaccaaattttaggagagagatcaccctgagtcagatcatgatgaatatctctcttaacaagttctggaaataatcagttcaggttaatgactcttgagttacaatagcagttgcagtcttagtgattgaaactcagcaaaaatgcagaagatgacacatatatagcagacataaatggatcagcagtactcccaatcaaatctgcaaattatttgtccaaatgagctaactaaaattcataaatgtggatgaacatgctacatgggattcacaagcagacaatgaggcaagcaagataggcatgtaatgaaaattgggatccaacgaggtattcaaatggtttgacgtcgtaccttatcactcttgaaaaagagcttattgacagtagaaatattctggaaagcatcgaggaagtcttgggttccgaagaggcgatcgaatgagatggtcacctcctccagcatggggagcggcattggtattcggcagccgttgtcgtcacccatctccatggtgatgtagagcttccggagtttgggcgctctgatggcccacgtgtccacgccgccgccgttgatggtgatcacgggtgacaaatttagcacggcgagtttctccgccgcgacgatgaggtgttcgagctgcgtgccggcaccggcgaacgggagggtgacatacacgaggtcgaggcgctcaaggttggggaagcccagaaagcccggcggcgccgccggcatgtcgcattgctcgaggtcgagttggacgagtgcggcgcaggagaagagggcgggtccgggaagggggcgctgcttaccggctaacgagaactccagacttagatcctggacgcccttccgcgccaaggcgcggagccagcgggcggcgcggaagacgtcgcggcgggcgacgcgggcgctgaagaagcggacgggccgcgcgcaccgccacagggcgcggccgccgccggagtaggcacggggcagctcgatctcgaggtttctgaccgactcccagcggcggcgccacgcgcgggagagacaggaggtgcggaccagcttgtcgaaggggagcagcgcgaggatgcggtcgtcgaggatgtccggcgggagcgccatcagcatgtccgtgcgccgcggcggcggcggcgccactcgctggcgcttgggggaggacggggaggagggggaggaggaggaacccgaggtcgccattgttttggaggtggaggtggaggtggaggtggcttgctgacgacgctatgatccaacggccttcttctggaaccttctgcaagatatttatagggttgtttggaaagcgaaggagccataccacgccgcctcggcctcgtggggtgcgggtgagcggcggctgcgacgccgtcagtatttctccaccgcgaccggcgtcagctaacgagttggggggtgaaagctgtgcctgtgctgtgttttgttatgtttcttggttcctaatttctgaggatggatagacatagcgactttggaagggaaagacacttttattttttatttcagctgtttttcaacacccaaattttatatggtttttttaatcgaaattgcgatatggcattcgacagaaatttgggatgaaatcttacaaatttattatcacatcggatatacggacacacataaataacaaaataaattacagaattcgctgggaaactgtgagacgaatttattaagtttaattaatccgtcattagcaaatgtttactgtagcaccacattgttaaatcatggcacaattaggcttaaaatattcgtctcgcaatttacacgcaatctatgtaatttttttttcctatatttaatactctatacatatatccaaacatttgatatgataacgtgaaaatttttgtgttgggaactaaacagggcctaagtgttggccgtgtgcttgtcagcagaagccacgaaaaaaagctctgcagcttgcagctagctgtgtttaactgttggtttcagtatcagtattctgagttgactgctaatgcaaatgtttaacattactcctgctgccggtttctagctcatctggaaactaagaaatgggatagtatgcaggagttttgccattttggattatactgtttcagaatcaagccacatcaagtataaattatcgaggcttgactgctgatgcaaatgattttacagggttcgtgcagaggtttgggcttctctgaaaaccggggaatgacaaatatgcaggcgttttggaggtcgatggttcagaatcaaagactgaacaatatggatgcttatgttggtctgctgatgcaaaatttgaagagcctgcttggcactgacagactgaagatacaacaaagcttccagtcttccaggaatcaaggttgtatcaattgaactaaggcagaaaggttgataaattttatgcaatgtgaaatcctgctgctgtgattaacatcatgatacaaggtaaatccactatgtctgatgcaatttacatccaagaccaacagaaactctgttactcctgttcatatcagagcaatatcgaacaaagaacagagcaaagttcataccaagattcacaacgttctcagatttctattgcatttgatatagacatatagttacagcc

SEQ ID NO: 81970 - DNA, 57191 bp, Oryza sativa
gcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaggattttcattttcctctatactccttaatcaacatgctgtaaaactttctgtaggtccgaactgcttttatttaacgagtcgtttcccttgtttccttagcatgtgatcccgagtacctttgtcattgtagatatgttgatgtcgaggatgtccagcagcgcgggcagcccgatacgccggtagtcgttccggcgctcacgcttgagccgcatgtgccggaggtggaaatcggtcaaagcccatccacggagacaaatatggcgatgacgtccttaggtttgtgtcttgattttcttcgctcctcgtgtttggattgacttaattagccgtgttctcgaaagagaagagtagcttgacttagtcctttccgtgttgggcagatttcaagaacgcgttggctaactgagatcgttgaatccagtattggaagacaaaactcgaggtggccgaactcgaaaggaccatcgtgggggcgaaggaccaggccgtggaaactctccgaggtcgcgaggtgtggtttaactcgtaccttaagagttgttgcacggccatggtagaagtttgcagggagctccgagttccccgcggagatcccgaggagtccgctgctggttatatctcgtggatgaagggggcctgcgcacagctcgaagggattggcaagcgcatcgacgaggccctgaagcaggagtgtcgtcgagcgagccgctacgccgggggacatgtgctggcttgcatccgagatcaccgcccgcctctgcacctcgagttccttcgcgaagggttctcttgttctcggaggacatccgcggagatcgacggtcttgcgcagtcgatggcgttgcttgccgagaaggttttctgctccatggattggcgttggccgtcctggtagcttttgtatcctgtagaaaaacatctcaagggagcatgtaatatactttgaagtattcatgacttgtaagaaatccttgtaaaataaaaatgaaatctatctaactaagttttcttacttttggtatattgtgtatgagtgttttctcattctacgacttcgatcagtcacttgagccatacactctccctagcccccagccttgtcgtcggagaattgttctcgggggataagactcttggacccttgacctgccttggttgaaaaagtgcagagcctagcccctagccgtgaagttagaaaactcaatttccgattacacggcttagttaatacgcacggtgagaactcttacatgaccagatcttacgtggtgatttgtctctgcataatctgacaaggccttatccgctctgggcgtccccagccgaagttcccttaggttcctcagaggccttgccaggacggcgtaaagggacatgaggatagatttcaactctaggtgtcgtagtggtaagggatcgttgggaaggaacactttgacgatattctttacctgaaatcaactttattgaaatcgtaagatatcttacaaatatggatactattgatttatacataaaatttacataattgatcaatgtttcaggagtttgctaactcgcgaccatcgccgtctgcactcttgaatgcgcccggccgcaagacttgcgtaatcgtgtatggtccttcccacttgggtgagagcttgttgcacccagcttggctttgaacccgtcggaggacgtaatcgctgatcgaaagtgtgcgtgctctgatgtgcttctcatgatatcgacgaagggcctactagtagccggctcctctgacggcaactctttctcgatgttcctcgagtagattcacatcgtcgcttcgctgctcctcctgctcctcgtcggagtacttctgtactcgtgtgctctgatgtcgtagctccgtggggagcatagcctctgagccatacacgaggtagaagggtgtctccttattggatgttgtcggtgtggtacgcacggcccatagaacagagggatgttcttcgacccacttcttgtcgtgtgacatgagtctgtcgtagacgcgggtcttgatcccttgtagcactatgccgtttgcccttttgacttgcccattgctctaggggtgagaaatcgaggcaaagcaaatcttgactcccaatccaatgcagtaatcctggaagtcggcactgatgaactgggagccgttatttgttatgatgcggtgaggcaatccgtatctgtagaatatccctttcataaacttgatggcattatcggccttgatttcccccgtgggcgtcgcttcaatccacttggtgaacttgtcgatggccacgaacaggaacttgtagccgccctgtcctcgtgggaatggtccgagtatatcgagcccccaacacgagaacggccaagtaagagggatagtctggagcacttgcgatggcagtcttgtgtgtttgctatgaaattgataggcttcacaccgctgcaccatgtcgcaggcgtttttgagcgcggtcggccaaaaaaaacccttgtcaaaaagcttttcctaccaacgtccgtccgccggcgtgtgacccgcagatcccttcatgtatgtccaggaggagatgtttgccgtcgtcagacgagatgcatttgagaagtactccgtttggcgcctttttgtacagatcattgccgatcatacaaatagatcttggcttgtcgggttatcttctcagcttctgcatcgtcctcgggcaactcgtcgctactctggaactcggtgagtggggtccgccagtcgtctgtggtctcgatatcggcaacgacgtgttccgcttctgtagcccccgagctgatgtcggggacaaccgtgctaccgtcgtcgcttgcctctttcaccgatggctttgtcaggatgtccagaaaagtgccaggttcgagtggctctcgtcgggacgcgcgccgtgctaggtagggatgaaactggttcggatagtttccgtccgtccggaccaattttcggatacggcaaaattcggtcggaactatccagaatttctcagattcggaaacgaatacgcataatttttctcggatacgaaaacgaataccgtaagggtgatattcaacggaaacggaaaacgatcggaaactatccggtaatttttcccggatatccagagaccttcatcagccattcatcagaatcagcccaaagagcccaacccagcctaactatgtgtgttatgcaaaccctagctcgctagcaacacagccaacaggcaacaggcagccgagccagccgactactcctattcccccgagtccccgacccccacgcatctcggccggcggccgccgccaccgcccacaggcgcctcgccccttcgccgctgctgccaccgcctcaccccttcgccaccgctgcctcacccattcgccgccgccaccgcctcacccctttgccaccgccgccgcctcaccccttcgccacagtcgctgcctcttcgtcggcgtcattgcatcggccctcttcgttggcgtcgtcgcgtcggccctcttcgtcggtgtcgtcgcgtcggccctcttcgccggtgtcgtcgcgtcggccctcttcgccggtgtcgtcgcgtcggccctcttcgccggtgtcgtcgcgtcggccctcttccgcctcttcgctggcgtcgtcacatcgccgtatcaccgccactaccggtctccgcatcatcgtctcgcataggcccgtaagcaggttcgtcggatccacattcattttttgtgctcctcattcactgagccagggagccctatatcagagtttagaccatcgagttgtgctgttgtggtgctccttattcatttgtttttttctttttgcatgtgtggtagatctgtgaatctgtgatgaattcctctcatgcaagtagcagcagcttcagcttgtgcagtgcgtgtgtgacagtcatcttgtgcaagtaatgtgtgtgacagtgtgactttgtcagtacgtgcaagtttgtggatgtttctcgttatggtattattaattattgatctttgcaaatgtaacatgctctattagaaaaaataacaagttatatttcttcgttgatttgtgaaggtcagtttgaggggcttttatgttcggattaatattcgttaccgtattcgtttcgattcgtattcgctccgtatctgtattcgataatattcgattctgttttcgtatccgggtttccgattccgatttcgattccgagaaaaaaaaatatgaaaacgaatatgataaaggtagtttccgaccgtatccggtccgttttcatccctagtaggtcgtctagttcgatgttgttcttacggtatacgtgtcggaccttgatcccatcaaacctcttctctagcttcctgacttctgcgaggtacttagataactcggggctagagcacttgtagtctttgtgcacctggttcgcgactagttctgaatcccctttcacgattagtcgcttgactccaagtgtggctgttgcttttatcccagcaagtagtccttcgtactcggctgtgttgttggtcgccctgaagttgaggtgaattgcatgcttgaactgatctctcgatggtgatgtcaagatgaaccctgccccttctccttggctgttgagtgcgccgttgaacgccattgtccatgtctcgctgtccgtttgactgtctgacctgttctcaggcatagtccagtcgattacaacatcagtgaggacctgggacttaatagctgttcgtggcacaaagtggacatcaaactggcttagctcgactacccatttcgcaatgcggccgacaacgtctttgtttctcacgacttctccaagggggaaggaggaaacaactatgactatgtgggcttgaaagtagtggcgtagctttcttgatgtcataattactgcataaagcagcttttgatctgtgggtatcttgtcttcgcatcgtggagagcttcgctgacgtagtaaaccttctctctcttgacaacaatgacattactcacagaatatggcgtggcagcgatatagaggaataattcttcattaggttggggagcaacaagtacagagggatttgacaggtagcgcttgagcgcgatgaacgcatcttcggcttcctgtgtccacacaaatttgtcttgtttcttcagcaggacaaagaaaggttgtcctcgctctcccatcctagcgacgaacctgctcagtgccgccatgcatccagttagcttctggatttccttgagtcttgtggacgacttcatgttctcgatcgccttgatcttctcgggatttgcttcgatccctctttcggagacgaggaatccgaggagcttgcccgatggtactccgaatgtgcacttctctgggttgagcatgaggcgatatcgtcggaggttgtcgaacgtttcccggaggtcatcgatcaatgagtcgcttgtctttgtcttgacaacaatgtcgtcgacgtaggcctcgacattgtgtccgagctggtcattaagtgccccttgaaccgtgcgctggaaagtgtttcctgcggttattagtccaaacggcatcttgacatagcagaatacacagaacggcgtgatgaatgctgtcttctcctcgtcctcttttgccatgctgatctggtggtagccggagtaagcgtcaagaaagcttaacaactcacagctggccgttaagtccaccaattggtctattcgaggaagagggaagtgatccttgggacacgccttgttgagatcggtgaagtcgacacacatcctccacttcttgttggctttgcgcaccatgactgggttggctaaccactctgggtggagaacttatctgatgaagccagctttgagaagcttgtcgagttcttctcatatggcttgtttccgatccggtgcaaatcaccgcagtttttgttttactggtttggcatcgggtcgcaccatgagtttgtgctcgatcacctccctagggactcccggcatgtcggacggctgctaagcaaacacgtctgcattgtcgcagaggaaggtgatgagcgcgagttcctatttctcatccagtgacgccccgatcttgacggtcttgtcggggttggcactggagagcgggacgatcttgattgcaccgtctggcttcggcgtcttgttggttttgctcactttcttgggcggctcagctatggcaggtgggttgggagtgtgctcgaccatgtcgaggctccgcttgtcgcactgcaccgccagtttcgcgtttccctgaatagtgattgttcccttcggtctaggcatcttgagcacttgatacgcgtagtgagatacggccatgaacttcacaagtgcagtcctcccgatgatggcattatatgctgtgtcaaacttagcgaaatcaaaggtgtgaaagtgcattaattcccctagtggtttttggtgattaatgacaaatgtggttaagggtctaatgagtttattgagctactttcaggtgcattagtccaaggcgtggaagaagatgtcgtcacctagccgttatacatatacaactcgtttccagctcgttgttagcctctcccaagtgtttcttgccttctccactcaatctagagcctaattcttgtgagaaagagagattgagagggagagaagaagatttggagaggtgtgaagactaggaacttgggtgagcacttggaatatctcgtgggctgtcatctcggtgcttattactcttggagatgatctcctagacggttaggtgtcgcccgtgacaattcgttgcatattgtggatgtcccgggtaagtttgtgaaggatctcctctcctccgaaagggaacgaggtaagttaatgaagttcttatgctgagattctagaggttttccaagtagagcaacctacacttgtggtggatttctagaagtaggttgagttggatcttggtggtcactcaattctagaaatttgtctaggagtgtttggggttgaaggctgtggatttcctctggggtttttgcacatgtgaggcaaggggttaatcgagacccagctttttggagctcctcaacggagagtaggatcgcaagatccgaacttcgagaaaaaatcgctcttatctctttctgtgatatttctgtggatgattctgtgatctatcctctgcttaaaatacctgtgcaccttcttgtgaagattggcttagtctcctgttttgaaatttgaatttcatctctgttctgttaccaggaagttcctgtcctagaacaccggaagttccgggcctggctggccggaagttccggagttccttactaggaagttccgggtctatttgaattttaccgccgcgatttgtttttaagttttcagggacagcctattcaccgcccccctctaggcttcatcagcgcgttcaaggtgatctgttcggaagttgtttacttggccgaaagtcatgggtagcgtgatcttgcccaatggcttggacgacgactcaggagtgattccatgaaagggttgatcagtgggtgtcaactcgcttcgtgggatccccatcgcgtccaaggtgctagcgaagagtaagttgatggagctgccgccatcgatgagaacccgtgcgaccttgatatcctgaatagtgggctcaaccacgatcggatatcgccctggagtaacggcagtcttggggtggtctgcttctgagaactcgatcttctgctctgaccacttcatcttggacgcagccccctgccatgtcgaacaaacttcgcgctccactttcttgtactctcgctttgaggagtacgccgtggaacctccgaagatgtgcgaaacatggagaccggagtctgggtacgctgagtctgagtcctgagtagtcgcttcggcggccttctcgactacacgtactcgcttgcatttctccaacgccagttgcttcgtgagtgcctttttaagatgaaataagtctccagagagtgcttgtccgtcttgtatatagggcaccatattttcttcgtgtcgtcgccttgtgggtttgggtgcttgggcgggtcaacgtgttctgctatgagaacctccgtttgcgctttctgtttcccactcctgcgaatctttttcttgcttgactcaggcgtgtccttggctggtttcttctcctctcctgtcttcgacttgtcgttcttgcgtctcagagcgtcgtccgcgtgagcgcatcaattgacaatctcgaataacttgcaagcagttgtgatatgccttgttgccaattcctgggttgtgtagcgatctcggacgctagacttgaaaacgcggattacagaagcatcggtgatctcggggatcgtatttctgcactcattaaatggttgaatatagtccctcaatgattcgcccggattttgcgttagcgcgtgtaggtcgtccttgatcgcgtggcgcttgtatgttccttggaagttagcgacgaactgttgccacagatctgcccacgaagaaattgagtagggcgggaggtgaaccagccatgaacgtgcagatcccttcaacgcaaccggcaaataattcgtcaatgcgttgtcgtctgctccggcagcatagagtactgtagaatagacctgaagaaattcttcagggtcggtgcttccatcgtatttctctattgctcccggtcgaaacttctcaggccatcgaacatctcacaaagtacgagtgaaagccttgcacccaccgccaggggcagtaggttgtcggcgatcatatgctcatcgtggatgtctgtccgatgatgaagatgacgaagatgacaatgatgatgatgagtcacttggttccggggcgcgatttcgagtatgatgctcgggttcttgcaagcctcatcgtcgcccatagttgttgtcccggcgtcgatctccgtcgtcgtcattgtcacggcgtcgacctcaactggtatcgcgcggcacccgctgctcgcgtttagtatgttcgcggcggttgtggcgatcatcacggtctcggttctcgctcggacgtcctccttgttcttcgttctcgcgatgtcgtgaagagacacgatgttgggaacggttttcgttatcttgagtgagtcgcgcttctcggcggccatttagatggtcacggagatcactggtgccgcgaggtggaggggtagcttgacgaggtggcgtccactgatcaggctgttccccattagcgccgccggtcggcggttgttctggtggtgccctggcggcggcctctgcgaacgcgttattgaagttagccactgattcccgtagtcattctgcccattgatcaagatcagtgttcaggacgggatcgaaagggctttcgttcaatatcgcattgagggttctgatatgttgggccggtgtcggtgtaaccgattgatccgccgttcccgtgtggccgcctccagatgtgttggttccatcgatagcatacacgtcgcgtggtgtacttgtcgatgatgaggcctggacttcgagcagatgtaggacagatggctcatagggatcgatatcgattaccctgacgaatcgatctgatgtagtcgccgcaccttgttccttgtcctcatctctaggagagattcgtgaccgctggaccttagggggtgacgtcttaatggcgctgagaaggaccttgcagctggagaggtcgtgagtctttgccttgtggatgggacaatagacatcatgagttggagaagtacgttgaattccacgctctttgcaggcacggacttcagcttgtacgttgaggaaaaccgaacaagcttgcaaggtgtgcttgctagtcctgtggatgggacaccaagcttttgtcgccccggaagttgtccttgtcggctcgtacttcttgtgggaaggataagatttgaccacattaggatctttctcaggcttggatgttgtcgattctccgttctccacttctgcgggaggatcttttgacatggagtcaaccggggtcgtaaccacgccgttctcgctcccgataattgctgggccagtcgagattggcattgtggtgtagagcgggaagacgatttcgccgacttgagtccacaccagcatcgtcgaagttgaagctccttggttgatgccagtgttgacgctatcgtcgagaaggcttgaaatcataatagtagaaccttgagcaccaagttcccctacctgatgcgccactgtcgacaagggatacccgtagaccggatataaagggtattggggtccgttggtacgaggatcgacgtagtacgacatcaagcaaataaaagataaggattatactggttcaggctccttggtaggtaatagccctaatccatttgatatgagattatatgatggaaaccacaaattacaaagggaatagcagaactcgatgataccgacgagaccgtagtcaagttggtccgactagatctcccgacgacttggctcctgcacgctccggctccgtaggctatggtgggtgtattggcggtgatattcgatgtcttaggtcctacccagggggtcccttatataccgcgggtcagttgatctccaagtaggactcagagatatcgtacccctcacgatacagtaaagacccagtcttgtctgagtagaactccttccatccgtagataccatccctatcacgtgatagattttcttaatgtatacggaatctatccgtatacgcgcgggtataccgtatcagtgtacaacgcacatccaatgatagagggtataccttatccgtaaccctgatagtagctcccgacttctgcttaaatgagttcatgttaccgatcgcggcttctgatgtcggaattgttgtcactctcatctagtcgatctcgctttcaaaaatggattaatctgatttttttaagtaactttcgtatagaaattttttacaaaaaaatacaccgtttagcagtttgaaaagcgtgcgcgcggaagacgaggaggaggagttgggaacctgcccaaacgaacagagcattagagagttattctaatatgcaactctgcatggtagacaagttcatatataggagttgctgtgcataattaaatttgcataacgaaacaaacacagctggcaatggtggcatcatcactgacagtaagcaaatgcatgctgcagtttagcaccaagttagtgataaatcgagcttaattagcactagtgtgcgcatcttggtgcaccgaaaggttaggtcactgcagtcgcttgcttccccaaggagtgactgagtgagccagtgacccagtgacccacacgatatatgttggagtcggaccaaaacattcctccagatgtcggtgcttttatagagactcttctcccttttttttatcgcaccacaatttaattaacaccaataaatataattaatatgagtcttttatgacttatgaggtataaaaaaaaaactctgttgagtttttattagcttgataattctcatatctccctctccctatctctctccgaggggtaaaatttacaccgaacttagataatatctctctaaaatggaattaccagcatagtattaaaattaaaaaaacaattattatctaaacatttctaatcatctaaaatgtggtcaacttatcagataattactccctcaacctagcttgaaacagattattggccaaattataagtggattattaactacactattttagaaatagactaaatattttgataaataaatgtaactgatagcttctaagacatctaaataaaacagtggaaggaagttttataaggaaacatggaaaaaataatctgtgacaataatttggtgaagcaggtgaaaataataatgcaatataatgttgacataaacccaatgtttgactactcatcttattaaaaaatcagtgtaaatatgcaaaatatatgagtgataattttagtaataaaagaagtcacaaaaaaataatgtaaataatatttttaacattacaaatagtcaaatggcatgctaaaaatcaacagtaattacaatttttaaaaagaggtagtagcattatgagaaaatcccgtctccaaacaggcaaacatgggttggccacctctttgtcgaccagctagaatttcctttccgtaaaagccataaatcattataaactccgtggcttgcatctttgtgatatgatgcatctcttcttctttatccttttaaaaaaaagggcttagaaaagtttattaagcattattgtctggtatataggggcattcaaattatgtcttggtcagctgtattgtgttgaccacttcaccagaatgtgataaaataaacaatggacttgccaaaaaaaagtttgactggtccaaaataagtacggaatatttgatatataagggcattcaactgcgtacagaccaaacttccccaataaacaactcaaaaagatgcttatagtattagcaattgtctgctctctatgcattttgcagttatacttggtatttgcaattttgtattttgtcccccacttccccagaaattgtaagaagttttaatagcctttgatacgcacatgcgtgatggtactacactcgaatcggtggtcaagggtctcttattccactataaatagtgtagttttattagaattgctagtttaaaaaactatgtggttcaatgctagtcaataataaagggggttggggatatgtctcatcaccttatttctcattttaatttatttttatttttattttttaaaaataaacttatggttgtatgtcttatgacagaaccaacaaggaaaatagacaaaacaagccagcaagaaggctaatcataccaacaagtagcattttagtacttacatatacacaaccctaattcgtgatgtttctcagaattgtctttgacatgttaatggtatagataaaataccctttctatctataaatataagtatttcaagcatttaaaatttaatcataaatacaagaattcttagagaactacttatcctatcaatcagtattatttaatttttttatcttacctcaatcaccttctcatctctaatcatcactcatttaaagtgaggtacaaagttttatcaaccttaatctttattaaataacccaaaaataattatattcatgtagagacagtacgtcacaaaagtgtcatctaattaaacacggttacacgaccacgtatgcccatttgcctacaagaaaccaagccatcaactagcagccttgaagttcatacccaataatttctcaaacattacttttgtctgtttcttaagcattgtttaccaaacaaaataaaggcaaagagaattggcagaaagaaacatgagagaacacaacaacaatcctagaaagggcctatccgtaataaatggttgtttagattcaggctaatttttatccatccgaaatattgctgacctcgaatatttggttcgatacgaattttcgctcaaagtagttcaaattgaataatactaattttggttatacaaaagcttactaatctctactattataaaaattgaagatatttttgccggtactttagtatgtcatccgtgtatgagttggttttaacttcgtttacattttgaaaatacatatccgtatttgagtttgtttttaagtttattcgcttttgtaaatacacaaggagtcgtataagatctctttaaaaaaacttgcatgctaacttgaggctatcgaactcctagttgcagctcatgattttctaaaaaaaatatgggtctaagagaattctcacagtgaaatttcaactcaactaaatcataaaatatagtaagattaaaataactttccccgttgcaatgtatttgttttttttctaatatttaaaaaatataactggctcgaaaccaaataagctctcgctaaataggaagaaaccaattgcaataaataaattagtccaatgcaataccaccttcgtctccatttttaacccaccctctctctctctcctctcatttttctctcccacaaaggcacaaaccgcgtctccctctccctctctccgcccatccatcctcctagagagggagcgcgcgcaaggaggaggaacaagggctcctcggatcgggaccagctgaggtgagcgctcgatcatctcccgttttctctcctcggatctgaccatctttcttgcctttgttttctttcttttttcttttcttcttcttcttttcccctacctgttcttggtcgatcggggatttcgctgccgtgaggctgacccttcttgtggtgcggtggtggcagtgggtaggatggctgcttgatccccttgattttagtattttattttatttttcagattagatgcgtagtgtagctcgtacctcgcattgcccgcccaatgcgtgttcttcgttttctttaatttggataatatatggcactgaatttatcaagtttaaaaaaatgtcatcgtattttgcttaactttgtcaccatcaagtacacctagaacgaaaatttccaaaattagacggaacattccgaaatatcgtattatagaagttgccctcgcgtatcttccccctttcccttggcgtaaaagaaaatctccggtgtcgtctcctccgctccttgttcccaagacgagtcgcggctgaacaggggaggggaggggatcctggtgagcatccacatcctctttctgattcatctctgtcccaccgggagtacttttgtctagaatttgcttgcgttccttctcttctagatctggaagaagctcttctcttgttaattttacagagagccttaaccttaataccagtaacagtttgtttgttcccccaaaaagtttggggattcaacgagttgtgagtttctggaattggagggacagaggattggcatgttgattcttggtccgagcatgtttaccaattggcaggaaccggcatgcggttcagcactgaactgtagcaggagatgagtttcttgcctggatctggagccatcatcagtgaagaaaaggaagatttcttcaagaattcaatcacaagtgaggtttatgcggttccactgttgacagggatagggataatgccgcatgatgggtcgttttcagtacagagtgcacactgatgaacgctgtgggttccattgttccacctatggaaattccacggtcgaggcagagagaaaatggctcatgtgtggtgactggtggttctgttccactatgttttttgttctgactttttcccctcatctgaagctcgtgttaaggtcatatatggtttggtagtcctaattgtcatgtattaatggccagatggattggtagagtagtatgtttgaatttcctatgttctaatagctgaatttgttaacttggacttagatgtagctacaaattatggcctagaacagctatatcattatttcccgacctgacagaggaatctagagcttggctgcagatttagttgaatagtgtgatagtatctctgtgttttttgttcattgcagtgatgtatttagtgtttcagtatgagctatcattgattacaaatttacaatataacatatttgaagcgtttggacaatgtgatgacgaggatatatttgacaaatttacaatatgctgatgtacttgtgtttcagtatgtgctggtaacagaaaaggcataatcctatcacttgttcactgccatgggagctgatatacaatgattttttcctattgatggaaaataatatgatgctccagatttatgttagaataagatgcttctctatttattaaaaaaatggaaatataactaggcaaagccatgtaatgaagaagatatggatgtttgtcaatattcatgcacattgtgtttgcataatgaaccaaaccatttttagaataatctcatttaacatatgttattgattggcaggtgcatgcttgaaaaatgtgaatgtgtgtaacattagtgtttttgtatgttttaggttggataggtattttaatgaaccattgtaatagtatgacaggtccatgccctttaatgtcatgtaatattcgtacagtagaggataattgtttgtttccagtattcagaagtgttgattcaactatttgtccattattaaaggtctactgtaatttagaagtggacttatttttgctttcttggtaaaaacttgaatgataatttccttgagtaagatcaagacgtatggagcttgcaactgatgatatctagactaagacggtataatttagtaaacctgtaactgtattattgcgatgtttcagtttagctttaggtaatcaacacatgtgcatatcatatttctttaagatgtatctcgccaagcataatttttcagtggcaacttgcaattgagttcttgttgagttgacctattaatttattatcgcgccatataggcatatgtgtgttgaattgaatgcttgaagccttgaagcatgttattttcataatgcaatctttctagctagtatgtactatgtagtactagtttgagaatatatgtgtttcctcatcttttttattttatttttctattggacaggatttgaacaagtcagcttgtcgccaccatggttcttgattcattatcatctcctcacaggaggtcacagaacacattttttctatcatccccaaagaagcttcaatcatcgaaggatgatgttggcagttggtctgcactggttgagcggcatcgcttcctcttgacaacactagtggttctggtctttctgtgcaccatctatctgtactttgcagttaccttgggggcacctgatgcttgctctggattagcgggcactgaaaaggctgtatgtcgggcaaaatctgctcttcgacatggaaaattgaaatttttctagcgctgtcgtgcatactctcgaagaccaagttactgaggcttacaatgcgctcttcaggtcacccacagcttattcttcatacattgaatctgtatattttgtggtggatgtattgctttgtattcatgttgtactttgttgagagacctgctattcaatagttgcaacaaatctgctagtgatagagagaatttatatgttgtgtaaacggtacaaggtaggtcatcatattattttttgtcatggtgtactaaaaacaccatgccattactaatccatccaggagaccctgatactgtctccatcctggcatactgtaattcatttgaaactgcatgatactatcaagtgttagtagtgattaccaagaaatttcacaatcttagcttgttctttggttcatttttgggtttctatctcttttcttgagatgctgcggatgttcgcctcgtcatcgtcaggctgtatatctactgtaaaatttggggcatttgcaaatttgcctccggtttttccaattttgcaaggatgccactcgaatgacagttctagtggtattttgcaattttctagtggtggttttgtaataacgattcaaagtagtggtgcttgtgttcagtcttctgccgtacagcagcaaaagtggttctatcaaaaggtactattcccctgttccataatactcagttccacaatgtaaaactttttagcattactcatatttatatacattgtgaaacggaggaagtataagcaatccaagcatttaaaatttatcttaaaatataaaaaaatttgtgcctcatacccgtaataagggacgtcttattttactctccttggtaatctctgaaaacccatgggacagggtttaatgagggatgccagtccttttacttactctctcgtcctaaaatatactacctcctacttactctctcgtcctaaaatatactccctctgtcttataatataagagattttgggtggatgtgatatatggtataatagatctggacagacggtctatctagatccgttgtactagaatgtgtcatatcaacccaaaatcccttatattataagacgggggaagtagtaatctagtaattgtttcatttcaagatatatacaattgaaagatagcagaagtggctcaaatctattgacagatagtagtgcagacagtggagggccaactgaaacaagatgcttctgtcgtcttgccatgtcagacactaagcaagatgcataatcttgtgaccactgcaaccaccgatgatagatgctgtttggatttgctgtcaccagggacttaattatggggttaggctttgtttggatgctaagaagatccatgacactccactggagctccagatccatcacacatcccctgcttaaccactgacattgatagtgatagctcactggtttagggtttaggttttgattattcaataatggatatggtctattcagtttcaccccttcggtttgcaatttattttacctttctcagctttcttaaagtccccaattggcccaattcggcattcgggtgttttgattaaatttatgttttgcaagctttcttccggttttgttcgtgtaactttagccatgtttacgtgaaactttagctgtaaattcataaatgagccaaattagtgaccagaaatctcacgaatctccgctttttctatggttttgtagcacctccaactcttttaaaacagggcctttaatattgcttggattcgtaacgaaatttggatgggcttcaaacacaacaaattacagcccagcccaacaacacatagcacagaagaaggaaaaagtacaccgaaggtccctcaacttgtcaccgagataaaaaaacgtcctcaaactgcaaaaccagatatcgagggtcccttaatttactaaaaccagtcacaagtggtcccaaggcagtatttcacatggttttatcctacgtggcgctggttttgtccaccgtggcgctttgaccttggtcttcgttgctgagtcaccatcgccacgcgaagctggtgggacggagtggggcagcgatgagcggacacgcgggcggagtggcggcacccgaagccggcggggcggcggagccaagcggaggacgccagcctcatcgtcgtcatcttccggcgtagggcggaggacgccagcctcatcgtcgtcatcttccggcgtagggaggaggcgcgggagctggagccggaggcggaggaggggctccgctagaagccgctgctgtagaaccgggagcgcatcatctcgagctccagctccgacgccgcctcggccgcgtcagtttagccgcgcccccactccgccgccgacgccgccttgtcgtccatcatatcgaacgttgacgcggccgcggtcatcgccttggcactccccgacagcgactcgtccggggcggccctcctgcagccccaccgccccctgcggcggcctcggctcttgcgccgccgcttcatgacccgccgcatgacgccggcggggaacctgacggtgacgagcagcaggatcgccgctcccttcctcctcctcctcctcctcctctctctctcagggcggccagcagcggtccacttcgtcctcgacctcgccggcggcggcgagctgttctccttgccagcggtggcaggggcatgggcgagagaggatgagctcgaggaggatggagaaggcagtggagcggcaccgcacgggccgctgcttcccccgccgccagcgcccgcccgcacgccgctcctcccccgccgcttgcgcccgccggccgtcccccgtgcaattgcttcccccgcctgcgcgcgcccgcaaccacctccgcctccggtactgaagccgccattgtcgtcgtctacttgtcttcatccacccccaaaccgttgttgcgcctagatgtgcgccgccgtgtagccacccctttcccctcgggcgccgatcgccgcgccgcgccgatgcgctcggccattgcccaagcggagccgacgccgccgctggcgccccctccaatcggcgccctgaccttctcctcccggcgccactcccttccctccctccctcctctgcccggcgccgccccgattcctcccctctgcgccgcctcccggccgccctaccaagccgccgcaccgcgcagcctctctcctcctacgcgtggctcctgcgcgcaaccgcgccgccaccaggctctctctccctgccgccaagctctcccccttccacgctgtcggccccctcttccccaccgccgccggccatcacctgcgtcgccggcgcccatcctttgctgcgcgcgcgtgacagcgtgcgtgaggaggaaaaaaaggcagagagagaaagagaacggcaaagagaagaaaccgtgagaaagagacaaaattaaaagagaaaggaaagaaaaaggaagtgggacccccctgactcctcctccctgtgaagccatgaagggagagagatgtgacgtggcaacttgacacgtggggcccacgctgactcagctgtcacgtaggctaaaaccgggctcaaaaccatcgaaggacctattatcaccggttttggtaagttaagggaccttcgatatctggttttgcggttcgaggacgttttttaatctcggtgataagttgagggaccttcagtgtactttttccacagaagaaagtggaacgaaagcccaaccaaattattatccaggcccagccaacggcgaccacaaaccgagcagataagcccatccacagatcgggtggctcccgtttgccgcctaacggcaacctccccacccaaaaccaaacgccgtcacctctcaaccccgccccaactcaaagcctcttccaaatggccctcacagccgccgtctccgtccccttcgccgtcacccctctccgccgcctctcctcctcgacgacgacgagggctttcagcttcagggtgtccgcggcggcgatggcggcggccgcgaagacggcggtgcagccggccgtggtggtgggcggggggcgggtggggcaggcgctgctctccatgggcccgccgggagcggacgtgctcgtcggccgcggcgagaaggtgccggaggacgcgcccggcccgatccttgtctgcacccgcaacgacgacctcgacgccgtgctcgacgccaccccgaggtcgcggtggcgcggtacgttcgtccctctcccggctctcctctcctctcctctccgtctcccgcctggcagccgcgccgtctcctgctctgcattgcttctgcttgttagctgctctgcgattcaggtcgttcgtcagtaactcagtatgcgtttgattggtgcctgtggtgcatcgcttcgttttcacccgaaaatgcggacggcttggacgaatttaaccaagttgtgccgtgaattggagtattgttgttgaacccaatttctcaaacttgcttagcagttgagttcagttcagttcttctttttgtttagtatagagtttgctattaactgatgcccgatagtccaatggaaaaaaagtccggatctatttctcgaatgggtggtcttgggaaagctggtcatagttgatgtattatgaacgcgattgtaaagcaaattcgtttggtgactttcagattggatcagctaactgacaagaatgctcagtaggtttcaaaaaaaaaaaaaaaaacaagaatgctcagaattccggatattggatattagacaaacagacatatagtgcttcagaagtttaatccttagcacagttgtcaatacatttctacgaacgtcatccttcctaaatagtataagtgttcactttcttcttatgtatgagctgatgtagcatgagcccatttccctcccagtattggtgtgtgcagtgtgctggtactttctgagctaacactagagcagatttggtgtttttccagaatggaatgttggacccttggtttgagagcaagggactagtggatgcgaaccaggtgttggcctactttgccgtgtcgaagcttggtgagccaccagtggatgggattactgacactaatcccgaggggctgactgctgcatttggaaactgggctccagccgtggctactcgcctgcaaaatggcgggcttacctgcaaggtgggtttacacagttacattagttgtacttctagctgatgctcataaattgcaattctgcatgccttcatcacagattaccatcatttctactaagatttgactgtaaatgcacagtaaggtgaaggaccattgataacaaagtgcgtagcaaaaatgcactcacatctttgtttgtgcttacagcacattgtaatggacagtgcgtgcacgtcataaaatactcaattgattaacaatatattcttgtcatgtcatgtgtaagattttaaataaaacgaacaaaattccaacggtcaacaaaaaataatgaaccctgtgctgttatatactgacaagcatatccattagttgtaagtaatcctgttgtgattgcccactggaaaatcaggtacttgaaaaagaagcatttcagaagcaaatgctagagaaactgatctggatttcagcattcatgcttgttggtgcccgtcatccaggagctactgttggtgcggtcgagaaagaataccaatctgaggtaacccttattccttaaactttaatatatattctgtgtttctttctctccattaatttgaagcttagaaggcagtaagttcccaacacaacaaatttgtgaggaatcccttcttgtcataacacagaatcttcgagatcctctgcaatatgctggtttctaccaaggcatatattaattgcaagcaaaaagaaaaatgaaatcattatttcctgattgtacttcctgcataaaattgtctattgtcttccatactttattcgtccacttaagataatagctatttatgatttagtttactttggtaattttgatgggagtgcctgaagatagagacacagttttacgtgcaagacaggatttgtcaagagcaggaatagtgttcacacgtgaccaatagtaaccagtgaggtgtttgttatcttagagataagattatatctactcttgttaactatgtccttagttttatagataaatttcttgtgaatcaagtcatctcatctataaaaggaaggactaaatctcttctcattgaccagacatgagtaaacaaacaagtcccctgtctctaaactctaggttattcttgacctacgtccccaaccggtgtgctactttgcctagccgccatttttactttaagttgccaccatctaatctctcttcgatgaatactatcccaattgtgtgaatcaaggttcacaacataaaaaaaaaacatattcatttatattttgttctcacaggttgccagcctgatagcagaattagcatctgctgcagctgaagaaagggggcttacatttgatgcaggcatagaagagagactttgcgcatactccagagctgttgcacacttcccaactgctgtaaaagaggcaagtcctgcctatcataagctatctatataacaattaaacattgcctattctagtgccttttaaattaaaatgtaagctttccatggagcagttcaagtggaggaatggatggttttactctctcaccgaaaaggcgcttgcacaaggaaagccggatccatgcccactccacacagcttggctcaaggagattaaggtcatataaagaacttttatgtacagaagatgtgtggtttcgagtcatgttgatgttatccatatagagaaaatcgcataatctgataaactacgttaggtgcctgtttgatttgagtttagttagcctgttatattagtaatttacatgtcacctgtgtcacaataaacctttctatgtgaaaaattgagtgctcaagctggtcgttataaacttataatggtcaaagttcgtgataggcaccatatacatataatgtttgctgttactagtatctgctggctatattaacagtaaatgctacgctacgtactactgttatgcttctgtactgaatagtaactatgcaatatctagaccatccaatcaggatccaactgtggctacagcaactgctacagtgtttggcttattcgtggaataagccaaacggcatatttgcaaacaagaagtaatttgtgaattaaacttttatatacgtgttcttagcgacctaaaagcaaaagctgaaaaataaacttcgatgaaaaaccccaaaatcagcttcaaatttaaggtcgaaaattcaaattttggcttataagcataagtataaacgaaaagatgaggctgcactggatgccaaattgattattaccgagacacaacttatgatgcttgaataacttacaaccacttttatccttttccaatagtctcctcacacagtaataatcaatggttccctattattctctcctcatcctcttttaacttttgaggtgacgcctcgtgtaggttattttccccagtagcattatacagctaaactcaaaccttctccacctctgcatcttcagctaaagaactattgcaattatttcacgccagaatgacaagagcacatttcctttacttctcctgatgatcacacctccacagagttacatgaatagttggtaattattcagattttgcatacatgcaacaaatcttttgcataatcttcttttgtagatgatcaacttggccaaaaaaggcaaatctccaaggctcaaacaaaagcagtaccccgaaccacagccaaaatccgaagaccagcccagctaatacggagtaaaaccagcttaggatttcaagttcctggctgtctgtacttccccctatcaatgctgatgtagaatttgaaccatctgaacatgaaatgttcaatgggaagccacataacccaaagttgttgctataaattgatggatctgcaagcgtccggagttgataaccagatggtatctcacctgataaatgattgttggacaaatttagtgaactaagagacatcaaatttgagatgcttgaaggaatagagccggagagttcattccaagaaaaatcaagagactcgaggatcttcaaattgccaatctctttaggaataatgccagatagatgatttctcgacaagtttaggaacctcatgctttcaagattgcacaactccgaaggaatctcattggagagatagttgcttgatagatcaatacctgccatgagtgcaaccgttccttggaaagtttggttttgcctcttccagtttatgccaattcggtctgtgtatgtgtaatcaacacgcccatccaaaatgtggtgttggactttccaaggcaagttcagttcagtttttggttgtatcatggatgtaaaatttccaaaacttctcggtatcgaacctactaaattgttcatagctaggtccaacaattgaagatgggagagttgtgatagttccttcgggatactcccattgaacacattagatcgcagaatgagaaacctcagtaagggattgcaagttccaatccatgagggaattgtgccagtaaaatggttgccaccaagatctagaattattagccacttgcatccctttaggaccattggatatcccccagtgaggttgttgttagcaagatgcaccgattccaatgatgaattagggtaagccgacatcggaggaacctccccagaaaaggagttgtatgacaaatccatgaataccaggtcctgcaagtgccataggcaactagggatctctccatggagatgattgtttgacaggtccaagatttccagagaatccagctgacaaaatgtcaaaggaaattctcccgagaagctgttgctggccaacacaatggtcacaaattgcctactgccaaaatcacttggtatagtgccactgaacctgttattgctgagatcaaggccatagagattcctgagggatgatatggatgcaggaacctcaccctccaatcgattcgtgccgacgtcgatggttcgcaacgctgtcaggttgaagatttccggtggtatcacgcctgtgaagccgttggagaagagatccattaccaacaggtctgtcaggttccccacggaatttggaatcggccctgtcaagaaattatccgctagctccagtgcctgcaagcttgccagccttccgatctccgccgggatctcgccggtgagcttgttcttcgccaggcgcaaatacttcagctttgtcgtgttgcagatcgtcggcgggatgctgccggtgatcgagttgttctgaacacggaattgtgtgagttctacccagttcgtgaacaattctgaagggatgtcactgttaagcctgtttcttgacacgtcgaacacggtcatcttccccatggcggagagcgacctcaggataggaccgtacagtccattggaggacaggttgaggtagctcagctgttgcagcgtcgccggcgacaatggcaagacgtccagtatgtggccggcgaaggcgttgtcggaaaggtcaaggtacgtcaggttgctggccctggtggagacgttcgctgccacgacgccggcggtgatgttgttgcggcggaggtcgagcttcgcgagcgccgggaacgcggcgaggtcgagcgcgcggagctcgccgtggagccctgcgccggggaggctgagctccgcgacgtggccggcggcgtcgcacgtgacgccgcgccaggacgagcaggcggagctggaggtcgccggtgaccatgtggtcagcggagacgctgacgccgccgccgacaaggtggatttccaccggaggagggattctgcctcgccgtgctggatgatcgtcgagctggaacacggcggcgtcgacagcagcagaagcagaagggagatgcggagggggatgatggattttgatgcgtgtgttcgtgaccggagagccatcagtggcacatcgtgttcttgggattactccctacagtagagtagacggatgatgaactgacagcgggtcaaagatttggaaggagtccatcttgcgagacttgtggtactagacaattcatcctcatagttcctgtgctactgttatttgacatctctatcgaacggataacgcgttagttagagcaggtacaatagcatactgctagctataaacagaagataaaagatgagagagaagactacagatttatagccagctgcagcacatactctaaaatacatgtgtgtatgataggtgagatcgagatatggtgcaattgttactacaactgcaactttagcagttgcagtgcagccgatggatcaaaaatcaacggctcagatgacaggtaaatactgttcataaaatactatagcaaatttgtactgtagcgattactgtagtatcaatggtacaacaggatgacagagtgaatcggagcgttggctccatcgatccaacggttataatgtgctccgactgctaaagttgcagtcgttactactacatcaccagatctcaattcatgatatgtgggactagatattaattgtgtagtatatgtttataggtgattattatatgaattagctattaaattgaccatagatgatttgaagccaacagtttgctatactactccctccatttcataatgtaagactttctagcattgctcatattcatatactctctccatttcaaaatataagtcattttagcatttcttatattcatatatatctagattcattaacatcaacatgaatgtggaaaatgttagagtgacttacattgtgaaacggagggagtagatgttaatgaatctagacatatatgtgtgtgtctagatttattaacaactatataaatatggataatgttagaaagttttagtattaaacttgctcttatgcctctctcgttgttgtgctccaataaactctgtttaagacagcacatgaatcctcttcgctccaatcctaacccccgtcacattctcccccatctaatcctaaccccaaatcaaagtcagatccatcaccatcgtcatgacggccgcccaaaaagagaggtagatggtgctgaccatatctaacttctcctcggattggtaaggggctgtttccccgaaaacttttcccaaaaacatcacatcgaaactttggacccatgtatggagcattaaatacagataaaaagaaaaactaattgcatagtttgtatgtaaattgtgagacgaatcttttgagcctaattagtctatgattaatcatactacagtaacccatatatgctaatgacggattaatcatgaaattaattttttcattcgtgcccgaaaacttcttccgatatccggtccaacgtccgatgcgacaccttaaaattttcatttttcaactaaacaggccgtaagtatctgagattgtacacgttcctggcagatgaccatgtgattagaggagacactctgcgtccgccaccaaccagccgacttttgacacgcaattcacaggacaacacaataaccattgtactttcgtaacgacgaacggattcttttcaagcaaagcaacaaagatttatcctctttcgtggaagaatcctgattgttgaaatggcaaagataaacaacacctcggatcgacggaagaatgctgaaaattaccccaagtaccaactatatgataaaaaaaaaataacccacatgtagcggacgagagcctagcaatcaactgattgggtccaagaacatcagtgtctatcagtgtttatcagtgtctaatcgacaggcatgcgaaattttctgagcatgaagcccgcgtacagtagcaacgatggcaaggtaaagcaagtaacaacgccgcgggaaggtgattttaaagcaatgggactacctatttcagcaggatggtcagcggacgaagaaagaggcaacagctgtaatatctttccacgagagatgcagcagttgtgtccaccagatcttgggcgtacacaaaagggacagatacccaagttgcagtcacgagaacttaagacacagaaagaagaggaggagcatgaaatgtgatttaatcaaatcaaaccgatgatacccacaaataagacattaaaggagaagtgcattaataagggaggatatgtcaattgtggtcttgaagatacactcgatgtgcttatggatgtgaatatcgtgtttgagctccccctaattttttttcaacacctgatatagaggtcacaaagctcgttcttggttcaaataacactttgtctgagaagctaaaaaaactaagtgagcgcctaaattaaaggctctaattaacatattggttttatagtggttgatggaggttaatatttgtcacttccattctattctaaattaggccgaaaggagagtgaattaatgaaaactagcatagggcttagtggtttttatgggagttggctaaggctaagggtgtttatgtctatagagattattgttggaagtaaaaaaccatgcctactacttttttgtgttgttgatgttaagtgtagtgtaatgttttattaggtcgtgattggattcatgataattgttgcatcacatatactttacatcaatgtttgatgcaatggattaatgctaacatggaggtggttaagaccgataactcagcttgtatcaccttgatagacacaccggttgattagcggaacaacaacatgcaatacttgataggcagatattatcagactatgattaatatagtactaaggatggttttgtgccgatacaagctaaaccggttattttagctcgacttaataatctgtctttgtaagtgataagtaaaaaagatagtatttagtggttgccaatgcgtactgagtattatttagaaaagaaccatatgcatgaaacttcataaccaccatccaaagcggattctccgcacatcaccaaactcctcaattgtttcatgcatattattctttgcagaatgatactccgcagtacgcttttgcaaacactttatactatcttttttactcattatttattaagtcgagctacactagctggctaagcatgtatttgtacaaaaccatccttaccaatactaacataatcgtaggccagcaaatctctaccaatcaatcattgcagtcgtattgtcaatcaaccgccatgtctatcaaggcaatgcaagatgatttgtcggcctcaaccatctccacatcgacatccaactattgtatcaaacattgatgtatagtagaggagatacaatagtttgcatgaattcaatcctgacctaataaaatattatacctacccataacatcaagaacataaaaagcagtaggcatatagtatatatatactttcaacagtaagtttcatagacataacacaacaccttagcctcagccaactctcccaaaaaaccattacactccatgttagtttccattaattcactctccttctggcctaatttagaaaggaacgaaagtggcaaaatatcaataccatcacctccatcaaccaacatacagccaataggttaaaacagaggctttaggtgctcaccccatttttctgaattttcaaacatagcattttttggaccaagaatgagctccacgacctccactctcatgtgtttgaaaatcagccggatgctcaaacaccatcttcacatccatgagcacatcctgtgtatcttcaagatgatcgtcgacatttccttcttggtacgcttctccttccatgtcttatttgtgggtgtgtcggtttgatttaatttgaccattcctcacgctcattcttttctctccttctaaagttctcgtgatcgcttattctgcccacattgctttcgtgtacgcctaagatctgggttttggttgcgtccctaatgaaaggatattgttgcctcttgaagaaacatgtttcttcgcccgctaaccatcctgctgaaattaatcattccattactctatactccctccgtccaataaaaaaaaacaatctaggataggatgtgatgtttctatgtccagattcattgtactaacactactatagaaacaatttttctatacaagggccctataaggttgcaggctgaccataactggtcgcgccttcgaaaatcaacctatattttcacatacggctccttaagaggtccgcatgcaaaaatctattttcgtatgcggacctctaagagagtgatatgcaaaaataagtattttcctcggtgggtctcttaaatggtcgcatgaaatgtattttcgcaggcgggcctcttaaatattcgcctagaagtctgacttacttccttttttccctcagcacttcaatttttttttgaagtcatcgttatctcctctcatctctctctctctcacctccttcctcctcatattatacttctctcccatttctcaccttttcttctctctccctcaactcccctcctgggaacggctagtggcgggcacacggtagctagccggccgcccccgccgttgacgcgagggagacggccctaccccgccctcgagagcggcggtagcgggagcgagcaagccggtgatcggatccattgccctcgccctcgggagcaacggcggcaggcagaggcaacacgacgacgacgaccagcggtgttggctgcgacgggcggtagcagctagagttttggaagaatcggggagctagggtttcgggctatattgctttttgatattttttttatttttttttgccgaaactattttcacgtgcggtcagcttagatgaccacatgcgaaaaaaatagcaatctttgtagacacatgggtgcaaaaggaccgaaggcccgcatgcgaaaatctattttgatcctttgaaaaaattcttctttagtagtgtaggaaacatcacattttatcctataagttggttttttatggacggatggagtgttaccttcccatgatgtcattacctgccttgtcattgttgtagccgtactggtaagtgggcattgcgcttagaaatttccatggctccgatgcacacggatcccattggatgattgcatgctgcttcttgcctgcaggcaggggcggatccaaggggtaggcttcatcaggctcaagtttgccttccgatttttgcaaaaaaaattcaagcatatagcatttctcacatgggagcagttggagaaagcggggagaagagaagaggcgaataactgcgtccctgtccacgcgatgaagaagaacaggagtgatagagctgaaccgatatgcactaaacgacccaattaaccaatttagcaaaagcccattaaatggcgagtgattgccggcgcaacggtgacgagcgacaccggagcgaggctacgttatgacctgagctcatgagagatcgaatcatataaactaacaacaaatacactaataactccagatagtttgagaagaaattgggggatcgggtggagaacaagaagggaacaaaggaagaagaacaataggagggaatcagattcaattcatttcatttatccctctcctggtacatgtttcttgcattatcatggtagtaagactgactagtgggaccccaacgctggatacatttgtttagtacgagtatgacattatggccgagggaagtggactgcgccactgcagcccgcaagtgtgggtgtcgatttctaagatcggcaataaaatttatagggtgcgctagatgctagaaagaaatggtgacacagtgatttatactggttcaggccctcgggatgaggtaatacctagtccaattgtttggtggattatctttgtatcgagtgttgaatgaagaacgtgtgtaaccctctaggggtgctgtcgatccccttaatatagcagcagggtgaccggcggcaaggaggatgcaatatcccttacaatccgggctcctgccatccgtcaagatatggcgggatatgtttctatctccttattcctcaccatttatagtaacagattacatgggcttgggcccgtagcatgctagagatctggcctttgagtactgtgatgggctaccccagtacgataactcccacagtgggccgtgcaggcgtgccgggccggacaaaccaggaggcaggagcctaggaagtgctgcttccagcttgcttgctgccataaggccctatttgtttcagctcaaggccctatttatttcagcttagaattattataatctagattattagtagtaatctgaaataaacatgtagattattataatctataagacataatagtataatctggtaatctcctctaagcgtgttttttcatattatttggtggttaaagactcactatccttattctaccataatccagataaacaaccaactcatagcttattctactatagcttattataatccagcttatagtaatctagctcaataatttagattacatataaaacaaacaggcctaacttgcctcgttgcctgctacattgcttcttgcggcatgcggcttgcctcggttgcctgcatccagtgagcgagctctgttcagttctttattgtctagtgaaaaaatgaggctgtgaggggatttatcatttacatttcgtagtatttgatttattggtagatttgcaaattgcaatggagaagaaaatagcatagcttaattactttacaagccattcaactgatacatccccaacagacgagagcacaaatagaccaatccaacaaaacagataccaatagatgattagatgaagtgaggagagcatatttattgaatggtccaaattgagcaccaacatgtttttccaaaaacattggatggtaagatttagagattctttcaacgaaattggctcgataaatttgacattggaatatagtgtaggaaaggatgttgcattttctttttcacatttttccatttgatacttaaactaccggttcatattttctgataatggtatgcatttagccggtgccgtacagcaagtctgcgggatcgcgtggtgccacgtggccggcatgtgggactgacgcagtaccacgcgagcgctgcacgggattgtttcagccatcaatccgcgttttggtgtcgcgtcgaataatcgatcccacattatcatcttgcggtacatgtatatttttacaattcttttaaaaacacgtatataattacagaacgtcagaaatcatgtatattttaattttgttttctagatttcgccatctatcaaagagaaagaagtcttttgcaaggggcatctttcaccaaaaatttcactcacagcttaaaatttcctcctccgcccaaaaaccctctcgacgctccgaaccccagcaatggcggacccgccgtccttccgccgccacccgcaccccttctccatcgacctcatccgctggctcccctgctcctcctcctcctcctccgaccgcctcctcgccgccgccgtccacgacccggcggcgccctcctcctcctcctcccacctccacctcctcccgctccacgacccctcctccccgctcgccgccctccccctcccctcccgcgccgcctccctccgctgctccccctccgtcctcgccgcggccacctcctcggggtccctccacctcctcccctcctccctcgacgccgccggatcggccggggtgtccgtccctgccggcgccgggttccacgtgggccccgtccgcggcctcgactgcggcggcggtggggaggagtgggtgacggccggggaggacggcagggtgcacgtggtgggcggtggcggggatgggagggtggtggcgaggaggctgtgggatgggaaggggatggccgggtacgaggccgccaggtgggcgtcggcggcggagttcgccaccggtggcgccggctgcggcgtgcagtggtgggacaggaggaagggggacgccgtggtggcgcagtgcaagggcgtttggtgagtgtgagaaatggtggatctctcctgttcctggttgttggttgatgtgcttgtaaatgctagtaggagtagtacattattagtggttcaattaggatcaaggaaatcttctttgcttgtgattggtgagtagagactcaatgcgcgcacaatgatttgattggtgctagtacattacatgttgtttgctctgtagatatgtatgttcctgctgttgttatgaacatgctagatgtatatttatggttatggttatgctcattgttgtcatcacgtaattaggtcgactgctacggttatttgcttatgggttgatgaaaattttggcaaggagagcttcctgtaactctttgatgggattctaacatctcaagacatctctgctttcctaaaatttggtgcactcgaatctgatatggatgaaatgtacctgttacacaggaatttgattcaaaaaatttcagggtaacaagcaactcaattcttgaacttctctacattccatttctgaaaggctatagctcaatagttatcgttctatttttagaagctcagcctaagctttactagtgcagattttgattaattgtgtgatcctcaaagttcaaagttctgtggtttttttaattaaattgcagattttgatttgtatgctgataattgcaaaattcaaagttctgtggtttttttaattaaattgtcaagatttaggtttaaaaataatcatgcaacaaatcatatagattcatctctactctccagtcttcctcaaaaagcatatggactcctacgtcataagaaaaaaaagataaaaatgatttaggcttgtgattatttttattatcatggtgatgaatcgagatgtttcatgtttggcggatttatttgctaaaacatcaagatctgatgtcccagaaaataggttttttttttctgaatggctgcacatcttgaactcatgtgctagacgattcaggttcttttatataatggattgttatgttaagtggaatacaaggctggatggctgaaccttatgtgctagtatgctgcagacaatgagtggtttttgtatcactacttgatggaaaagcataaaacttctgaattactgttaatatctaattcatgatcaattgtaaacatgtaaaggtaccaatcttagcaatgtcatgtcatataattatgccagcgtttatattattccagaagttggtaatgtgccatatttgcttgttatgctgacttgatgaccttgtgattttgcaggggccgtggcattgtcactggtatggttcattccattgacattcatccatcaagaaagcatatctgtgtggtaagttcaatgtcttagaaaatttgtgttgacttgcgtgaatagaagaatttaaaaagtgatgagtgtcatgggccaggagtcccaggcccaatgggaacaatatccccgccccacgctacttacgtatctcagttagatagagtcagagtctgttgggattaggttagagtcctcgatctatataaagagggatcttatcccaggtcagagaggcattagattgagttatctcttaggctgtgttcttccccccattttcccaacccacctctcttgttttccacgcgcacacttttcaaactgctaaacggtgtgatttatgcaaaaactttttatatgaaagttgttttaaaaaatcatattaatccatttttcaaaaaaattagttaatacttaattaatcatgcaataatacgagcttagttttgcatgccgggctcctcccgaacacagccttagtgcccaccggccctgcctttcctgcacaatgtgctctagctccgttgcgctgtttaggtccagggccagtcctgttacttcctctattataatccaatttatcccccttcaccccctttcatctcaaataatcctcgccctgacaatgagccaaggtatatagcttaatcaaacagctgaatgttgcgtacacaccaagaagcctctgtttggactttggaccatgaagttggtatgatagggtgtccgctgttcactgagagtgatagtttctgttttctccaaaaatcttataaccaaatagaatacacgtaagaggaaacaaccatatatcagtgtattgacaaaatttcagcacaggtggaaatctggatttgttctcaaagtctttttttcaaaagaaaaagtatatccatgtcggctgttttattgaaataattagaactccttcagagttaatggcaactaattccttgataatatccttaggtcagatgtatttactgatttcttgcagctcttcttagttatgtacaagggtttccatgttattcataccccccccccaaccccccccccccccacacacacacacacacaaaaagggaaatggcaatgtaactaataattcattgtaatgaatgaatgctgtcgagtcattggctacaactcttgcttcttatatttgccaaagatcggaaatttccaatcagaacaatctttgctgtgacaactaaagtcagttatctgtattgcttaacattgatcaagttatcttctaaaattatcttcaaattacatattgacatgttagtatatattgtgaaatcctagtgttgacataaatatgttatatcatagttaactagggatatttggtcaggaagcggttatgttgcacttttgtgcatctgtgctgtacatgccagagaattaagatgtctataatggtggagtggacctagacgactttaggggtacgttctcactgtttacatgatgggggaactgtgggagaatggtgacagttttaaacctgggatactggtctctggactgtctaccaattagtgtcagaccactcatgttctcacaactgccaaatagacctatactggtccatcactgcggaactcagagttgagatgagttgaaaagctgtgtttacaggagagtcataactgcaatttgaaccagctctgatgtttttaggtgggagggtcctcagggacaatatttgcttgggatctgcggtggccgcagcaaccaataccactctctggtttaggccttaatggaacagcacagcctgtgtctgagagtgaggtctgggaggttctttttgacaattacactcagtctactgatatcatctcatctgcctcgacgagaatattacctgtgatgatgtgctcagaggatgggatccttgcagtcgtcgaacaaggtaagcctatatgaagaaacttgtgccattttttttgttggctattattcaaattgctgaaaaagttacctttttgttgcagatgagaggccccttgaattgcttgctgaaccttgcgctatcaactcctttgacatagatcctgagaacccttctgtaagttcaaggtttctccagtttgaatagttttttctttattggaaatgagatattaaaattgttttgctttttgcgcaggatgtggtttgtgccctggaatgggaatcaattggtgtactaacacgtggtagagatacaatggctgaagaatgaaaagttctatttcgttaaaaatttcctgcatggtcttccttaaattgtgtggggcaactatgccaagataaacgtcttctaggaatgacactgattcaagtcgtccaacttatgtctggtgctggagtaaattgtcttgcgactttgggtcgttggttcgttgccttgtcggtgtaattgaagatcgtggaaatttgatgtgaaagattatcgttcctagtttcctacatgtgtaactgcgctttacgggagttgggtgttccattcttgaaatgcaagttggaatggtccaaaactattttggcaagttctttgttgtagacagtattttggtgctcagggatgggtcgactgttgtgagaactttttgttccatgtgctcccaagtcatgctaatgatggctaccatacaaaatttcaaacggaaattgattccggcaccgagatgccattaaacctttatctgttattatcgaaaaatttcatctgctgcttgtagctcaggaaagaacgcaaacctttttctctctctgaaaatattgaaaaatttggcaatgtcggtttcaacattcttggataggatggtaattttttttcctagctgggacagcaaatagctccggttgaactttattaaaaccggggaagagctacaagtgtattatgacgaacaaggctgaaattttattagaatccatttgaaaattttaaattttggttttcaaaattgtggtacattattttattcccttggatttattagatctgaaattgtttttgccttgagaattgcatcttttaagagcaaagtgactgaagcttgactggttaggtttattgtgttgggaataatccactcacgttcgagtcttagatttgacaagtggtagacaatgtatctgttgatagcgagacgcctacggtgacttcgtcaatcttaaaatttgatggcccatttttctgaatgtactcgtatgagtagggtgagcgtgcattgtaagaatctccatttgtaaatatgttttaaaaatatgggcctgtttggtacagctccaacttctaaatttaactccagaagttgagtctggagtggagatgtggagctgcctaaacccagctccacaactctagtacattttgtgagagagctccacccaactccactcccagttttagtggagctgaaactgtttggctgagctcctggagctggagatggagttgtgccaaacaggcctatatagttaaaaaaagaaaattaatggaactcactatcaacaaattaaataaatggatataaaagaggccgacaatgtatctgtcgatagcgagacggctatggtgactttatcaatcttaaggtttgttggcttattctttcaaatgtactcatatgggtaaggtgagtgtacgtgcatttatagtggtgggtatgtgcgttgtgagcgtctccgtttgtaaatatgttttaaatgtatctttatctttactattataaaaattgaagatgtttttgctgatattttggtacgtcaactgtatttgagttgattttttaagtttgttcacttttgaaaatacatatccgtgtttgagttggattttaagattgtttccttttggaagtataaaaggagaaattttttaaaaaaaactcgtatgctaacttgagatgaaatacagactcctaatcgcagctcataattttctaaaaaaaaatctaagcgaattcccacagtgaattttaccctagctaaaccgtgcaacaataataaaattaaaagagcatttacctgttgcaacgcacgggcattttttatagtatagttaaaaaaagaaaattaatggtaaactcattgtcaataaattaaataaatggatattgaatataacaaaataaaaattcgggatgccttatgttaaaactagagcatcaccaaccgtgctttgcttctttcatagtcctgatttttttgggattttagctgaaaaaactgccccaacaattcctcttctctttcttacgagaattgacattcccttctctataagtcacgaatcattatcgctcccaatgttccgtctaaagagcaggaccaccacccgagaaatggggcgagcggaaaggtgattctggatgagcgatcacggagtaagatggtatgaaataaggtttgggtgaagggaggttcatccttttattttagtgagttaaatttagtctatttgttggaagtatatttttaaccttgaatacttattagaaaatctcgaaaagaaagatttagggaagagattattaggcacatgctctaaggcatcaccaacataacacaaggaacataaatcactctccacaacctcctatgtgtgcttcttcccacgtgtattgttctctccacattttgcacgtgctattggaagccgacaccctcccctactagtggagagcgactaggactgaaaagatatttcatgggaagttaattagggaactgtagaagtcaattttttttcttatgaaaaacataaaatttaggcattagaagctatattgggcataagttggtgaagctctatgggatgtacaccgaatttctccttttttttccttaaaaaaatcaatctaacctatgagcaactaatcaatctcacttgtactctctcaatccaaaagcctaagggcatattactttttaaatgggattaatgaaaaattaactcatcttgcatataacaaacactaaggattactcctatgtatgcatataaccaatgagtattaagataattgcttgagttccaataattcagcactacaaaataataagacaacatctttatttaagtctaggatacatgaaggctataaatatgcacatctcattagaaaaaaatatgcttaaaacttttggaacaaaataataagacaacatcttcatttaaatctaggttacatggaggctatagatatgcacatctcgttaggaaaaatatgtttaagacttttggacggaagggtacaaattgcatcttgtttcactgtgaatgaagactcatgcttttatttttcctcttctattgctgttcaggtaagatttttctacgctattagatctacaaagatataaaggcacaagacattaggcgttagaggtgagattaactaatttttttagggaaaaatggtaaaaactaaaatcccgtgtggataataaattataatgtccaaaaacaaaatgaacggtcatcaaacatcgaactatgtgtgatccggcgaacgaaatcatcatagtactagtttattagaaaatagaaagagtaattttctctacagcaatgctgctcaaacaataatatcaaccatctaatttaaatagatggaagttatagaaattctagatatactcacagcatgagacatagtgttagactgttagtaagataaaatttacttcatccgtttcacaatgtaaggctttctagcattacccacattcatttagatgttaatggatctagacatatgtgtttagattcattaacatttatatgtatgtgagcaatgctagaaagtcttacattgtgaaatggagggagtagtatgtatagacttttccttttctcttttgcggggatagctagaaagggtaatttgatgcacgccacagcggtaaaatggggggaaacaaccgcagcaaattcgttcggcatgtaaaagcctcaaattctagtattctacaagcaaaacatccacgaaaataactcccccacattccaaaaccaaccacctgctagggcccacctgtcagccaccctaccaccccgcccgctgctcccgaaatccgcgcgccaaaagactccacatacgaagcggcttcccgcttcactccccttcccaaaaactccttctcatccaaaacttctatttttccccccccaaatctcatctcatctcatccccctcccctccctctccgtgcgccgccaccaccaccgccaccgccgccgccgcaggagcaaccccgaggagacggaggagggaggaggcagccgacgccgccgcgatgttctactcgcacacgatccttgcgcggaagagcccactgggcacggtgtggatcgccgcccacctcgagcgcaagatcaagaagccgcagatcgacggcatcgacatcccctcctacgccggtaagccctcccctcccctctctcccaaagacgcgctctttcttttcccctttgttgttgctgcgcgggtagaaaggcggcgcctttcagcggcggcgggggtagaaaggataagcttttttttttttttggttcctccgtgcaactgggatttgttccggagttgtgagtgaaaaatgttttggggttagcaatggggtcaagtgatggtacagagatttggatcccaatctgcattctgcaatttgggacaggaaggaagaaggtttggatagttttttttagagcattttgctaggggttcgcagtatttatctggttatcagttagaatttcgtgtaaatgattgttctagtggcatgattattcattaatgacaaaagatacaacaaaatttggtcttttagttatgggaggttgtggtggggtgtgcaccggagacttttgggtggatttttgcaggccctatttggatgctaaacatttcaagaatgacagcatttgcatatccagaaggaagaaaaaaaaaagaacgaccaaacccaattttttacctcccagtacagtataatcacttgcggtggaacactgcctacttgagccactctatttgaagagtaattcatatatgtttgttctacttatatgaattacacaaataagtttatatgttatccagtcaaatcatagaacattgacaaataaactggcttgttgtgcttgcattgttcttttagtacattatgtaacagtttttactttattctgtgattaactttacatatttaaccttgcaaactcaagaacaaagtagataagccttatgtttaggaagcttactgatggaattttattagaacaaaacatgttttttgactggaagtaaaacaactggattaatattgcatatttgggcatagatgtctatactctatgggaagttttttttattctctttgggaggaaagtgtgacaattttttttatttcaacttcgaactgtgctttgcaagaacttgtattataatggcatgctgaataggtcacatttttctgcaggtcgcttacccttggcaattagtttgtgtttgcttagtgaggtcatgtgtcgcccttaggtgttgtgcacgtgagcgtgttcttgggtgtgtttgtcagtttaacctcctctttttctatctattttcttcttaaagaaatgaagttcagtcctcccgcatttttgagaaaaataggttacatattttccttagttaagtattgaacaattttctcatatacattgaattttccctatgctttactctgcaacctaatgccatgtcttctaatgcatgagttttattttttcagaatttatcatgttccctgaagttccaattgctctgaggttgtcagggcatcttcttctaggtctagttcgcatttattcatggaaggtaaactacctcttccatgactgtaaccggatgctaagcacaatcagaaccgccttcgcttctgtacaagtagatctgccccttcatgcggatcatgcgccttttgacaccatcacattgcctgatacattccgtcttgatgacataaacctagatgatgcaattcgtctgatagagtgagtacttttcttctcatatattttctccgcgtcatacaacctcaactaatattattgtgttaactttctgacagtacgccagataatcatcggaagagtctggaccagatcaccctggctggtatacgaagttcaattagtcaatatatgtattattatcattccaatgcggatgcttaatgatttcattttggtgctgcagaaggagactatctgatgattgatcttgatgaggtattcctcactgacttgcgctttttgcaggcttgtttagtttgcatgttttttaatatttgtgcttataaattgtgtaggatgctagagtagagctatcagctcctggacaatcttcacacatgggacctgaaccaactgacgaagagtacgtgtcatgttttttttccttctaatttctattttggtggactcatgtccgctttgcttatcaggagattgcctccatttcacatcgattttgggccaagtgacaatatggatgaggaaatttccgtagatccttcccaaggcaacaactcggaggcagtgaacaccagtaacataaatcaggcagataaagcaccagatttacctgaaataatgcgtgaagcaccatttgagggccctgaacttaacttgccagatattgatgaggtaaacaatgatcccatggatgtgactgaggaatcttcaccatttgtgtccaagaatatcacccctccggcactggaacgaactatatcccctggtcaaggtggattatctgggacatccattcccaatgcacgaggaagtacaagcaccacatatgacaatatagaagatgttataccaatggatattggttagtattttgcttgttgactcatcttgttctttccagttttgttttctgccttcattttttcataagacctaatagaaataagactacattgcaattccaccagcattacttatgtgggatgctagaatgttgtgtaaaatgtactttcccttgatgttaaacatgtcttctcatccaagttcttttccttctgtgattttaggaatgcctgattttaggattgaaccatctccacctcgagtacaagatgagatgaatgcacaaccagtacaaggtgagataaacgcacaaccagtacaagatgagatgaacgcacaaccagtacaagatgagatgaatgcacacccagcacaagataagaggagaattagatatgacaatgaaatagtgttctccaatgcgtaagttcgactttacaaattatcttcttaagcaaagttcattggtggaaataacctcaaattaaatattatatgtttaccaggacttcgatgaatttttgaaattcatattgtactatgtcttgcctgggcgttttgtttaaaatctaccaaatgacatcttcatttctaccatgtcctgtctcctctgatcctattactctgtcccctcacctacaccacccttcgaatattgtttttctaaacagcttatctataaatagaataattctatgtgtgctgttatcaaccggtaattaactcgtctaataattttgatatatttgtatgggatttgttctgttcaaaaatacaagtcaggctatgaactttttaccatcgtagtgctaggtgtgatggggattaattgcaacaacagtatgatatctggtggtactatactgtattagttacaaatgataagacctcatactctcttgcacagttatatgaagagacaaattgatggcggtgaactacatcgtctggtcagcaagaggaggaaactgcctcaagcagcggtggatgtgtggaaattcaacaggattcgccaaaaggatggtttcttgcttgatcctttggtccatggtaagctaccatactctctgattccactagtgatggtcctttcacttctgaaacaatgtcagctcaaatttgctcttcctttcagggatgtgcgctaccctacgtcaaacctacgagagaaccttcccccatgtgattgaccctgaagctgagtcaggatctgtcgagcatactcctggggtagctaatgacagtattcaggatacacatgatcatcaactctccccgaagtctcctggaaacacagatgcacaacctgaacatcagttcaatcaacaagctccaagaaattcagatggacaacctgaacctgagcttaacccaaagtctcctgtaaatgcagaggcacaacctgaatctcagattaatccacaatctccaagaaatgcggatggacagcctgaacctgagctcaacccaaagtctccaggcgaagcaggcacgtcacactttgatgatatgcctgagatccctcgattctcgccacaaaatattccatctccaataagagacgacaattctcctttcaaaactcctggtgctggtggaactccgaaatcaagacttggagaaactcctgcctctgggacaccagcagatatgagttacatgtcacctggacaagactctgatcctcaagtttctccttttccatttaatgatgaacttgatggagatttgcccgagattcctagcctcatgagtactcctggagtaatatctaccgcaggtactggcaccacaggattgggaagcatgtctgctaggacaaggtatgggataagttccaatagacgatttcattatatgttaccatttgagtgtgaattctgacatgtttcatactgcattgtagggctgtggcacagtacttcaaagatcaaatggcttcggctacatcagatgaccaacctggtaaatttatcttgaacagaatcttggaagggagacacaggaaacaagctgcacgcatgttttttgaaacactggtaccatttaaactgcaagttacatttcccttttggacataatttgtagtcactttccacactatgtcttgacatatcgtatgtttgttctttctgtaggttctaaagagttatgattatattgatgttgaacaagaagcagcctatggtgatatagcagtttcagttaaaccctcactctcaggagccaaattttgaccaattcagttgcttagaaccacatataatctcatttgatccgcgggaaggagctttggtgggatttgcagaaatggcctgaacaatggattcttatatgcgacatggctggctaatctactgcaatttgctggactccaattactagaacaagtaggcactccatgccatttaggtttatgttgcagaatactgtagttgtaaagctgtagcattagtagttgtcgaaagccaatacatcttgtccagttaggacttcagatggtagtccttgcctatgctttcttggcagaaagcaaagtgaacaaggaatcagatgaagataagaatttttcttacttttgctgtttaattacatggtagtgatatgttaaatacaagtcgaaaaatgttggatgactagcataagacaattttataaatgtcagtgtacatagtctgatatcttcagtgtgccagagcgcagagtctgttcagaaaattttcatgcaatatgtgttctgcaatgcaccattatttgttgtatttgtctgaagtttaccttgcatgattttattacttcaatgagatccaaaattaactgtccttcaatggcaaggatcacccttgcccattatcaatcatacaatggaaccaaacatacatttttctttccattttcatcatttgttttaatttttacttggtaataaattttaaaattaaaatgaaggttttgagaagtttactccttttgggtttaccccagtgcaaacttaaggtcaagccaaatggccccttaataaccttatattatacgtgtcattaatttgcttcggaggttaaagatagatctgattatgagactacatgttaattaaacactctatctttagcttcagtattattttgatatgaatatagaataaacatatttattattcttaattgaatatattcatatgttcttcctccacatacatatggcatttctagctcaacaaattttatatttgtgatttcttagtatctattcaatctcctttttaatgatatatatgatcttccaacaaatccatgatttactgatctatgttcattttgtatcaagattttatcaattgagcatgcacacacacatggatgttgggacctattcctttgcacaactcaaaggaagacattagtcctaataaatcgtttgtcatcctccacttgatgaccaaccggttgcctatgaaagatatgaatgtttattgagtattcattaacaccacaagtatcatatacttgcatgcaagcttaagtgcaaagatccaatataaataataggtgaacaacatgtatctagaacatgcacaataaatgtataagatttgctctccctaaatatattcatacaaagaaatatataagagaggcaagtgtatgcacaagtagagaagaaccaatggggtttatcctatacacatggagaaggtatgtagcaatgataaagacaaacataaacacatacctttatcatctccatgttcttaatgtaaagaacactaaataagaaaatgctcaagtaaacattagtctcgcacttatataacaataacatggaaatcatatatatgaatctatcaaaaagtatgagataagaagtgatacatatcgctttatctccatgcatttcatctttgtcatgattaagatccaccaccaaagaatgcatatctaccacatctcatcatcggggaaaaacttctcatcattttcactttcatatacaaataagacttattgtttttatttccatatcacaatgagactaaaaaaaactcataggaacattagtctctatcggtgatatgggcccgggggtacccagactatgaagaagggcctgcccttggtggccacgtggccttcccccaagggggttcggcccgaggcaaggcggcagccgttcctcacacaccccggggtcgggtcaccccgacccccactgcgcggcgccacgtgtgccgcgccagacgggcgctcctagtgcccacctaaccgcacttaaggcggtctgagcgagcgctccgcacgcagcatttattgcggcgtggtgtgtcaggccggtctgtgaccgatgattgacatggccggggtagtgcgcctgcgcgctggttgcatgtcaggcgtcctgccgcctgacacccaccgtcacgtcgcaattgtgagaggcagatcagcctctaacgtctaccggagacagtttgcctaatccgtttagggcagggttcccatctcccggtacaaatgaggacccaaaagtcctcactctttaaatgccgaatgacggctgtgtctcctgtgtcaggcgagaggatttgatgggccccgcactgcagcaaggcatgcgagtggctttcaaggcaagcaacgagacatgtgcttagtatgattatcctccccagctaggctcggtggtcccctgtggtaaccccttgagatatgaaaggaggtcctggcctactgtgggagggggatgagccattttgactaagatagtctcttgcccctcatcatcaacacattctactccaacaaggagatcttgtaatctctctctcagtgagcatagcacatgagtagggtattacgcttctcagcaccccgaacctgtataaaccaccgttgcctttcccccgaggggttgaaccccctctcttgcacactggacagcgaaaccctcaaaactacaatcaccgcccccggccgaactgaaaaaagggaggggggggggaggggggcctcacggttcactggtggaggagtacaccctccgacagtctcatataaatagattcgtcattaatcaccaaagtccaaaaccaaactaaagcacttgaacttacatctatgctttccacgatagtgagcagttgcagcagcatggcaatggcgtacaagcgaagtgggagagctccaatgcagcagcaccgacgttggaggcgcttgagatagaacggacatgatgcggcgaaactagacctccctgctatgatgcttttgatttgtaggctgctcaagtttgttgtggctgcactatggtaggagaggagagcagagagcatctcagcatgcatgagcaaaagaaaaagacagctgtgacgttcgtatatatagaggaggaaaggagaggtgaatacctagccgggagttgcacagacagtgaaaaatggagctaaatgatgatagtgatgtagttgtttatattgaatggaggaaacgaatcatgatgtggatggggtgcaggtgcttacctgccatcgaagagaagaggaagcaacaatgttctggcaacgagcaggaaggaaaagaaggcaggaatgacttgggcttccggaaacgacgacggtgctggaaacaggacgaccatgacatggcgatgaaactcaacctcgtagtagcagagcagcagtgggaaatagcgtctcgacctgtgcaaacaccaaatggtgaacaaggaggaggaaataatgaagaactagaatgtggtgcatgtgcttactgcgacagaggagtggtggcacgatggtcgcgcaatggtgctttaatgtcccaagacgacgatgggactggaaatggaatggtgacaatgttgcgatgaagctcaccgaacagcggcggctttgatttgtatggcgctcaggattgccaagcgtaagcatgttggtaggagagcgaagtagagaggcgacgacaatagcacatgaaagagcagtggggattcaccaccgatgatgacgttgaggtggtggctgtcttggaaacaagacaacgatgatgtggtttgtgatcaagaccgagaaatggctgcatgatgctcgtgcgatgatggtacaaattcatgagacggtggtgctggcggatggcagctgcagtcagaggagatggaagtggagacgccgacacaggagttgtcgacaccaaggagcagtggcggcttgacggaagatggcactagatctagggaagatgaagccggcctcaaccatggtgctcacaggcagtgggtgaagctcctatggatggcgagatggctcgagctcttggacatagtagaggtggcactctcaacaaggttgcaggagaaaatgatgatcggcctgtgccctctcaggctgcgacggcggtgctggctcaatctccactctccagggtagcgcctcgtgctctccaagcgatgatgagcagtggcagtaacgacatgggcgatggtgtgatcgtcgaacaaaagggagatgaaggaggtgtgtagcaggtatttatagaggagaagaggagagacgaacaaccaggagatggagaggtggcggcagaaattagagaaatggttttggcaaattgaagagcattcaattttttgcattgaagaggagaaattgatggcgaagctagtgatttgtagagaattgtaagaggaggctgcttgagcaggagctcagtgtgcttgacttgtgtgtcaaggtgtagaggtggctggaaaattgaaaaatggatccatctcatcaattttattcagtttttatcatttaaaagagatatattgattagagagaggaagggattaattaatgggagggaggaattggaagagacggcactgcttaatggatgagcatgacgtggtttcttgagggaggaggaaggtgagtagcctggagatgaaaactcacttttttttaagataatggaagttttattaagactctgtcaaatatactaagatgatacattccaactgagcctacccccggcctctgcataaaatgcacacagccaataaaaggataaaattaaaccctcatcacgaaacatagatattagtgactatcaatctgtagactagatcgccacccatgctcctgggtaaaaacatctcgtgccacctggtccaaatgtcgagataccaccgcaatagtatcccgcaatcccggtttgtggaggatagcccaggtacgtagccaccgggtaactagagtaataacctgtaaaggagaagacactaacttgttataaaaaataaccccgtttctgcttaggcaaatggaccaacagagagctgctgcacccatcaaaagcagatttctcatttctttaggaacacataaaagccaacgcccaaacatatgagtaacatttcgaggaggttgaaagttagaggccatatgaataacgaaccataccaaacgagatagatgacattggaagaacaaatgctgaatggtttcatccttatgacaaaagcaacattttttactacctttccaatttcgcttagctaggttatccttggttagaattactccccgacgtaagtatcaaaggaaaacttttacttttaacggtactttaatcttccaaatacgtctattaatattcgggacgcccgtatgaacaagagctatgtaatgtgaattgaccaagaagaccccattgggggtgagattccagtgaaattcatcttgctcttgtgtcaacaccaaatcagctatgcgaggcaataaattatgccaagcagctagttttgctccaattaaatctcgtctccatgaaaagtttggagggtttgtttgaaagatttgtgatattgtcgattgtttatgcctaactatgttatagagacaaggatattgatctctcaacgaggcattacccaactacttatctttccaaaaccttatttgagaaccgtccctaatacgaaaagacccaaaccgaaaaaatcttgtttggccttcataagactagcccaaaaatgtgagtctcctgctttccaataagactgagataaaggttgtgatcctaaatatttattacgtatcaactgttgccacattagcagttaaaaaaattgattcagctcatcaaggtgatttgatttttggtattggtggagaaagaattgatgggggagagaaagtggttagtcaggggaattggaggagaaaacgtctggctaggcacttaagtagagtttgaagaagcagaaatgacgtagccatgcgggggtagacggtggcacatgggaacatgtcggcttggggtggacccaagtgctggacgaggtggagaggagcagtacactaggcttcagcccatgcacggatagagaacgagggagagagacacacacagagaaagagaagcaaggatattaggaggcaacgggcggagccggaaagaaaaggaaaaagaaaggaagatgtgatgaaggaagtaagaaaggatttttctattgagaattaagatttttctaacaaactcaaaatttggagaattttttggatttacgattcttaggatttgggtgaattcatgaaatagagctccacttccaaaactcgaataaaaaccaaataacttcaattaacaaacgataaaataaaaaggtaatgtaattaattaatttagtcaaattaattaattatgtgaatttttgttaagctattttagatgaatataaaatagtgaaagaagtaaagtttcttgcaaagttacagcggccacgtcatcaacaaatcactgtccgtccgatttcccatccacacgatataagccgtcaaatccttatattggtgaaatatctttttggtctttcgagaaacctatttcacaatgaggtcctcctatgtccttatggttttaaagaaaaaaaaaagcatgtgatcccctctctcgtcttctcgtcgtcacaccactgccgcggctcctctcgtcgacgtcccaattcaccacccccggtctgcctcacctcttttcccgcaccgacgcatcctcctcctccctcttccccaccaccagcgcctcccctccctttcccctactatcgcctcttcctgctcaccccgccgcctcctcccatctccacctcctcctcctatagtccccgccactagcgccgctacatcctcttcgcccctactctccaacccaatcccttgtcgccacggttgcttcatctcaatcgcccaactgtcacctcccgcatggttccataatacgaaggcttcggttgtatttgaggaagcagcagcagcagcagcagcagacctccctcactgtgttagctaagtgcccccccccccccacacacacaatgaccgacatcataggtagtcactcacacacagatcaacatcatcaagctaattaacccattgtacatgtagttttgtccaccatcatcacatatttggatgcttcattcagatcttattattatgttttgcatcagcaggcactacatggctgcagaatgcatggtaataagatcatcaacaacggtaatggcagcgggggtagacggagtatgacggagaaataggtgctctatactgatcagcgaacagtgcaaaccatggtgaagtagtaaactttgcagattgctttctgagtttgcccatgaatatagatgtgagtgttggaccactgatttatgaatgaaaaaggcaatcttaactgatctgtaggaactatatgggaagactattccttgcaaattcaacaactaaacacagggctaagtcacactcaattatatataatggatttgtgtgatcaagtaggcagttgaattatttcttgtgatcatttatggtcaattttgcttggacatatgtactagaaactgttcaattagaatcaaagttacaaattcatgcattgcaaagatttgtgttttctatggtatgtgctgaaagaagtctttgcttttcacgcattgtgaaaatgtgaattcattagttcctgaggttgacacagtggattatgttaattagtttgaaagtgtttaactgtcataataattggagttgtgaatcctttgtgactgctctactatcaaatgttgagactagacactgcattgtactaaattcttcgtttgttattccatgatcaacagatgggaggaagcatcaagttgtactggagatttttgagcagctaggagtatttaccttcataaatatgcatattcagaatttctaaactcgtgctctaaagaagcatattttatttggctatcaattatttggtgtattgtattatatatagttaacaaagtttttagccataatgatcatgacaatcatcaaattctattctttcaaaaactgaaacttcctacaacagttgatccactgtttttgtttacacctcttaatgctctttttgctgctataatagataatagaagagattgtggagtagcagatactaaccactccatgagaaatctcaaaattaacttccaatcatatgaactttgaaaaccaaaagcaaggtgttgaacatagtatttgaaccttagttggaaatattgagatttatagttctaatgagtaattgttagccaagttttgtgagtttgcaaaaaaaaaagggcaatatatatatatggaccttttacataggcatccaaagttgtgcaacgcttgactaaatagctagtaaacatgaatgtgaattttcaaaattagacaaatttaagaaagtgacacttggccaataattattacaaagttttagatatctaaaccaatataaaaggaactggttttgaaattgtgcaataactaagggttgatatatctaatcttaaatattgctaccaataatatgggtaggacttgtattttgatatttacccccaaatctctcctaagcatttaacctgtccatttattatcttttctttaaattatcatttcaatattaattctctttcgtatgaattaagtcagattgttcatttccaccttcaagacaagcataccacctacttaatacccacaaatattactcacctaccatgtgacatggaggaggctccgacatgggctactaacgtgtgggcccatgatggtgagccccacctattatggacccatatccctttgattttacgtcagaggagctgcatccatatgacattcagctgaacatcttttcagtcatattaaataaagtagtaaaagccattgatatgtgggcctcacttttctttggactcacatgtcaatgactttaaataccctctacctggcatcgtgttgtcttttcttgatatacgtgtaacacatttacgtatgttgttggtttatttttgtatttttactataagttctatgaacaaaacggcttatcgagaatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgttagtacttttttttttcgtttgttcctttcttttctttttccaatcctaattaaaattgaac

SEQ ID NO: 81971 - DNA, 1270 bp, Oryza sativa
caaaaggacgatgagatttttttaaatttttttgaactatattctcctaaagttgtactattgcgctattatcactaatctgcagggtcaatcaatcttaagtaatgtatggcacacatctatactccattaaaaagataagagtgatggtagcggtgaatcttccattgccactgataacccatcattcattttacagttttttacaaattagcttcttattttctgatattatggaatagtccagtatttatttcaaataaataaatacaacatatttaaataagcgatactaacatatctgataaaaaagatatatgttatctatgatatactataatacgtttttttttactcataacacagcatgagtattttgctagttatgtagaaaacgcaatgcaaccatgcaagaaccccaaggttatgtagtctagtggttacagtgatctgagtagctccccaaggatctgcgtttaaatcttcataggggtgaattttagattgggttatttgagggctaactttcatcaactaagtttctaatttaaaaatactgcatatatccggttggatgtagatgtcggttaaaaaaaatatccatctataataaataaataaaattaaaattaaaaaagaaactatgcaacggtgtacgtagcatagttaaaaaaaattaaaaattaatctagctacagtgcacgtagcgtacgacactgttacaacggccttgctttaaggccgcaagtcttaggtcgatccatccatccatatatattttgcaccgtcttttctcgatcgatctgcagtgaagggattcaacccaacgatccatcgggtggcgcattaatccgctcggaagcaagctagctctcttcgggtactgtttgaatgatacttttatcatgttttaatttttttttctcccatatgtactgttataatccactaacaaaattttttaggccgtgttggtttgggttatagtaaccattcggtacgtaacaacatgttagtatatgattaaaaattaattaagtatagattaaaaaaaacttgaaaattagattatataatttttaaagcaacttttttataaatttttgtaaagcacactgtttagcaatttgaaattcgtgcgcgtgaaaaacgaaagagtagaagttagctaggaaagtgtagtgaagaaagcaaccttaaatactcctaataataagaagccggcccatatatgatagcacgagagatcttatcaagaagctcagccaat

SEQ ID NO: 81972 - DNA, 3777 bp, Oryza sativa
ctctctctcaagaaaaagttaatcgccggctaaatttattaagatttgcaaggccgtgtggagcaaggcacaaggccgtcactcttcacatgctttcatcaaaacaccaagattacatcacctgcttcatggcgtcgcctgccgtttacggtgtgcacccttgtcatcggtttccatgatcatctcatatattctctcatctactggctgcttgatttcgattatattgagttgcttcctcttgtttgatttttgcattgatcgatcggtggtccctgcagtgattgccacgatcatcttcgttgtggcgttcgcggcgttgctggtcaaggtgtaccggggcgccgagagctgcggcgccgcggtggccgccgagatgaaggcgacggcgcactacgccgtggtgcccgacgccgcgatgcggagcgcgacggtggagaggttcctgtgggagatggcgcacgagaagcccatccggttcacgccgcggcagctcgccgggttcacgcgcggctactcggcgcggctcggcgccggcgtcttcgggacggtgtacggcggcgcgctccccaacggcctcgccgtggccgtcaaggtgctccgcggcggcatggacaggaggaggtccgaggagcagttcatggcggaggtgggcaccatcgggaggacgcaccacatcaacctcgtcaggctgttcggcttctgctacgacgccgccgtgcgcgcgctggtgtacgagtacatgggcaacggcgcgctcgacgcctacctgttcgacctgagccgcgacgtcggcgtcccggcgcggcgcgccatcgccatcggcgtcgcgcgggggctccgctacctccacgaggagtgcgagcacaagatcgtgcactacgacatcaagcccggcaacgtcctgctcgacggcggcatgacgcccaaggtggccgacttcgggctggcccggctggtgaaccgcggcgacacgcacgtctccgtgtccggcatgcgcggcacccccggctacgccgcgccggagacgttgatgcagtccggcgtgacggagaagtgcgacgtgtacagcttcggcatgctcctcctcaagatcgtcggccggaggaggaacttcgacgaggccgcgccggagagccagcagtggtggccgatggaggcgtgggccaggtacgagcgcggcgagttgatgatggtcgacgacgccgccgccgccatcaatcatccgagcgacgagatctgtagtggcagcgacggcgaggccgtggtgaccgtggccgaggccgacgacgagcggcggtgcaaggaggcggtggtgaggatgtaccaggtggcgttctggtgcgtgcagcagcggccggaggcgcggccgccgatgggcgcggtggtgaagatgctggagggcgagatggacgtcgcgcctccggtgaacccgttcctgcatctcatggcggctccggcgccggtgccgaatccatgggcgacgacgacggcgagcagcggaaacgccgtctcagaaaacgtcgttgtttctcacggaagtgacggaatcgtctcgctttgactactgaaatcttttgtctgtgcgtgtgggtcgccacgacctcgtttctttgcattctacaagtagattgtttatcactacatcataatacttcctccatctcaaaatatttgacgccgttaacttttttaaaaatgtttaaccgttcgtcttattaaaaaaaaatatttgacgccgttaacttttttaaaaatgtttgaccgttcgtcttattaaaaaaattaagtaattattaattctttgatttattgttaaatattcttttatgtatacatatagttttacacattgcacaaaagttttttttaataagacgaacggtcaaacatgtttaaaaaggtcaacggcgttaaatatttagggatggagggagtactcattagatttggaccaacaaatcttacaaaactttcaaccagtgaatactacgttttcaacaaaaaaaaaagaacaaacatgttaaaaatagtaattctagagacaaaagcagttgtaaaatcaatttttttataatataactgagtgcagatacactgtaactatttgtaagtgttctatagtatatataagcgttttgtaaatgagtgtaattgtaagttgggtctacataaatataaatctttgtgcagatcttacagacaaaaaataaagaggctgctatataatggaatcccgttttcgaacggaatgatcccgagtaggtaacaggtgtgatacctatcaagtatcagacgattctacacaacatgatgatcccgagtaggtatcaggtgtgatacctataaggtatcagacgattctacacacatttcaggtgacacttgcaagtatcatgtgatatttatcaggtatcatgcgatttctaccacgtatcgcgtgatactcgcgaggtatcatgtgaaacctgtcaggtatcagacgatttcaaccacgtatcgtatgatactcacgaggtatcatgcgatacctgtcatgtattagacgatttctaacacgtatcgcgtgatactcgcgaggtatcatatgatacttgtcaggtataagacaatttctaccatgtatcgcgtgatacttacgaagtatcggatgatacctaccaggtatcaggtgattcctactatatatagctgggcatcccgttgggggaggagcaccccgacacgtgcggtcggccccctgcagatgtcccttgtagatgaggacggcgacggcggcggtaggggacgagcgcggcggcggcgggggattgcgacggcggcggtggggcatggacgcggcggcggcggcgtcgtcgacgggggacgggtgcggcggcggtgggggatgggcacggcggcggcggaggcgacaggggacgggcgcagcagcgacgggggacagcgacggcggcgagtgagcaggcctggtgcgtgtatggataagaatcacgttatggaggaggagctatcccgttgggggacgatatcccgtcccctagcattcccgaaaatagaaaagggagccaaaaattccatcgcaaaggcttgaagggcgccgatggactaaaacggatggcgcggaatcaggtgatcgatcggacaaagacgacgtacaaaaatctcttcacaaaaacatcttcaattttaataatagtagtagaagtagagatagagactatgggcccacatgtctgtaagacaaatgataaaaaatagcgggacccacatgtcagtgggccccaccctcctccctatctccagcaactcctcattcggtcattccccttctcccccttcttgccggtagcttcctcctctggctacttcttctcgccagcggtggcaccggctgctgtgaggaggcggcggcagcgtcggctgctgcaaggaggaggcggcgtcgaaggcctcgatagcctggttggaagccttcacgccctcgaagtctgctgccatggcacgctaggcgctgaggatgggttcggcggcggtggccggttagcaagggaactcaaagagggagtaaggagggccgggaggaagctcgaggagggagcggggcagctgtgtcaggagccttgatggcctcgaggtcggcggtcattgagcgctcgccgctgaggatggggttcgcagcagtgactatggcgcgctcggcctccatgctcggccgctattgtcctcgttggcggcagccggttggcgagggaacccgaggaggaaggaggaagggcc

SEQ ID NO: 81973 - DNA, 3209 bp, Oryza sativa
accgccgccaccgcccatgcttttgcacggagtagagggtggagaggggggtttggagtcagctataacttaaaagagtgaattttatggtccatatagaaaaatgaaagctcggtgttgtgaaaaaatcattttaatattattcttctccaaataaatttataattgacttataattatgattatccttgctctgtgggagaacctatggactcggtctctaccctctctgtttatattatataagtcgctttgaatttttttaagtcagacttatttatgtttaactatatttatagaattttttaaatatatactgatctgcgataacaaattagtttcattaatattgaacatattttgatgatattttgtttgaaatgttacaataattttctataaacttgattaaacttaaaatagaaaaacaaataacttataatatgaaatggagacggagggagcaccacaaaattaacagctagtagctagcaaaatacaactcggtcgacagcttcggactcggtaattcatacgtatatataatcaatgtatacgatcgagccagctatagagatcccaagcacgtacgtacgcacagatcttagacgtacgcgatgcctgctgcatccgatcttgggcgggacgtcgttgttgtacctccagccggcatcatggacgacgatgatgaaagcacctggtcaccatggccggatctccagccggagctggcaggcatggtgttctgccggctgctgtcccacggcgaccgcctccgcttccgagccgtgtgccgccggtggcgcctcgccgcgtggcagcagcaccctctgccgccggcgctcccctggcttaacttggacggccgcatcacctaccagagtctccccgacggcgaggtgcaccgcatccccgtccccgacgagctccaagctggaggcacggtcgtctgccgcggctcgttcgatggctggctcctctacgaccgcagcgagcagctggagtgcttcctgatgaacccaatctccaaggccaggattgatctgccctaccactggcactgcgacgacgacgacgacgccatcctccccgactacggggaggagaaagagggacaacgaaccatgtgcttcggcgagaacgccgtgcggaagatcgccgtgtgctcgcctgatctcgtcgccgccgtcatcgccggctctggcgttttcttctaccggccgggaatgcactcaacctggctgtttgcctccggcggcccctgcttcgcgcgcgacatagcctactacaatggcaagctctactccattagcagtgacggggagcttttcgttcacgagttcagcgatagcatcagtgcagatatcgtgatcggcatagctcctcaagcctagagttgtcaaggctacagttggcggagcactttttacctcgtcatatcgtgcgctactggaaggctgatgatggttcgatggcggtggcatctccccatattttacaatgtacgccgttggggcgtcgacgagctgaggaaggagatcaagctggacgtgttcgaggcagatctggagaagcgcaggtggttggaggtgaaggaactaggtgaccaagctctcttcctcggcacctcctgctccagggcaattctttcatcggattatggcagctgtatattcttttcgagcttaaacataaccagattatgctctgatgggatcatcaatggcattggtgactgcgcctactgtgtgtatgacatgaagaacgacacattcagatttgataatccggtgtccataaaaagggaggggttgtcttatgggtcggatggaagatggagagctgactggttcttcccatgtgagtgaccttttttttttttaaagatgcgcgtgagtacatgcttgtattgtatatatcttggcccgtggcatctttaaaatttgtatgacaaaatatagcacatctattatgtaccccctccacataataaatattatgcaccccttccttccacgtcaatcaaagcgttcgcacgtcgggcagactccgatcaattgatcaaatccacctgctgacttcccccatgctatctctttttaggtccttctcgtagaaatggcgtaataacatgatgaccaaagtacacctgctgacttcccccatgctatctctttttaggtccgtctcgtagaaatggcgtaataacatgatgaccaaagtaggaacataactgctttatcatagtaacaatgttaaaatatagtcacgatatcatggttattgcaagaaaacacccgcccaaaagttgaaatactgcaaaatctgaaggatcgtaaagggcctttcccaccccaaaagctagccgttgaggtgaggggttcctccactaatatcttaggtcatttgcccttccacaaccaatgtggaactattcaacaaaatctagatttaaaattgaatcaggaatttttgaggttttcggggaggggattttgagaccttggcacatagatcgaccttaaagccacaccaagaacaaaagtttttgaagtggtccagccgctgccggaagtagcgcgtttcgtagtcgtaccctctcaccgcttcttcggcccccaccaccccacgtcgtagccgcgcgtggggcaccgggaagcggggcggctccctcgccatggccgacgcggtagccgcgcgcgacgacacgagcgcgcccacgtcggccgagcaggacaaggaggcggaaaaatcggagaagtcgccgcgctcgcacgctgcctccgccggcggccatcgcggcgccgccctcccgcctcgcctcggccagctgcagagaagtgagagagagagagagagagtgagagagagatgaggaagggagagaagaggggaaagagagggtgacgtggacacctggcatgtggggtccacgtgggtcccacgctgactcagcgccacgtagaccaaaaccggggtcaaaaccaccgaaggatctcgggtgaccggttttgtatagttaagagaccccacatatctggttttgaggttcgaggatgttttttaatcccgacgacaaggtgagggaccttcggtgtactttttccgttccaatgggttgtctgggaacacccaagaatttggcccatcccggcgacggacggcccaacgagaaaaaaacagcccagtcgccctaggggagtcagggt

SEQ ID NO: 81974 - DNA, 21602 bp, Oryza sativa
cttctagattagtataactaaaaccctaaaaatataatgcatttattcaaacaaatttttaaaaatacacactatttaactcaatagtcacatataggatttatgaatattacctgaaatcggcgtctgaatccggcagggcttcgccccttcttctcttctcctcccctttcttctttttttttcactgaaattgaggagagaagaatgagggctgggggctgggcagcaggccttttataggcagcgaggcctgccgcccggccagagggcggcaaggggccgcctgcaaaatagccggccccgactggcttttttgcattcgggccccttgcagccccaccagagggcggcaagggttttcctgcaaaaaaaccctccctccgtcaccgcccgttcctcccccgtttgccacgtcagcttgccgccccagaggtgggcggcagggtctatttttgtaatttttttggccgatagattatttctgtaaatatttttttaaaaaaatctaaaaccgaaaaaaattctgcaggcgatggccaccacgcatcggcatcgacgcatcgcgccgcctcgcgtctcgggctctcggcgtcgtcgctgcgcgcgaccgcgccggctcgccgcctcccgcccctgagagtggagacaggggcaggcgacgcgacgcgacgcgacgccgccattctgcccccgccaccccgcgcgccggcgccgggtcccctgggctctccgcctcaggcctcagcgcctcgctcgccttcgactccctgtccctctccagctctcttgctgccctgagtgcaacggtatagctctactgctctagtctctactctagagtttagtctttagtttttcatttcttgctgccctgtgcactagtgcgtagtcagtacagtagtgctagtgcttccctgttcttctagttagcgaagaagatattataaaaaaaatgaggactcagagagtacataagaagaaatagtgtattgtaatcttctacatatctatgtaagatgtttgaattatttatgttgtaaactttcgttacttcaaacttaaatgttggttttaagcaatttgtgatgctgtgagatttactgctatatttgaattgaatttgtgacaatgtggtaatttggagcgtcaagtaggaccacccaacaaattgttcgtggagccgccactgccaagcacccaccttttcatcccaacctagtttccaccgtggggctgggcacccagctggggcgccaaattggagttttgacatgccttaaatcgtgtaagggttcagaattcggatctggaaaacgtcagtgtttggctgtttgcaacacgcaacgcagggttcttgctgtagtacagagtaacgaacttagtttttttaatctaatctgtgttcttccccctgaagagagacaagtgaacgattgtcggaagactttgtaccagaaccactacactaaaaaggactgattgtgactatgttcacaggctttagtgtacagctaatgaaataattgtaccttgtacggtatcaagctaagagcaagtttaatagtatagccaattacgggctccaaatcatctatagctaatctaatagccattcatacaatagttaactataaaaatatattacaccattaatacccggtcccacctctcatacaaacataacgtcttggagtctgtgttgcagctagctacaaatctatagcccgctttcttctctctcttctcttttcttctcgatatgtggttatagctggcttatagcctgctattgtacctgctctaatgtgtttacggaatcatgcaacattgtgatatcttctgcctctagcagcaaacaacctgcacaatgtttttaagcatccttttaattcatagcaaacaacctgcacaagtttctcggcatccttcaattcagggaagcagcattgaaaaaattggtttgatccgttaattcatgaacagcagggcacattctagtttcgtatgaaaatggtagttttttctttcgtctgctttgcgtttctgcttctcttagaattcttttacttttgtattatgcctccgaatatcatttagaaatgatttctgatgttgatgtttgtcatgcctattgttacttattgagttaactaattgctcgaatgagtttatacatcagcattttttatttatttatgcagctctaaccacaagtctggaacatttctccaggtgacctctgtgagtctgggagcaggtaaattaagtaaacatgatatatttgttctctaaaactgttctctgatacaggtatactgcttggatattcttggcagcaatatcaccatctccccagttttcagtcaatggggttggatttacggatgagcctttctcttttcctcaacatttatatctcctctctaattttcttgatcgtattccatgtcatattttttggcccgtggtatcctggccttgtttctcgtatggcagaggaaaagtcagatatgcttattataatccaagattgtgcagtaagtttcttggtatcaataattatatgagtgttctgtattttcacctaatcttgtttagttaccttttcagctgtcccttatccatgtttctgcattttgtgccttgttgcaggttaaagtatagcttgctctgtactttacagccactgacccgctgtggtaacaagacgtcgtctcaagagataaatctattaatcgtagaactgctagctggattgtgttctctctgtgggaaaaaaaaacatgaggacaattcacttatttcaaagctatcacgtatgcataagtttaaagagcagatttgttcatcctggtttgtctctgctagtgattaccctcttctatctgaacgggcaatttatggagaagttagtacgcttcaccttttgcgtttctattgctgttttttttaaagttaattcctatcttttatgtttgatccagttagcttctaatggatcctgatgttccaatgatatttcacgtgtctactcattatgggctacatgcattggtctttacatagccagttgtggagcggtccatcgggtgtgccaaccatctgaacacatccacctgataattctctattggtgtgtgttatgagaattcagaagtcaaagatatgggttctgtcataatgagaaagcaacacctgatattggaaaagggaactaaattcaccatttgtttatctaactgggcactatatatacgaactaaaaggaaatcccatgttcacatggtgtaattgtattacatccaaaaaatagtagaaactaaaagtctccttggtttgttcagattttttttaaactcagttttcgtatcttttgtttcatttgagttgcttatagatgggctctaacggtgggtatgaaaaaatgaagaaacagctgaaaccagattttgagggtactctgggtatgctgatgaaactctaccttttgctatcgcacttgatgcaatgtacttatacggttttggagtttccgtattgatattagtgtactccacaaagatggtgatttttttccttttcccgcagacatccaaatccgtcctcgttttcatatgaacggcatcttttcttccctttctagtatgccttccagccacctgcttggtataaacttgaacatgtagcattggtgaaacccgagtttctgagctcaggaaatatcatggacgacagtgtcttattgttcttggaaaccatgataagtgttactcattgctaattttgtgcagtcccatcatggtttacaacgttttcttaccatgtattccttgccatttgctgacatgttttatttgttatgctaatgatgttttggcatggaatttcccacgatatttcaaagacactactgcgggttgatctatcaaaaaataggactgataaaatcataattgttttgagcagattggttcactgcacacattcatgaggtatatatgtcataaaagttggctgggtgagtgatttctacctcagaagatcatgaattatttagccttaaagcttcctgattggtggtgggtttttggccttgatcaagcacttcatgttgacattgatatctggagttcaagtctttttcagagcgtcagaagaaggtaattacattgtgccatcttttaaggtgttagcaaattaattttgtggcctatgctatggtgtacatttctgaatttgatgattcagttcttctggagaaaatgtaatttgattccagtacaccagcaacattactctacacattgttgtcatgagcaaaaagttgtgcaaaattccatgtgaagtttgctgcgtggggatttttcttagtgactgatactagtgagttttgcaggttgaacaacaagaagtgaagaggtttgtcactacgatggtgctgttctgcccttttggcaagaagttggaagagtggtgtcttcaggacatcctttgttgcttttttggtgttccttctgcagtcctggaactgatatttatatgtgcccacaattggtgataaatgacactacttatctagataaagagtcctgttgttagctccacaatctctttagctaaagagacaagaatgctatagtagtatgaaactgtcaagtttctcgctttactgttgttttgtggctgtaccacgaagactcttgtgtacaagcagaaactccaaaagtttcttgcactagaacatctgggagaacaagaacacccaaagggagaaggctttaaactgagaagtagccaaacctctactcgcactccggaaggctacatccagtcaccattttgcagcctcagaaatggcatccatcaaagtcgaaaccgcagaagaagctatggtacgggacaacggacttgatgtcgttcaaggcattggtgctgaaaccacgggccctgaacaactcttgcatctttctcgaacctggctgaaggcagaacatccgaccaaccctggccatatggagaaaaatggcgccgccatggtgagcgaagccgacgaggcgaggtggactgaaaagctgaatcgacgcgcgtagcgtccatgccatggcaccggcaccggcacctgccgtctccctcacccacacgttcagcacgaggtcatcagtagatgcgaatcctagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaaggagaatctcggtcaccatatcttcattgagcacatcgacgagtccgcagcggctgcttgaggccgtggtgttgatgatggcgtcgccggcggagctcaagttgaggccgtcacttgggagctcatcatgagcattgccgaccggagagaggtcgacgatgtccttgtcgccaccgccggccacggcgtctgacccgaacctccacccgccgaacaagctggggctctcaatccacggaatccacgacggcggcggctcgtatggcgtcgccttgccggtgaggccatcgtgatcgaggacgccgtggccgttggggaaggggacgatgtagctgccgcctaaaacactagatcaccggcatacctagcgtttaagatttgtaaacaaagataataggagccgaagtcaatcccttaaaacactcctccccgaacctcctcctgtatctactattggttgactgaaaataaaccaaaagcaagggtggttgcacatcttctgaaaagaaaagggctcggtatcgagtcatctactaaaaaggaccctccccgctgtgcgcccctccttgaattattcggtcatgcaatactttttttaatacaaagaacaaaatgcatttcgacctggagccggcctcctcctgatcctggacgaggcggccaccgatcccgctgctctcggcgagggaggtggaggtcgtcgtcgtccccgccgccgccagcaccagcgccgcgccgggaccggtggtcatcatgttgccgacaatggcggtgcccccgctgtcggagtcggcggtgtcgccgccgattaggccatcgatgggccgtggctcgaacggggtggggaggtggcgggggccgttgggatcagccatcgtcgcgaggcgtgatttgaaaggggcgaggcgtggtttggtggtgggggagagaaggtctcagagagagcaaggggcccgtcttaaatagacgggaggtaacttgctcggtaagccagcctccaccgccgttgctggctgccgtgctcggcctcggcgatgagaagcttgaagctttttctcgccgatgccaacggccatgtggcgattaaacaggaaggtgactcgccgagtgctcttctcggtttattgggccagaggcttttcggcccaacagaagtgtggaccttttgtacttgtgaaaaagtttaccctttgatccttatcccttaaccgtaaaaccatgcaggttttaaggacgattttcgctgacatggcatccatgcagcaatctaattatcagataattaagaaaatagagtggacctgtttgtaagtgactcccctcttctctcatctatcctctccaatccgcattcttctcgacgtcctgtaggtcctacgctggcgtcagccatcttgcgatgcgccacccacgtgtccttgtcgaagtttaagataatcgagcacactatcacagaagaggaattgaacacacagtagaaatctactctagcaattaaacgtgtaatcaaaatctgctcctgcaaccgaacgtgcagtcgaaacctgctcctgcaatcgaacacggcaagagggcgatcatggacttcattgctgtcaagaataggagggagagaggccccatgggaggatggatagagggaggaagaaagagtgagagtgtggatgacacacatgtttcaggccactgacatgtgggcaccacataatattccttgatgacatagcatttttaaccatgtcaacgtaccacgtcaccaataccactatcaatactatcttatgaatcattttgtaccggttttaatagttgaggtattcgttatatccggttttatggttgagggatatgaattagattgacctataatttaagggagccaaattggaatttttagttttactctcaacaaaatgagacccacaattagattaccggaaataaaagggccagctatcaaaaacttcaaagcaattacaaatcgggcgcccgatttgtttctcaaaaattgggcgttgtttcatttaggggtgaaaacggagcggattcggacgataatggtcataccatatcctaaaccatatattttaagcgggtgcggatagtgtacggatgcggatacggagcagattgtttcggatgtcgaaaatggtgcggaatcagttcggtaacggattaaatttatcggatgttacgtgtgtacgcaatcgatacaacatcgagttagcaatgcaaggaacaataatacaataatcaataaacgacccatcgtaataattatgtgcttaagtgttaatcaacatgaatatatgatgcccataatataaaagtacagctacgacagtgtgacatgagacagtgaaagcctcagactaagaaatctaggttaactgatgaattaggcaattggatgaaccaacttatgtaagatgcaatagatagagtggttacatgtgttgataatttcggattatctggcaaacagcctatcggataatctgatagaaatgtcggataatccgtattcgctggattttagagataccatatcctcatccgtatccgcattgtactatccgcatccgcatccatatccgccatatttctaaagcacataccatatcctcatttcggacggattcggagcggaacgaatcgatccgttttcacccctagttccactagtcgaataaaaatgtttcacctattagatcgaaaatgtttcaatcccttaaaatgttgaaacacatttgaaataagactgaatcattttggtgcaacatatgaaacatcgaatatccccctactgaaacaccaacaaataaatatcaaccaaggacaaagatatgaaacaccatcaaaatcccatcgcaacatttcaatccaatacaaaagaacatcaaattacaatatataaacaacagtttcaaatatattgaaacatgaaacacatctgagtatatcaaaaaaataatgaaacaccatcgaaaaacccattgcatcatttcaatctggctaatgaaacataatggtgcatgggctgaaacatcaaaaaattcaagagaaaaacctagatctatctcttcctccgctctagtggttagctaccacatgaactgggatgctgtcacgcccagaaatttagctcaaatttccagactattttatgtattaaatccctgtccaggatcaggcagggtacataaaacgacaagtaatatacagttccaaatgcaaataaaagcgtaaatacttacagaagagacacttaatcctcacaccgaaacgaaagcaacagcagcggaaaaaggcgatcctagcggggcttcagctccactccataggcaaaactcaattggggtctgagccttggtcttctaacttcgtcttcagctcagaagcactacacttctgaaaagggggaataatagcaaggctgagtacaaccaccgtactcagcaagccacaccaacgatgcagacgtgcaagaggaacacaaggacggtttgtggctattgcataaaggcggttgtaaaacattttattgagcaaaacagtaaaattgttgagtaattaaagtaacattaaatctcaactgatcaacgctacaccacgttgaacaggcccaatgtggacccccgtttttataacaggaatcaatcgtgtaacagtaccatttccctggatcaagtagtctggtacatacgagttcatagctgaaataccaaatacacatacacgagagtctagtgcgaattattacatcataagcccgcaggcatagtcttagatcatcggactgagcggtccggaatacattccaaaagcagaagtagataaggcagcggagttaaggcagcggcacgccattgccacaggcaacgaccgtaactaagacctactgagcgccatcgtcttcatcaccctcctggtaatagtcatagggatcctccgaagcttcatctccggcctctgattaagtttatatattgcaagggtgagtaccaaccgtactcagcaagccaccacagcaacaatgcacatgataggggtattcaaaggatggctatggttcttttgcgcaaagtaagttttgtaattcttttcacaagcctaagacctagcatagactaatcaaattttagtaccagtgttcacattaaacaacgacggttctatccaccatccattgtgatcccaagaatagcttctggccattgagtcgtcatggtttttctgaggacgtccatcttccctcctctcaggaaatggctccatcagtatagaaatcatcatgcactatcccatcccacacatgttaagaatttagagtctagccaagtgtaatacatgtcccggtgctcaataaccgcgagcacggctattcgaatagatttggtttactcacactacagtggatgtacactttacccgcactccgcaactgcccaacacatgagcctcgtcccaacacatgagacgtgtcacggcaaagctttttgataacctcgcattggcagtacccgctccatgaactttacatcctcatgcactctaggcgtacacggtttctagcagtgagaggagttctggcgcacccgggaaggaaagactcacacatgcattaagttataagtatgtttagattctcacatggcagtcctgccgatggcgacaccactgtagacacccgcctcgcggtcctaccaatggctgctccaccgtagagcccctgcctcacacatcaagaaaccattatgcatggatactgcctccgctcagctatctactccgctaggtctatacccatacgagaagtgcggttgtacggggatcgtttcatgcttaacttcatggctcggtccttaattaaccggggacggcactagccttttccggacaccacccaaatcctccgtccgctccagtcgaaaacagttgtttaatttttatttctcctttcataaatcatgtcatcaacatcatggcaatgtggcgctcatgtctccacatgccgcatctcaattaccttcccaaaggtaattgcccaagcatatagcatttgataaatatgagtatgcatgattctaaaatagcatttctaagcaattgtcataattgactagggactcatacgtaaacatggttacgaaggcataagggtaaacaataatcaaggcatggcataatcacaagtaggatgttcataattgcatgcaattttatttgtaaacaaaataatttcgcaattgggatcgacatgttcaaggaatagtgatgacttgccttgctcgtagtcctgcgggtcttgatccttgctcggatccgcaaccccctcgggctctaaaattacgtgcgaagaaatgatttgaattcaattagaattcaaataaaatccaataaactcaaataaaagtcgaacgcgaatcgatctgcctatatcgactacaaagtttgcgaaaccacgttattccaattttagtgtcattcaacctaagttatttcgtgatttagaagtacactcctgaggattcaacataattatttagctcttaataaatctaaactcctaccgcgaattgattacttatagagattaccaaaaataatctataattatattaagttttgcaattctacgactataattaatctataattaaattctaattattctaaattttctaaacctccttattctctctctaattttctatttatttttccttttctttttctctctgttttttttctcttctttctttctttcttcttttctttttcctctccttttttttctttctcttcctcccggcttctttcttcctccctctctcggcttctcctcacctctctctctctcggctcacggcctacccgggcggcgacggcgaccggacgcgaggggagggcggcggcttaccgacggcggcggcggcgacggcgccgcaaggcgtggtgtcgcccggcgcggcacacggcgcggtgcggcggtaccgagggcgtcgacgcggcggcacaaaggcggcggcgcagtggagagggtagagaggaggaggagggaatggagtggggagaataggggaggtggggtttttatagggagagagggaagagggggccggttaatggcgacgcgacagcggcgcacagagctcggaacgacggcgacgcgcggcgacgcgacggcgcggggcgcaaggcggcgaggggacgggcgcgcggcgacgggacgggcgacgcgacgacggaacagggctcgaggcgacggcggcacgcgcggcgcggcagcgggatggtgacggcgacggcgcagcagcggcggctcggcgacgcgacggcggacggcgcggtgtggggcgcaaggcgcgagcgcgtggcacgaggcggcgacgggacgatggcgacggcgacggcgtgcggcaacgcgcgacaggcaagaggcgcggcgcggggcgcgaggcggccagccgcgcgcggcagaggagggggcaaggctagggaatcccatcgagcacctagagtgcaatgaatagtgtattttcctatttatccctattttagcctatttcctatataaattttattctataaatcctaatttttgcataaatgaagtgtactcaatatttgtgttattctaaccaatagatacaccctagattaatattacccatattataattttatataatttatttgaatctttaattagggctaactcttattccaacgcacttaaatttaaatttaattgatactaatatggtcgcgataatatttttatttatttctatcctcacctaatctttattttaaattgtattccaactatttatttagccaaattaattttagggtttattcctaattagttactctttattcgcgattaatgaactccgaaatcaaaatccaatgaaataggcaataaaatcggcatgatgcaatttatttaaaaagtttttgaaaatccgtatttttagagttttgattttgttggtcgaattttcagggtgttacacccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacatgtttccgtgcgctgacatgccaccacgacataccggaaagaggccgtgaaaggacccttcgcataaccccctctaaccaagcacaccacacctcaggtttaacccccactcctcgcaaggcagcgggcagtcccctctcgtgcctaggtgaatccggaagccgcataggccatcgcagggcccatccaaactccatcacgcccacccttgcctagatgcgtaagctagaggaaagctacactacaagcccagccgttgcccacgctggcttgtggtaagcacgataaattcttccagggtttcccacgaaccggtccttaattgccatgggcacgactagcaaaaccatgcacccacagcccaccatgtagtcgcattttagttggataattacgaccatgaagcatggccagatgtctcgagcacgcagctcattctgatactaaaaagggtctaatactgtaattatcccatcaactgagctagtggtaattaagcatggctaagcatatagttttagctaggtcacataagtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatatgatagctttcataggtcgtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatctgatagctttcataggtcatagactgccctcacagaccaacacatgtcttttctgcacactttgtcctcactcgtgtgcacccgggaagaataattcttcccggtcggtcacccatcccaaattgcaccaggccaagcacgcttaaccctggagttctttggagattggcttccggaaaagaagttgcaacttgttgatataagtattctattaatcctattaagccctaggccgggatgttacaccctcacccccttaagagagatcgacgcccccgtcgatcaaccctaggccaggaacgtcctctcttggccacgtccatgtgtccaactgcgacacacgcgcccgtgaaaccgcgagagtcggctctgataccattttgtaacgtcccgccttcccccaggccgggcccgcttacatctgatagctttcataggtcatagactgccctcacaggccaacacatgtcttttctacacactttgtcctcactcgtgtgcacccgagaagaatttcccggtcggtcacccatcccaaattgctccaggccaagcacgcttaaccctgaagttctttggagattggcttccggaaaagaagttgcaacttgttgatataagtattctattaatcctattaagccctaggccgggatgttacagtgacttgccttgcttcttcacaacaaccttccgaactctgatcctcatgaaagcgatcttccgaaacgacgagagctacacgctcgcacgtaaaacgagaaaaaactctaataaaaaccaataaaacagtacattaaaagtaaacaaacatgtagagcttaattttatatgaattttgcaagttgagtggcccaattcagagttcgaatgaattagatatgaattttagaagttttgagccatttaaatgaatttctagaattattatttatttattgcgcaattataaattattttctcagaggaaaagggggatgctgacgtcatcaaaggggccggcgctgacaggcgggccccatgcgtcagcgggccaaggggagggtgcacggtggaccacgtccaccgcggcctcgggcgcgccgtggaccaggaccacgccggcccacgggcggccacagggcaaggcgggcgcggccgagaccggccggccgagcggcgacggcggcctagccggatggccaccggcggcggcggcgcaacgcgggcgaccagcgaaggggagatagagggagagggagggatgctcaccaagctcgcgcaacggcgaggagacaacgggaacgcggcggcgatggactcctcggggaggcacggcaacggcgggactccggcgacgtccggcgaaggaggagcggctggggcacaacacagtctgggagagaggatagaggggttaggaagggaggaggaggcgcggtaccgaggggaattgcggccggaggcggcaatggcggaggtggctcgggtacgtggtgaaggggtggtttcggtggtggcgaggagaaaggaagcggtggccgggcttgggattgctgcggtgaagccggtggtgacggtgacacagtgcggcggcggttccagccacggggaacgacggccggagctcgcaaaggcgatggcggctcgggttgacagaggggagggcggctcggtgggggattggaggaacgaggcggtggccggtgctcggcttggagcggtgaagccgatggcgcaagcggagcgccgcggcgacggccagggctccggtggcgcgcagccggagtcggtggaggcggtggagagaggtggtgcgcgtggcggcggtgcttcggagacggggaggggaaatggagcggatgccggggtgcggtggggcgctgcgatgctataggtggcagcggcgcagtgcgggggcgacggaagcggcgacggcgcgcggctggagggtcgccggcgtgcggcggcgcacgggaacggcgtggggagctcgagagagcacgcgggagggggcgatgagttggggaaacggatgaggggaggccggggtgcatttttataggccccggagagggagatcgtggccgaggtgggcggcaaccgccggcggagggagctccggcgacgtgggcgagtgaggctcgaacggcgccgatttttggggaaaataggggagaacgtggaggaaggggaggacgtggggtggaccacgtccacacgcgcgcgggagcggggagacgcgcggaggaggcggcgtcgtggggcggctcgggcgtccatggcggcggttggagccggaggaaggggatgggcctgacgggtggggccgtgggtcccacctatcagccaaaggaagagaggggaagccgggtgggggttttctggactttgggggagaggggagccgagctggccgagcggcccaaagaggagaggggagggaggcggcccggccggaggggaaaggaggaaggaggggaatgggccgaaagcggcccaaagggagaagagggaattttatttgcttttctttttaattaattgattacatgatctttgtgctattaaaattattttttgagctccgaaaattcatgcgaaaatttcggagaatatttagggcacaaagagtattgcaaaatattctcggccaatgatttttaaaggaaaaattttaaattctcccattatttcacttgattgaattgacttaacttttatttaatttctaaaaaatatattatttaatgatttttaatcccgaaagaaaatcggggcgttacagatgccgctgtggatgaggaggtggcaccgacgtaccctagaatcactaccacgtgctcatgtggcaaatctgcaccgtggtcgtcgatgcagaccaagctcagccacaaccgcgtggctgccgttgtcgatgccgtgccgagctcggccatgtcagccacaactgcgccgccgccatcgtcaacgccgcgaagctcggccgcgtccatagaagagggagcgagagaagcgaggaagagggagagcgagataagaaacgagtggctgagaatgaggagcgcccgatatttttatttttatcgggcactcaggtaggaactttttcccataaacctgttttgggctgaaagcccatatgtgttttgcaggaaaaatagtactctattttctgggggaaaaagtacaccgaaggtccctcaacttgtcatcgagttacaaaatcgtcccgcaaaaccagttatccagcgtccctcatctatcaaaaccggttacaataggtccttcggtgtgtttgaccccggttttgacttacgtgacggctgagtcagcgtgggacctacgtgggccccacatgtcatgctgccacatcaccctcctctctctctcttttcccctcttatctcccttcctcatctctctctctcccttctctgacagccgccggtgggaggatgagggtgtcggcggccggcgaggggcgacgcggcggcagtgatgacggcgacgagcgacgcggcggcgatgggggagaaactgcaagtgggcggcgaggaggagcggcgcgcgggcggcgaggatcagcgcgcgggctcccccgccagccgccgcccaccgcccacgaggcccacgaggcagaggaggaggcggcgagcggcacggcggcgacgacacggcaaattacagaggatatcaccaaggtccatataaacaagataatcaccaggcaaattactgctgctgctgctacttcaccatttgtgcatttcctcttctactatcttagctgcagctcgcacgctttgagtacgtgcattgttcaactgccatttctctcctcaattcaaaaaaaatatattcacctttttctcattcgagctaaaccatttcgatcaatggaattcggacgatctccagcccttctactcctcgttggtaagtccgagaaactttcaggccggttaactttaggctgttagcacacatcttcttcattcttcaacaatggcgtgtctcaatgcagggttcctatggtcacagctgcagttcggcgctgaggcagccggcacgacggtcttcacgctgtgcaacaactgcacctacaccgtctggccgaccaccttgtccggaaacacagcggtcgggggccatcgggggcggcgacttcaagctatcgcccggcgccaacgtctcattcccagccccggatggttggtccgaccgcttatgggcgcgcacggactgtgcaccctccggcaccgcgtcccttgcctgcgccacggggtacttcggcggcgccgtgagctgctccctcggcggcgcgccgcccgtcaccctcgccgagttcacgctgggcggcgccgacgggaaggacttctacgacgtgagcctcgtgggcggcggccgacgggggagtccgcgcgccgctcctccccccgccgcacgcgctctgctcctcgccgcccctccccgccgcccacccgcagcttctccccccaccgctgccgcgtcgcccctcgccggccgccaacgccctcctcctcccgccggctgagtcagagaagggagagagagatgaggagagagacaagagtggaaaagagagggagagaggaggctgatgtggcagcttgacatgtggggcccacgtgggtcccacgctgactcagctaccatctaggacaaaaccagggtcaaaactaccaaaagacctattgtagttttaatagttgagggaccttcagtgtactttttccattttctgggtcactcagcgagaatgaaagcccacctaattggtcaggctggtctctttcctttcatccgatcagtcacgcggcgttgccaacttgccgtccacgagagcaagcaaagcaacttcaaagcttctcgccgcggcagccacggccgccggagtccggacgctgtcgtgcggagcacgccaccctcatctctctctctctctctctctctctctctctctctctctctctctcactgacacctccatccccaccacggccccagttcaattcaaatcacaccgcctcgcccccctccaccgacatggccgatcccaacggccaccaccgctgcctcctcgccggtgccccagggtcgcctcaacttggcctccgccccgcctcgtcggtctccactgcgacgagcgcgtcgtccgctacgacgaccgccgccgccgacttcgctcccagcagccgcgacattcccttgctccccatcggccagtttcctcaggaccacgtcaacttgggctccgcctccgccgccggcgacgccatgatcaactccgccggcgctcccgctggagctcaccagtacatgaccaacccatacgccggcgacgccatgatcaactcctccgcgctcgctggtgctcacccgcacatggtcaacccaccaccgtacgccggcgcttcttcctcgcgactccccactgcttccgccgagtggaacatggattggctgcacgacgcgatggcagaacagcagcagccaccgcccccgccgcagtggcaggagcagagtgtcttctccccccccaccgcctacagcttcatcccctctccatcactccatctggttcacgctccatacccatcttcgccccctccaccttttccacgatccccaccatccgacgggagttcatgccggtgccgtgtcaagttccagccccacacgcgccgccattccccgcaacctatcagtatcccggcgctcttcccgccgccaccacccacaccatgagggactcctcgccgatcggaacatggataccggcatcaatgggagatcgcaagacgatgatgtgcgtgaaattcaatccgcacgggtggtgcaacgaaggggatgggtgtcaattcgctcaccacgaggacgagcaacgaattgtgccggggaggaggggcagccgctggtggcatcggtgcaataagttcgcgaccagaaaatggtgcaagtacgggcgcaactgcaggtattcccatggccatgggcgccatggcggcgtataggccggaggagcagcgccatgggaggatgagtccttcgtcttagcagcagcagttaccacgcgcgcggaggaaacacgtcaggttagagtctggatcatatggctgaatccatccgaatcatttggttcaaatgcttgcttctgttgtggaccttgtggtcagatgaaccactgcgtttttttttttctgtttgtgatttgatttgagtcctgaatccatccgaatctgagttcgacgaagcacaagtgctgtttgtttctgttttggtcagatgggacatggattttctacacctaggtgccatggcatctatcatttgcatgtaactcaaatagttatagaaaaaattaaaaaaatttagtaacatcgtttgtgatgatacaagtctatacacaaacatacatgactaaatttgatctacaactagagaaacaaaaataataaaatcagacagtgaatagtacgtacagtgcagataaaatttgttatttttgtttcttcatatatcgatcgaatttagacttgcatgtttgcatagtgtcttatattattatggactatcttataaaattttataaaatttttatataaatgtttgggtgtagaaaatactttctgtggtcagatgaaccaatgtgtttttgttgtcacttgtcagggtctagtcttagtctaggggaagaagacttgattagaacccatgcatttgatttgattctgagtcctaataaacttgatgcctcgatgatatcgttgattgttctggtatctggtttcgatctggggttattacaacattgcttgcttccttgctctggatttgggaatgtggtgtgtactatgtcgctgtttggcttgctctggaagtctggattcggtttggtaacgttgatgcattgagatattgttatgatatctggattcgattggggagaatgtatattggttcattgctcgcttcggaacgtacatatacatgccgctgccttctgcgctgtacgacgcggccagttcatgatctcgacgaggagcacgactaagttattggtcggtcagaactatgggtcatctgcttttcttagtttggggcatttagattttgattcattttgatcaagcctgcattgtccttgtgttttgggttgctgtagcctgtaaactgatgagagacagacatgtagctgaccttgttctgttgtagactgtcatttctattaatggaaatggagggctatgcctttgcttaaaaaaaagagtagctatattcatggtattatattttcagaattgctaaagctctgtcgacagaaaatcctacctcaaatcttgcaaattttggatcattggacgtgcttcacgattcgtgctcttcttctccaactccggcgaccacctcttcttctccggcgccggcgaacccaaactccagtagagggccgacgaattagggtcccggggtgaggtgggggtgtggggggaggggga

SEQ ID NO: 81975 - DNA, 6385 bp, Oryza sativa
  unsure (1)..(6385): unsure at all n locations
gggggccggccgggggggcctcgccggcgcctttgacaccattcggccagctggcgaggccgggcggcggcgcgctagggcggcggcggctgtggtggaggcgctgaggagcggcggcgcgtgaggaatcgggagagagaggagaaaggatttttagggtttggttgcctgcacgaatcttaaagcaatcgggtggtctaaaatttacaagatttgtgagagggttttctgtcaaatgatctatagacattcccttatattttttaccaaaaaatagtcagcatgtatttacattgtaagtctgtaaattacatatgtaattttagtatgtttataatgtaaataccaaaaattacatatgtaggttcaaaattatatgtgtaattagtatataattacagtgtaagtataatgtaatcatggtgtaactaacatgtatactaattacccatactcaaatttgtttatacgtactcctatatctttctactatattaaggccctgtttgcatccggagggctattaaatagccctccgaaatcttactatttagaaatattaaacatagattatcgacaaaacccatttcataactcctaggctattttgcgagacgaatctaacgagatatattaatccatgatttgttacagtgatgctacagtaatcatccgctaatcatggattaatatacatcattagatttgtctcgtaaaatagcctagaggttatgaaataggttttgtcggtaatctacgtttaatactcctaaatagcaatatttcggagagctatttaatagcccgaatatccaaacaaggcctaaataggtggttcctgtttacgctaatcaccgacagcctacgcgcgtaatactgctgcacgaatctcaatggagcatcaatggtagaaaatctgactgaggttgtgttcagttcagtgcaaagtttggattttaattgaaattgaagatgatgtgactgaaaagttgtatgtgtatgacatgttgatatgatggaaaaggactgaagtttagatctaaattttgaatctaaacacagcctgagattaggaacaaaatatggcacaacaagtttagcaaattcgaaaaaaaaaatgtagctgactttgctgaaattatgcacgagtagttaaatactgtgcataatttcagagtttatggttaagtagaaactgaagaatggctcatggttcttcaccgtcagagcttttcattgcttaattctccatttaattaccacggccgccggcgccatggtaccgcagacgccgtcgacatgagatgcgggctcactggaggcacacgacattggctagattgacttggacaccgagacgtgtgtcgtgtcgtgtcagcgcgcgcggtacgtacgcccgttcactcaacgggcgtgcgtaggcgtagcgccattctttgcaaggaaaaagtacaccaaaggttcctcaacttgtcatcggaaaaagtacaccaaatattctcgaacaacaaaaccaaaatatgatgtcccttaactatataaaaccggtctcccgagatccttcggtggttttaactccggttttattctacgtgacggctgagtcagcataggacccacatgtcaggtgtccacgtcagcctcctttccctctttcccctcttctctcccttcctcatctctctctctctccctcccttcgtcatcttcgtcaatgtcgcggcgaacccgcggctcggcgaggccgtgctccgacaggtcggcacgtcgactgcgatggtggatcggctggtggagatgctcacctggaacggcaccgtactctgaactggcgccagcccatacccctcagcttcatgccccctgagcaccacatcgacgtcgctcttctcgccgccgtcaccaagatggtacacatgcacctcatccacacaggtcttggtagccaccgtgtacggcctctgcggcatgcagcgggcgtggttgacctcgccattgtgcggcaccgagcgggagatggacacaagcggggtcgggacggcgccgctcgccgccgaggctgccgccgccaggcagggtggaagcgggagggtggcgtcggcgagcaggaggtggttggcacgtctcgtcggaggtgtgggttccgaggatgaggcggtaggagagggtggagtccggtgaccgggagtgggaggggagccactggacggtgagcgatggccactcgagcggctgggagatgacgaggtcatagagcaccagcgcgttcttcttccagttttggtgctcctccatctcctccgcggacgacctcgtcgccgggggtggcggtgacgttgaggaggttgaagatagagacggcggaggcgtagagcggtggggaggagcggaacacgaggtaggcatcgcagggccccgcagtggcggcagaggtgacttcgtactcctgctgcgcccaaggcagctgctgatggccctcgcccgcgccacgccgcgatggcaaggaggacgaggaggaggtgacctcgtactcctgctgcacctgcgctgcgatggtgaggaggacgaggaggagcatggcgccgccatctcggattcgccgtagtgtctccgccatcggcgaggtcagcggccgccgccaccacttagcctcgccgccagctgcctccccgctggccgctgtctagccactgacatcgtttttgccgcgccgccatcgacaagatttaacgcgagagcttcgcatgacgcctgccgtttcggcccatttgagccaatgctatttcgggcgggcggcggtgccgccggccgccggacctcctctccccttcccccggtggcctccttcccacagcgctgcctgttgccggcctgagaaaagtgaaagagagagaaatggagaagagggggaaataagagaggggttatgaagtggcatcctgacatgtggggctcaggtgggtcccacgctgactcagctgtcacatagaccaaaaccagggtcaaaaccgccgaaggacctcgggtgaccggttatgtatagttaagggaccccgtatatctggttttgcggttcgaggacgattttgtatcccaatgacaagttgagggaccttcggtgtactttttccttcctgcaaacaacgcagcctcaatcgacttcggctacaaatattgggatcacgcgggaaggcccattatactcttcccagcccatgagcttttatcgggcccaacaccgcatcctacctagggttatcagaagggcgccgcatataagaccgaggtcccaagctcgcgccgccgccgccgaaccgagccgcttcttctccagaccttggagctcgccgtcagggagggagaggaaggacagaggtgagcggcgcgccgccgcgatgagggccaaggtgagtgactcctcctcctcaactctcacgttggatggatcttgttttgattttgtgggtgttctcttatttgtgtatgtatgtatggttctcgctggttagcaaacaagtttactactagtaaaatcttatccgttccgttgtggacatggggtcaatcgaagcatttatctgagaggattaccgtgttaaaatgttgtttgattgagtgattgtataccttttttttttccggattggtttggcatgatgaggaaatcaatcgtttctaactgatccactggatgagaaattcctcctactcattctgaatgctaaaattttctttcataattccgtgatttgtgtccagttttgcggtcattttgattaagcacgccttgccttatgtgagatgctgcgaaaaaaaaactgtctctgttatgccctgatggcctgatctaagatatgagcagccagagttttctgtgtaccgactgcattttgggggatttcgtgtttccttgcaagtttttgcttctgtttagctaaaattctttgctctggtacgcagtggaagaagaagaggatgaggcggctcaagaggaagcgccgaaagatgaggcagagatccaagtaatcccataggcgatcgactgatggaggaggagaaagcgtctttggctctcactgctgtcatctcatctatttaagttgtttagtttcctttagtaagagagaaaaaaaactaatcaatgtacttctcttgatctttgtcatgggagtaattgattgtactggacagcaatgtttccataattctattacctggagttatctgtcagcaattctcattgtgtctcttctctgtaagagaagctgttcatctgcgattgtgattgtggagatctgaatttttttgcttctttccagtaatccagtgacagtttgcgtcttgattattttgcattctgtcggagtctctaagatagcttgtttttgtcattttgaattggtattcagtttcggataccattcagagattgcgaaaaatgcattcagatagcttgtctttgcggttgcgaatcggtattcagtctctagatagtttgcagctttacacttttctacacacgtaaactttaaacttttgaactaaacacaacttcaaacttttgaactaaacacagcctcagatggcttgtagattgcggttgtgaattggcattctgtttcaggcagcgctcgcagtgggagtaatctcgattttggcattctgctggttgttctattgcatttctagtgctctgtccactgtatatgatgttacctgtttgcagtatattgaaatctgcaagcaagtggatattattcacaaattctcactcactcaaaacaaattccctgaacctcctgaaatctggagtggacattaatatttcgaattacttgttgcagcgtggattcgccagcttatcaaatgaacacagattttatacactggtgtaattagtttaattgattacagcgctgcctcagattttgcacgcacagatcaccagttcactactccctccgtcccacaatataagggattttgagtttttgcttgtaacgtttgaccactcgtcttatttacttttttttaaatataaaaaacaaaaagttgtgcttaaagtattatatataataaagtaagtcacaaataaaataaataataatttcaaaattttttgaataagacaagtggtcaaacattgcaaacgaaaactcataatctcttatattaggggatggagggagtacttcagttcatcatctagaaaaagcacctcggtagcttgtacgtcaacgacacaggaaggcgtattccatgttcccgtcaacgagatcatcaagacgaggaaaattggaaaagaatccctctcctcctcctcgtaaccgacacgcccccgaaatcttgcgccgtttcgatgggggaagcngaggcttcctcctcctcttcctcgcggaagatttcaaatccctcctccacttctccaacgccttcgccaactggaaaccccgaattccccgccgcctccccacccgcgccgcaaacccctaaaccctagccgccacctccacggcggcggccgccgtagccatggatttctactccgacgactccgacccggacatcgacgaggacctgcagagggacctggacgcgctgcgccaatcctgcatcctctccgggaacgaccccgacgcggcggtcgcgcaggtctccgcctgcctcgccgccccgccggcggcggcggcgggagcggaggtgaatggcttgtctgatgacgacgacgaggaggaggacgaggatttggccctcgtccgcagcatacgtgagaatctcctcctcaacaaggcctcgccgtcctcgcccctgccgcgcccgatctgcgcctggccgccctccgactcggaggacgacgaggacgacctcgagacgctccgcgcgatacagcgccggttctcgcactaccactccggtgagttgattcgctctccctttgtttgttcgcggcatatgctctaagataggttccatgtggtgtgctaatcgatttatacattaggacaggaataggatgattttgtatgatacgacctgggaatccgaataactgggataaacttgcaaggtacttgactctttgatcaaaacataaattacccaattcaactcgtcttctataaaatatgctcttgcatcggtatataatgtttttatgggttctctagggtttatacttccttaattgttgtagctgtagaagaaatttaagctatgtaacacacttgctacatatggtgttatcttcatcagaccttacttctaaaacatggaatagaatctgtgcaaactatatttgttccttagagccaccaatataatatatataattgaagaaataatatgatgtaactaagtctctgacgtatagatatatagtaagtaa

SEQ ID NO: 81976 - DNA, 23523 bp, Oryza sativa
ctcattcagtccccccgtggatcatactgcttaatgcatgccaagtcttatcatgcatgcatattcttttgggcatactctcatccccgcttcaaaataaaactcaacatgcctgggcaagtctttagccagattatagatcacgtcctatgtttagattagattattttggaacggagaagtagcgcccaacctacctatataattactctgtttcaaaacaaacaaacaaaattagtacgaaacatgcatggcgatatatattgtatatatactaaaattttaagttgagttgagatggtttcttgctaaatggaagctaaaattttgatattggccggttatgtgcctattagaatgtgttacttctccttctcgtaacaattccaattgtgatattcttatacgtacgctatatatatttacaatgaagctactatattcaaccttgtattttttccacccaaaataaacaaacataatatatatggaatgtgacattgttcactaggatgtgtcattcgtttatttattttgagatagagggagtattatcctgctataatgtttggaagtgcatggtggagtcagctctccggccggactgtgcataagtcaccacccgggcgggctcgatgctatatattgtgcccactctccaaagacgccgaaaacaaaacgtgagtagatattgtcccactctcccactgttcgggctccatgcatgccaggcattcatcttggatccaccacttctatttacctgaccatgcacaagcttataattaattgtgctgacaatgtgcttcaggtgacgtaattgactaatacgaaaaattcagacgacttataaatagcgaaatttaattagctatatgcatgtgttaagttggcgcaaaaacgagcttgcgcgtaacaagcacgacgaccatacttagttgaaagagagtacaagcttaattaggaagatagtgcaaattaagagacacacaaacatgccatatatatatgtacaagtgatgaaattgagtttcagccccttacatcggggcaattgcttagggtgttctcaactacacattttaatttctactccttcgtttttctcgctcacgctttctaaattgttaaacaatatgattttttttcaaaaaaaagtaaaatttttattttcaaaaataatatttatccattttaagttttttggcttatatttaattaatcatgtgttaatatgtcattctattttatcagatgaaaggttcctaaacccctaaggccttgttcggttaattcttttgtatgaaattattttccctcaaatcccttccaacctctttcaactggaggattaaccgaacaaggcctaagtgaacaacgcctaatatttatacaaccaagtgtaattaattgcagtgtacaatatagacctctgagtatagtaagagatttactctatttatatatgatgtacactgccgtgtaggctcatgtcaaggtggtcttatactattgcacatgccttgactgggtgtccatattttcgcagcgttaggatgcaacccacttgtaaaaagagggaggtgggggggggggcacaacttggacatgacgatcggtaatagaggctcaatgatctgatagtgatcgatggtagtggctttcactgtgataggcagacataatcgatggtagtaggctcacttataaatggatttgtgggttagccactctatatccctaaacgactaaacatggagtcgttgtcccagtatagtggctcatgttcttggttatgtggcattagttaatgatcttaccggacgagcgtggaaagtgataatatggcttagagaggtttgagctaaaggcgcccccatccctaccgatgaggcaggctgatcaagggcatgaagtaaaagacgaagtgtagctccgtcacccttctataaggatcctggaatggagggttgggtcactaaagatctttccctccatgttgctctaacggaagagactcaaacccctctgatgtgaatttgggggttccgattcatttaggagttagcctccatattcatgtggtatatcttaacatcttttcttttgggtggccttgcatgttttggttcttctatcaggaatacactatgactctctttagggaattaagattttgttaaacatttggttggtagccaacttccgagaatttagaaaagttaagtctttcgatttctagcttctagttttattttaagattttatagctataaattcttagaatctggatgagaatctaaactgttaggaagcggagatttggaaaaagctatggctagaaactccttcaaacaagacctaaagctctgtccatcgaggtgatgccggagggagtttcctcttatcgcaaatcacacctttcaattccaaatcatgcctttgtacgatgggtaaagggcttaagaaaaaagccaaaaaatttattacataaataaatattgatagaaaatgtatactcttcccattgtactatttcacatattgtggtgtgtactcctatctttaattctcctgtgcaatgcactactaccacattttcaaggagtaatgtgatggaaaaattgaaaatttgaagaaaaaatttagaactaaacttggaatttagataaatacattttcaggtagcccctacctagctatagtactactcatatactagctcgtccaatgcactactaccaccttggttggctctattaaaggccaagcccactagacgcattctgtcacgtctctctagtgttactgcgtaacgtaggtggccgctgccggccatgtcgtcgtcgtccgctgccgcgctgggctccgacgacggctgctcgccggcggagctgcggccgagccggtacgagtcgcagaagcgccgggactggcagaccttcacgcagtacctcgccgcgcaccgcccgccgctcgagctccgccgctgcagcggcgcccacgtcctcgagttcctccgctacctcgaccgcttcggcaagacgcgcgtccacgagccgccgtgcccgtcgtacggcggccgctcgccgtccgccgccggcccggtcgccgccgccgccgccgcatgccagtgcccgctgagccaggagtggggcagcctcgacgcgctagtcaggcgcctccgcgccgcatacgacgagcgtcacgaccgagccggggagccagacagccgtagcgggcgccggcgcggtcgccaccgacagtacctcctcctcctccgccgccgccgccaaccccttcgccgcgcgcgccgtgaggctgtacctgcgcgacgtccgcgacgcgcaggccatggcgcgcggcatctcctatcacaagaagaagaagcgcaggggcggcaacatgaacggcgcccgcggcggcgccggcggcggcgcgcgcgcgggcgtgaacgacggcgatgcgacggcgccgccggtggcggtgaccccggggctacctctgccgccgctgccaccgtgcctcaacggtgtgccgttcgagtactgcgacttcgggagcgtcctcgggggagcacatggcgcccatggcggccatggcggcggcggcggcggcttctacggcgccggcgtctacttgccatttctgtacaacaccttcagttagttagctagctagctagttcgtcgtgtatttgtctgtgcttctcactgtggttgcttcagtgtactagctagctacatgtgtgatgtgtctgcatcttgtgatcatcttgatctgtgctttgatgctgatcgatccagcatatccgtacgtgttcgttccgttgcttcggatcttaattaactaatttaattgtgctaattaattttgttagttttggtgatggatgtcgattgcgttatgttcgtgcatgatctgattaataacatgcatgtgttacggtatttaaaccaggctgaaatcgctaaatgagggtgaacctcccaagaactaaggaatatgttgagaaatataaggtctataagcctcggacacaaatagaagatccacggttttgatttatttcacaaaatatcatattgtccaattcttcatcttattctgggtgtccggagagaagcaatatatttcccaactttttttaaaaaaacttttttctttgcactcttgcgaaaaaaaacttactacaaatgaatgaacatttaggtttcttactatacaaaattactgtgtaatggcaaagatggcatgaatctccttaattaaggcttttcccgctgtcccgctcccgtaggccgcaacaactctccggaagcgattttttagtttttttttctgaactttttaaatttttaattttaaaaataaacccttttaaaacttatttccactatctgaacaatttggctaaaacaatactagcattattttgtcacaccggtttgattggcgtgataacgttatttagtcacaccaccatagctgcatggctggattaaacatccacacccgctatttgtaacgcgtcagtattgttttgctacatggcaaaaaaaatttagattctgaaaataaactagttttgtaagggtctattattaaaattaaaaaatttaaaagttaaaaaaaatcgtcagaagcttccggcaaaaagaaccttctccttcgttttcgcaagtaaaatgggcctgtttctccatttacgccggcccaaaagcccattcgtattcagaaaacaaaaacatttgcggcgcgcgggcaccgaaatgctggtgcaggtgctccgccgcatcgcgcagagcggcagcgtcgtcgtcatgacccatgaccatccaccagcccagcggccgcatcctcaacatcctcgaccgcctcctcttcctctcccgcggccgcaccgtacgtctactccggcacgccgtcggggctcaagaccttcttctccgtcttcgccgcgcccgtcccggacaacgagaacccagccgagagttcgccctcgacaccatcggtgagctcgagcaccacagcacgacggcgccgccatgctcgtcgaattcaactccaagtggcaatcatcgctcggcgctttcctcatcgatgccgacgtacgcgaacccgccgtacgtggaggtgtgggtgctgatcaagagggcgttcaccaacacgaggcgaatgccggagctgttggtgatgcggctccgcacgatcacggtgacggggttcatcctggcaaccatcttctggcgcctcgatcgacgacacgcccaagggagtccaggagcggctgggcttcttatttcgccatggcgatgtcgacgacgttctacgtctgcgccgacgcgctgccggtgttcgtccaggagcgccacatccacatccgggatcgagacagcccacaacgcctaccgccgcctctcctacgtgatcgccaacaccgccgtcgcgttcccgccgctggtgtccctgtcgctggcgttcgcggcgaccacgttcttcgccgtcggtctctccggtggcggtgctgcttctcccgtggcgtcgagatgttcgacggcacgccgatcgtcgggttgtcgaaggccgtgaagatgtcggtgatggacgccaatcaggcgtacgctcggcaccactttgacggcggacacctgcgtggtgaccgcgccgacgtgctggcgcagcaggctgggatggatatcggcaggtggaagtgcctgctggtcaccgtggcgtttggtttctttttccgttttctgttttatattgtcctgctctttgggagcaaaaacaagaggcgctagctaaaccttcgggtgtgtgtatgtatgtaatatttcaattttgaagattttgtattcatatagctgaaaaccgtgttcaattataattatctgattagatttgatgacaaaaaactcaaggaaaggtttaaattcagacgtatgtagtgaacacgattttttatgtcctacaacaaattttacaacggtattaatacattgttctatcattttgtccacctattgttcaccagtatataaagacgaaaaaagatgtttatactgtagcaaatcccatagcaccggaccaataaatctcgcaactgatatgccgttttcataattattagtggagtcaggggcggatctatccattagaaagggtgagtcgatcgatccaattatacgacatgtgttgccctacacctctaaaacccccctatcctcttataatagtcatgaaaaattatgtataacaaggtctgaacgtctaacagatcaagtctattttttcacaatgcacgcaagccacagacaataattgagacaattatgcgattgaactataaatacgatatgtgttgtgttctattgctcttatcaagtaaacatctccgttctccaccccacgtatattttaaagctgcgtccgtcagtcctagagggctagaccgctagaccgcagcagtgtgcaggagacgttcacggtgcatccgacccggtggccgtagttcgatcgatcggttgcggtgcgccgccgcacacacgacacgagcggccgggcaagcgtgcgtacgtggcctgtgtcgtgggccccacgaaatcccacttcagccaggaatttgaatatctttgctctcatctgcgttgggcccaccaaatcccacttgctgggaggctgggaccactagtgtagttggttgggaccactgccagatcgtgtgccagatggattccgtgggacccactatgcattcaaaggtgcttggagaaccctacgatgacgtggcaggtcattccgactatataaaccccccgtgagagttcaagcagcccccgtttcttccacctctcctctccttctccccacctcgcttcgccctcctcttgctctttgcatccacacgccgacacgcgcgcgaggagatttttcatctcgccgatcggatcgagtcgagtagctagcggagagaggtgagcgtattttgatcgatcgcgctgtgtgtgttctggttttgattttggtcgatcaaaatggtggtggtgcttcgttttcgtgaatcgtgatcgatttttgaatgtgatccatggcgtgttttctgtgctgattttgcgtttgatgcgtgtggttttggtgctcgatctgtgtgtgtttgagcagcatggcggactcggaggatggagatcacgttgcgacgacgacgacggagcagcgctacgacgacgacgggcacctcgtccccagcagcggcggccaggaggaggagggatccggcggccgcgacgtcgtcgtccccggcggccacgtcgctgaggattaccgctctggcgttggcgtccccgtcggccgagacgcaggcggcgccacctcctccccgccgcagccagtccacgtcaccccgagcatcctcgtcggcagcatccacgcgccggtcttccagggcgagctcgtcggcatgaagttcggggtcgggtcaggctccatgggtgccggcaccagcgcgaccaggcgccttcccgcgaccggttttggtgctctgccgaccagcagcatggcggaggatagtgccgaccacgccgacgacgaccacctcgccgaggaggaggaggaggaggaggaggagcactactcgacgacgggcccctcgtccccagcagcggcggccaggaggaggagggatccggcggccgccacgtcttcgtccccggcggccacgatggtgaggaggaccaccccgacgacctcgtcgccgacctcgacctcgacctactcgtcgacggcgtagtcggccctgtccccggtggccacctcaacgcagatgcccccgccttcgtccccaccacccgtgggcgccaggacctctattccgccctctcctcatccgcccccgccgccggttaccggtaccgccactacatcacctcgtccgcgctcgcagaagccggccacgtgtccccattcctcggtctcccgtacgccacggccttcgattctccgctcgaccgcgagttggtcggcccgtcgtcagcgccgccgccgtgctccgccgctagccgtgcctggttagtgcgctgttcctcaccgctctccgactccgagtggactcggcgttcgatcctggcgcgagaggctgcacacacaccggcctccaccgtcactgggcgtgggcggttcgagttcgtgcccattcccggcgcaccctatgctccgccgccgtcattcgcccccatcgccgccggagctggaccagcagcgcgaccgctacagcagctggcattcggactggaggaacacaagacgaagctgtgcgcggaatattattcccgtgggcttggttgtcctcgtggcaacacatgcaagtacgcccatggagaagatgacctgcgtttggtggtggcggtgagctctctagccgacgccggtgagggctcctcgtcctcggtgagtttaattgatttcgtcttcaatatatatataactgattgattcgatctaccacgcaatacctagtcatcttgtcctcatgcatccagatttaatttactatacagagtcgatgcagatttcatttttggttttgaacttttgatcatatatgcattcgtttgcctttgcaggattcgtccttcgccgctttgggaggggaagacaagtacaagacgaagctatgcaagacgttcacgagtggtggattatgcctgtttgcagccaactgcaggttcgcgcatggggaggtggagcttgggaagaaggagccgtgctggtatttcttctccggtcagacctgcccccgcggtgacacctgtggtttccggcattcctactaggccattgtcttcgcatcgatcagttacatttatcccaccaatagcaaagcgcaaggaatgggagcagtagattgatcgattacctttgcgtgcacgagatacatagatagttctgatgcttgtttgttccatctcgttcagtgtatatccgatccctgtgtcgaacaacacatttacaaactgcatttctacctatcctagctacagcattgctcgggtaacaccatgaggttttcgtctacttagtacttgttaaatgtcttctttcttcaatgtaagaaagctttgtacatgcatgacttcattgagatactccctccgtattttaatgtatgacgccgttgacttttcgaccaacgtttgattattcgttttatttaaaatttgtgtgtaaatatgaaaatgtttatatcatgcttaaagaacatttgatgacgaatcaagtcataataaaataaatgataattacataaatttttgaataagacgaatggtcaaacgttggacaaaaagttaacggcgtcatacattaaaatatggagatagtatgttgcatgcctgcctaatcactgcatggaggttttgtctacctaattatccactgtctgcgcacctgacatgttaatttctgcttctggatatgcctagtacttttccccccaaacttactctgttttggatcacaactcaggggatgggtcaagcattgtactatttttgttctggaatgggaagttaaaagtttggtgcttaaattaaagccctagcttgctgtcatcctagagttgtccacgccgggtgaatgctaattaaaggtgaaaagggtttcccgttgacccagacgatttccgaaaacagagtgtatactgtatagtattggattcggaaagtatgttcctatgaattcttgtcttagtgtcggttccttccttcagtagtagtgaggtgcggtactaaatctggtaccgtgcctggaatgtcacgtggaagggtgacaccataattttgtattggcatatcagttgaatgtgctttgagtgggtgcatcctgggagtggacataaccatttgagtgacatgcaaataacgaggggacattccttcgagggattaaaatagtttcccggtgtatccttccaaatttcgaaccctaggtcccccgtgactgcgtgacaccgaggtcgtacaccgccgtgatcctcgcccgctgttatcctccgtgccagggttacggataaggcatactctctatcctacgacttatggaatatactgataagatataccttcacgtatacggttcgtttccgtgtatgccattaggaattcgcctcaagtcaagttatatctctacaaagttaaaggaattgcagaagtcctactcggaaagggtaaaatctctaatatatcgtgttggtttacatatctccaagtcttacttaagggtcaaggtatcccacatgtcacgccccgaactagtcccgaccggaactagcccgtgacgctccaaattaacctgttaatcgataccagtcccagaaaacagtgctggtatcacaggaagacagaatatcacagcaacagaggtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactggggggggttatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaacgacacggatgagacagtgcgtctcgtccggtcggagtatgtgcaatgtttcagtcttttgaattgatcaagattggcacccggccaacagctttcaaacagccagccgggcctggctgatcccatcagccgcagattttccaaacatcaaacccattccacaacagcaaatttcacaaggcagtagtcaaacaaaactacgctaggaattacctcacatccgcccatgaccgtgggcacggctgttcgaacagttttaataacctctgcagagggggtacactttacccacacgacattactaacccggatcatccagcccgtgcagaacggccacgactagagaccttaaggcttttatgacaaggcatttcgaaagccgacacaggttcaccatatgccaacgagaggggtcccagtccaacaccagattaggtcccagaccatactatgcccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggtgaaaaaaacggggaagattgggtggggaaaaggaagggagggcgcctgggtttatagggcggcgatgtcggtttggaaaccgaccttgggcggtcaagggagggagctcgcgctcggcggtcgcggccaaagcggcgacaggggaggggaaggatgacgccggcgggagggaaaagggaaaaagggggagagaaagggggcttgccccttgccactttgggaaaaggaggacgaagagagggtgacgcgggagagggaggaggagctcagcctccatcccttggagggacgcgcggggagaggcggggccgtgtcgatgacaacggcgatgacggcggaccggtttggagtggagcggcaacacgggcggtagacgcggggcaggcgcggcaggcgctgacggcggcggcgactggccggtcagccaccacggcacgcgcgcgcgcgggcggcgcggcgatttgggcggcatcggcgggaaaggcagcgagagcgggagggagggctcggcgcggctcacgacagagcggggagagagagagagagaaagagagagagagagagcaggggagggaaggggagatgggccgagagggattcggcccatcgaactcgatggaggctaaatagacttttgcggagggatttgatttgggaaggatttggattcgggattgaacttggcaatagatcggggatttgagatctgagatggcacggacactagacaacaagcaaagaaacggatttcgcaaatagggtttttaagagatagtttttccgctaggcgccacgacggaacgggcgctacaccacgatataaaagggacctctagggagaggtaaagggcatcgcatctcatcgccaacacacccaccaaagtttacgaagccggagtccacggagccaactcgtcgggagatctcgtcgaacccctcgactatgatctcatcggcattgtctgttcggttactctctttgtaatctgttctcatcatcattaatcccatataaactagactagggctattacctgataaggggcctgaaccagtataatccttgtcttttgtttgttttgatatcgtactacgtagatccctgttccaacatactctaataccctattcttccggtccgcgagtatcactcgtcgacactccactacgctacagtcgcacaagctctccttgggtatgctatcctcgctgccactcatcctcttctatcaccacgactttcatccgctgtcatggccacttcatagttcggaggatggaaaagatggattcctagaggtgggatgaatcgtgcaaagaggtttgagtacgtgaaggcgaatacgatgttggcttcaatgaggtcagaggcaaactgacgtcgatgctggccacacgacaacgaggtcctgtgtcgcctgggacatcggcgtcggtgaacccctactaggtggggatgatttcggtggggaagagaggagccgcacacgcgacatatgcatgttgtgtgaagcccagtgctggtgaacccctactaggtggggatgattttggtgggagagagaggagccacacacgcgacagatgcgtgttgtgtgaagccccaacgtgagacaccggcgtcggtgaacgcctactaggtggggatgctttcggtgggagagagaggagccacacacggggatgatttcggtgggagagagaggagccgcacacgcgatagatgcgtgttgtgcaaagcccagcgccagtgaacccctactaggtggggatgatttcggtgggagagaaaggagccgcgcacgtgacaaatgcgtgttgtgcgaagccccaacgtgagagatgatggttgtgggggcaagacaagttcggcgctgcgcagtgcttatacgacacgtggaggaaattcagccagcgacaagttgcaacaaagagccaagcctcatcctgcccatgatgacccaacggcccgattcaatttggtaccgcaagcactaatacagacaaggtttttgcatacggctagaatgatttatctcatgcgggttggcaattatcacgagcagacgctaggcctgtatacgaaaaaaatatttttagtagtgaaggtacatgtacctcaaagtaccatttgttgtaccagaacaaaccgaccaaaattaacaacatggaccaaaatatcaccaaatagaagataaatccattttgtaagccaagagtggtaataaaaaaaaatagaagaaaacatcttcaaatgttcagccaatatatagtagctctaggccagcctcaggggtaagtaaattattgagcataagacataccaaataaagcctccaatagggtaccacgagtgaccaatggtaacgccataattaggataatgaacaaatgattcttggtagatgagacaagcatcagtatggaccatgccatcacagttgctgggtgtcacaactcgttgacaatatctgcaaaactttgtagaattcttccctacaaaacgagtagaataaatgtttccattgacagacttgacatcgcttctgttatttactataatgctgacgtaaatatctttaccatcctgcgagatatagtcaacaacacaatgaaaggtcaacatgttacccttcatgacaccaaatcttctgatgttatttatgtactcgctttcttcatagttactaaaaaatggaccaagagttgtaatgaccctatctccaatccggtacaaggagttaccaaccggacaaattcgctggcaaaggaacttggacatttgattagccaatcttcctgatgatgatttggttggttctgctattccaacgtatagctgtataatatagaaaaaacattttcaattcatcggcatattattataagagcaattttactattattgaggaggtaccatgacgtacgtactattttttctattgtaaatttaatacctcttgatatctaagtagtatgagatactaaattttccactaaatttttgatacaccctcaaggattgtaaaattgctcttattataaacatgggttttcacatcaatgtgaaattgcacccattacttgtatgcaacttgattatagttacaggaaaaaatgaaaaaaaatgttagattgaatgggatattgggattctagaagtatatacacatacacacacaaatttgcatgcctcaaatgtgatctacacgtggaggtaaaaaaatgacacagtagaacgcagtgttactgctgttcttgaagtgtacaacgaatttgtagttgcatgcttgtgtacttccttatatcatcacagtatatttttccaatagtttttcaaaattttatttaactagttataccacatgcatttatacagtgagggatgaaaacagtagagcggaaacaatatatagtttatgtattaattttatggaaatggtttcgtcatggttgggaattttccatatttcagaatttaacaatctagtgacgactttaatatgacgccaacataaattagaaaaatgtgattagaaacggaagcggttggaaacgatgtcattatattatttgtatggaaacaatgtcatttttattatttgtatggaaaggatatcggtactatcaggaatttccgtatcattgtcacccccatatacatttaggtgcatagaatgcacatgcacctaggtgctaaaaatagtttctgacataataatcatatgattctacaagacactaaacatagtagctatgaacaacaagccattcccaacctaagacactagacatagtttccataaactccacatcatcaagaaactagtactagacactactcttccaatgcaaacaccactatttcattcttaaatttaatgctacttatctcacatgatgtcttgtatgttgtgtagaaactatatcttatgtaagatatggtttcctcctcttttctcatttagtcatttgccacatcatttttcatcctatgtggcagtttatttaatgctatggacaccatccttattgggttggcaatagcctaaggtgccaagctagtcaacttctgttaaaaagagagtagctttaacaggttactgctatatttgaaattaatggtatttgaacaaacgagggaacatgctttgagagtttaaaacacttccctgtgtattcgaaagttaaaaaaaagattaaaagcagcactgttaattaaactgtgaaactcctgaaaaaaatgcatgtaattgatgtgaatgagtttggtaaatgcagtcaaattgactgaaccaccaaaaccaaaccatatacgaagtcagagtggatgcgtgcacacgtcacggcagatatatagcagatttattactgcacggagtagtaattattgagtttgaaaactgctaataatcaggtagacagataccttctggccgttgacgacgtggttatggtcggcgagggcgagggcggcgttggcggggtgcatgaaccggcgaaggcgaaccggcggggaaggccggtgaggcgatcgcggcgcagccagatgtcggcgacatccccgtagcggccgaagtggtcgcggagctccgtgtcgcccatgtccggggagacgccgccgacggacagcctcgcgctctccggtatcctcatcggcgcgcgcgacgccggcggcgaacctaggtttttcttttcgctctcctttccgacgccactatacatatatgggcggggcggtccatgtgaaatacaagttcgggccatactagctagatgggccgaaccggaattgcttccaatcgaatgtgcagtccatgttctgttggctggattgtgtccatcgcggccaggacgcatcgaactgaactgttcttgcttaaagataagacagagtaaacgttttattttaaaaaaaaactagcaaaatacacggataaattatttgttaggctaagtattgattagaaattttaatgataattaggatggataaaatcaacattgcatattgatatactcttgttctcataatactcaagatgggtgtggatgctctgacgatcaaacggcggtgagaactgtggtaggatgtgtcccacaacatggtcttgatagagagaaaaatgacaacggcgaccttcggtggtgaacagatgagcgcggcaaaacatgttctcggacgaggggattccgttttctttggccgtgtaggaagatcaaaagatggagaaaaatgattagcactgttcatcgtcttccctaactgaaacaataaaataaataggagggacgatgggcgccgatgctctggtgaccaaacggcggcgaggaaggtggccgaacgtgctccagatgtgactcatccataaatggtggcgtttggcaacaaagacaaaacaacgggaacacgaccgacaagacatggtcccaacagatagagaaatgagaatgacgagctctggttatgaacacggtcatcaatggatgagtccaatcgtggaacacatcctaccacaatactcaccaccgtttgatcgtcagagcatccacacccatcatgattattatgagaacatgggtatatcatatatttaacagtggtttttatccagcctgattatcattaaaatttataatcaatacttagcctaacaaataaaaataatttatccgtagcgaagcacgggtattttgctagcagtagttattatatatttcttaaagataagacgcatcgatcagtttgatacgaatacggaacgtcccgtacgtacgcgtctacgtgtacgcacgagttgccgtcgacgagaaaatcagatcagcagatcgaggcggccggcaaagctcgctgcttcaagcttcgtgtcacctccatctccgaccacggcagcagcagccgccgcctcggagagctgccgtgcagcgcacgctacccgccgtctatataaagaggcacctctcgtgtcctctctcctctgaacccttcgttcccatcacaaaccacgcccgcctcgatcgatcgatcgaaagctcgagatggccggcgatgacgccgatcgcaaccgccccggccgtggtcgagagtctcagcccggcggcgccacctcgtcgtcgtccccgccgggctccaacttcgatggcctcgccgcgaccacgaccggcggcgcctccaccggcgacagcagcaggatcgcaagccacctcgtcgagttggaggacaccggccggaggcggagcgccgccttcgtccccagccgccacgaccccatctacgtccccatcggccgccccaatcccttgggccccatcggccatcgggaggactactactccggctccggcagcgccaccgccttcttccccagcagccgcgaccccgtccatgtccccatcggccgcgacaccgccttacccccaatcggccatccttcccagggccgcgtcaagtcgggatcgtcatccgcctccgccggcgacgacatgatcaactcctcctccgccgccgtcagccactcaaccggcgccggtggcggtttctcctcgcgacacgcccctgcttccgacgaggcgaagaagcagcagcgtgtgatggcaataaggcggcagcagcagctacagcttgcgatggaaatctggcggcagcagcagcagcagttagcggcggcaatgtggcagcagcagcagcaggaagatgagtgttctggcagcagctgcgtgcgatgacaccctccgccagcagcagcagcagcagctcgtcgtcctcatccgctgcggtcgccgccgccgacatagctctcgcgccatcggcagaggccgggtctccgtcgtctcctacgacgccgacgacaactggagccgatcagaagaatgtcggcgacgtcgtcaaacgtcggagtccttgatcgatgatcttagcatcagttagtcaggttagcacactcgcggaaggatcggaggaaacgccagtttcgtcaggttttgtttctgttatacgttgtggtaaaatcgatgaaccactgcgtgtttttgtttgttcgggtcgatatatccgtcttgaacccatttggtttgatttgactagtacggcttaaaagacttgatgcgttgatgatattgttgaatgttgattttgtgttcttgcattctggtatctagtatatctggagaaagattggttagtaagtattgctgcttaattgcttgcctgattgtggtcagattcagattctgatcagatgaacagtgtacatttgtctgatcaaagagtaggcagtaattaacatcttactctgctaatcaatcagtagttgatatgcagtttgacattccaattcatggttgcatgcacatgaatcttgttcagccttgatggaacattggaactgaagttgtgaactacggagtatatatgaaatgtcagatattttcagttatattttttatttgtacatctgaaatttctggatttcctgcatgcagccacaccggcaccatgcatgggtacaactaaacctatctcaacaaagctgacttgttcgggctagcaattaatcagttagcgcaaaattgaaatcagaaaagtaatgtttccactgcccgccgaccgacgaagacagagaaagagagataagaggaagagagaaagagggggtatgacacgtgggtctcaccattaaaaaaaaataaaataatgactggactgccacgcgtataccacgtagaacaaaaccaccacagattaggtcgaggggggtaattcggtcaaccgcgatagttaggggtgaagaatatccagttttgtggttcagggggtaatccggtcaaccgcgatagttcgggggtttaattcgtacttttttcttagctatttgctgaaacattgtttttatatagggtaaaacaacgttcgactttttggaaaccgttgtttcatacattgtagcaaaagtttcatgaggagatttgattgtgtttcagccttttacaagattaaaacattttttatttatttagtgaaatattttcgatctacttaattaaatagcgtttgatttttgaaaaaaagaaaaagaaaaggcgcctggagggattctggtcggtggctatacgggacaagattatatcggacacgatcgatctagctaggattactactctaggagtccctgactacatgtacttagattagatcgacgaccttaattaatttggcatcagttaacaattttttcgatcctccgctatcctcatcctcgccggccgcgcattgagacatgtcgaccaccaacgacgaagctacgacgtcgtcgtcgcctccttcagaattagatgctctcgacaccgtcgccaaggcagtcggcgacgccgttcgcttcgcgttaaagatggatcctaagaccaccttcctcgcccacggcctcgccgatttcgtcgcctccgccgccgcacgcgacgcgctctcccccatcttcgccaagttggcagccgccgagccgccgccgccgcccagtacaacggcgccgatcatcgcggcgccggcgtgggcgcccctcctgcagtttgcggcgacgcaacagataatcccgatcagtgcgaggctgttcgtgttcggcgtctccaagaagcgcaccaccgagctcgacctccgccgccacttcaagcgctacgggtatgtggccgacatctggctgcgccgtcgcggcggctacgccttcgtccagttgaggacaccctcccacgccgccctcgccctcgccgataaaaacccaggtcgtcaatggccggaaggtaacgtcatcgttgcatggaaaccgttctaaacactcgggcttttcttgcatatcattatgaaaaaatttaaaattttgacatgataggttaacatgtaatatatcacttcataaacatgcaagttcaaattagacttctacaagttgtaacaaaaataataaatttgactgtgattctgtgaatatatgtatactggttagagtttaatttgttatttttgttgttacaatttgtagaagactaatttgaacttgcatatttgtgaattgatatattacatattaatctatctgtatttttttttgaaaatttttcataatcaattagttgacatgcaagaaacgagtggacgttcacccgagagattagaatccatcatcgtcgttgcactgctacatgcatgcctacgtactaggggaataaccacccgggaaagcgttttcatcctttgagccaatattattctctagtttgttacatgtcatctaaaccgttatcaataaaattgtaaagaatttacaagatagattaacatgagatatatcatgtcacaacatgctagtttaaattcgttttttataagtcataacaaaaaataactctgaatttatatatattaactagttttagtttagtttatttttttattataacttctagaagtcgattttgaacttgcatgtttgtaagtgatatctaatattaatctaccttatcaaaaattgttaattttttttataactatttaggtgacatataagaaactaatggtatgaaaatccatctccatagtaacctgaccctatgagtatacttatacgagtatagagtgaattttgcaacatcattggtcagttaattagttattaacttcagctcgataaataatactccctccatcccaaaaagaaccaattcatgcttgtccagattcatagcccgggattggttctttttgggacggagggagtactcttttgttttatgtttgacgttgttgattttttacttacatttgactattcattttattaaaaatatacaaatatgtatttgtaatggtaaaaaaaataataataaatgatgattagatatttttttcctggaaagagaatgatgtctaaaaggcaaatgcgtcaaacataagaaaatggaggtagtagctaaacttcttttttatcaaaaaaaaagtagctaaacttctgaataaagtaacaaggtgattattgtgttgattggtcctctttgttttacagaattagtcggctactttggcccttagccccttatagacatgtttctttatatgattaattaatcacatgccttaattatatattatgcagctatacattgaaatagcgcaaccaaaattaccagtagaaagaccaatggccaagtacctctgccagcgggtttgtccagttgataactcgcttgttcggattggagacagggtcctctcaacacttgcattgcttggcaattactataaagcaagtgattacattactaacctcaaaagatacggtttcatggagggtaacatgctcatgtttgacagcgttgtcgactatatatcggaggattgccaacgttgttctgtgagttccgtagtaaagaaaagtgatgccaacaagcctgcagtccactacggaaacaacatttcttctactactccttctgtaggggatgatgctactgcaaaattttgccggtactgtctacaatttgtgactcccggtgatagcagcaactgtggcgaggttgatccataatgattcgagcctcatctaccaagaatcgtttcgtcgttttaattatggtcttaaaattaatgacaagtggtttcctgttggagcctttgttggagatatgtctagtgccgaggctgaagaacttgagaatttttaccgtccattgagtatctgcaggctcaaagatgatcaaattggtaataattttcaaacctataaaggtcttaggtaaggggatcctttatatctccaattttttttaatatagtggttgatatgcttactttactgattgagagggctaaagatgtggttctataaatggtgtaattcctcatttagtggatgatggtttatctatattacaatatgcagatgatactatcatttttctagagcattatttacatcaagcaaagaatctaaaattgattttattccgtatttgaaaagctttctggtttaaaaattaattttcacaaaagtgaattattttgcttcggtcaagcagaggatcattacgatcaatattctaatatctttggttgtaagttaggctctttttctgtcaaatatcttagtattccaatgtattttagaaagcttggtacgtaacaaagactggaaggttattgaacaaagaattgagaaaaaacttagtagttggaaaggtaagcatatgtctgttggtggtagattggtgttgactaattatgtactttcaagtttagctatgtttatgattttcttttttgagataccgaaaggggtgctttaaaaaattgattattatagatctcgcttttcttggcaaggagattttcataaggaaaggtacagacttactagatgggatatcatctaccagcccaaagatcagggtttaggggttcataatttggaaatagaaaataaatgttttttggacaaatggttttttaagttaattaatgaacaaggggtttggcaagacttattgaggaggaaatatcttcataataagtctattacccaagttgataagaagcaatgtgactcatttttggtcaggtttcatgaaagttaagggtactttcttaaacatgggttcctgtat

SEQ ID NO: 81977 - DNA, 14654 bp, Oryza sativa
tccgccgagtgctacagggattggctggaatggctgcacgacaccatggcagaagagcagcagccgctgctcccagttcaattcaaatcacaccgcctcgccccctccaccgacatggccgatcccaacggccaccaccgccgcctccccgccggtgccccaggccgcctcaacttgggctccgcctccgccgacttcgcccccagcagccgcgacaccatctacgtccccgccaaccgcgacaatcccttactccccatcggccagtttcctcaggaccacgtcaagtcgggctccgcctccgccgccgtcgacatgatcaactcctccgccggcgacgacaacgccagagatttctcctcctccccgcggctggatgtgattgcagaagcacagggtgctgcatggggttgggatgctctgtgggaagacacgggattcgctcactgccttcatgatcccaagatcgtgctctgctggcgatacatgtatggaggcgacgactactgtgatttgggatgcgattgctttgacgctcacagttacaatgatctgcaatcaaagatcaggacaggcgtcgccgccgccagcagaagctattcggttcctcaccctgacctagtgagttcactgtcgaattgatttgacgccggcattattattattgtgaattgattcgatgactaattcccaattgtttttctcttttcaggatctcgacttgtccgacgtcagccagttcgctggcgttttctcctcgcagcaacaaccccctgcttccgacgagtggaactttgcagtcgggaacatgcagcagcagcagcagcagcgttcgatgacgccctccgccagcagccgcgccgctgccgctaccgacgcggacggagaggatccaccgccgccgccgccacaccctccatctccatcggcagaggggtctgcgtctcctcctacgacgccggggacaccaactactggagccgatgagaagaacgtcggcgagctcaacgacgtcgactacccgctacttctccccgacgcccccgccccagcacccgcacctgcaccggcgccgccaccgagtcacaccccgatccggcactgccgtacaacggcacctgacaggagcgtgtcgtaggaaaaacggcgcgaaccgcttcctacgaaaccgcgatctcagtatcagtcccaggacatagcgctggtacccacggtgacaaatatgaatcattgcaatccttaaaataaatagaggacttatttaccttaacttaggttgcagctcagacagcccgagaatgcaaccgacgacacggacgaggcaaacaccaacaacagcagcagcagcggaaccaacggtctaacacccaataccacattcgacggctgggaaccaggacgaaaccctaatcttcacttcacttcatcttcacttcacgacggaggaactatatatacatatatagagcaagggtgagtactttcgtactcagcaagtcacgggaatttaggtgtttaatgcaagcttggaagagtggcaaggttgttttgcaaatcttttatttgaaatccattttgaaaccactaagtgatttattccttttcaggtttgggtcgaaaagagacttgcgtctcgattcaactttaagagatgcttttcaacaactcaattgataatgtaccgacctcccgggtcagatcattacttctcggctcccagagtcagttcacttgattaatcggctcccagagcctttttcattttctcggactcccagagtccagctgcccagcagcaaagcaatccgcttcctcttgggaagcctagtctatgatgcccgcaaacatcccgaatcacacagattcatttctgaccactcaggtcatccatctgccacataggctgatctggttacgattcccatcccacaacaacttttcacaaagcacaggcaaacaaatctacacaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaatataggccattttagttttcacaaatcaaactccaaccacctcaattggaaatctggcaagcttcgcgttcttgccttaccaggaacccgggttggctccaaccgaccccgccccggcgttccccaactattggcatgcgaggtttccctgaaccgactagttacttagctagggtgtcccattccaccttgtggttgcactttgttatgcttgatgaatttcccacaggaatcggtccttatatgtgaatacgggacagtgccacgcaggcacaacccccgcatcgcgagttttcacaattcattttatttttaaacacaccgacaccacaggtcgggttttcaaggcttctcaaacccatttcccaatttttcgacaatcaacagtgtatgtgggatatttggtatacgcgctcaaagagcacggataccgaagtaccacaagggtggagcgacaaggaatcagggtagtacaacctataggaattagtgcgactactgggtaggtccgtcggtttggcacgcaaactgaggccaagcaagttaagtgtgtgactataataatgcaagttgcaaacaaaataataatggttttccaattataggagcaattggtcaaagggtgacttgccttgcttaaggtcttcacggagcttcatgaatcttcgagaaaacccgcgatcggcgaaaatccggtaaccgcaactatacgcaaacaaacaaaaacctaaacaaaagaccaagaaaaagaccctatttagagtaaataatagtgccattaaatagatctcaattttacggaattactggaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaattttggaataaagaattttatttatggaacaaaggaaaaagatttattaaatcccttggaaaattaaagggatgagggatgtgatttggacttatctcgggtggcattggtgcggcccaaagggttgaaggaggctcggccgagccattgggccgggcgctgccacggggaggcggcccaacagagggggcgcgggggagagagagacggctcggtggaccgattccaccacgcggggtcccaggtggggccctcttgtcggtgatacggcccacggtgggatgggcgcacgcaagggcagcgctagggttcggggggaaagcggtccacgcgcggcgcgcgggtggacgcggtgtgcagcgggcccacgcgcagcctgtcggctctccgtggaccgcgcgcgagggtgggggacggagggaggcggctgaccgaggtcagctttgacccggtcgcgtcgaggtggcgccgacgtggcgcctacgtggcagccacgcgggccgggcgagaggaggaagaagaacaggagctccaaccaacggtggccgacggcggggtttcaccggagcacgacgcggcgatttgatcgagagggagttcaccggtacaaaggggagcacgagaggggttgagccaacggctcggatccttcgaagaggggctgacgacgacgaatcgcggcggcgcacgccggcggcgagaaaagggggaaatggcggaggggtgacagggattcaattcaaggcggtgggagcgtgtccggggttcaagaaatccgtttccggcatcggatggggcggaggagcaccgaggagggctagcgacggcggcggcctccggaagcgggcggcaatggcggcgaggccatgccgagcggcggcgaagctcggggcagtgtctacgcgcgttcgatgggctagtagagctaccacgcaagctagagagggcgagggagaacgaggaaggagaacggagggagtcactaccgagtcgggacggcacggtgacgagtggccgacggcgcgggagtgagttctccgttctcaggccggggaaggggaagaaggggggtgctcggagtcccgcgtcacgcgtcctcgcacgcaccggcctccccggtgcttggcgacgaacggcgacggcgagagcagagcgagcaacaataatagcgcggcggtgatggaagtgaaacgagaggaggattcgatgggaggggctcgggttttataggtggccgggtgaggagcttcgaggggaaggaaccgactcgggagaggcggtcaaggagaggagctggcggtcacgcccgtggtccaggcggcgacaggcggtcacgggcggtgtcgggcaaaatggaaaaaggagggggaaaagggaactctgttcttgccgaaacggggaatgggagagggagaggagagcgcgtgaggcagagagtcgcgctgcctccacgtcttggacgcacgcgcgtacagggtgggggcgagcggcagggcggcatgggcggccagggctgacgcggcggcgaccgggcggtctgccacgcgcgggcgagcgcgtgcgcgatgcgagggcgcggcggaattcagaggcggcggcgggaatcggcgccgggaggggagagagcagagagagagagcgaagacgggagagagaaagaacgagagagcgagagagctctctctcggctcggctcggcgcgtgcaacgcacgtgcgaggctgagagaggagaaacggctgagagagggaggtgggctaaggggggaaaacggcccacaacacccgagggaggtaaaatagacttttgcagggaaagctgatttggagagaattggagtttgtatttggattcaaattcgatattcgaactcgagggttcagggaggaatcaaggaagactcaaggtagggtttgatatttttcggaattgggagcgagtatttgccgaggattcaaaggatgcgattgaatttcggaatttgatttggagatttgagttgaaggaggaatttcgaggtggaggattttgatttcgatgagagggaacaacgggattgaattgagatcctggcacgacttagactctcacacaaagaacgaaaattttcgcaattaggattttgccgaattagtttttaacgtctcacgaaaagctgagcgttacacaccgccaccgccaccgccacggccacggccacggccacggccaccgacgatgagaagccgcaaggcgcggctgtgcgagcggtggatgcaggatggggaatgcccaaatgggaacggctgtcatgacccccacggcttggaggatcagataagggtggcagtgaagaagacgaccgaccgcggacatcggtgcacggactacttgttgggacagtgcaggaatggagtcaactgcactagactccatgatgttggtccttgatcgatcataggaatggaggatcaggatcggaggaaacgcccagtttcggagtctcgatgatgatgatcttactgaatgtctgaatcagatgttttgtttctgtttgtgggtggtcagatcgatgaaccactgcgtgttttctgttgttctcaggtcgatccgtcttgaacccatttggtttgattcgactagtagtgtccgtcctgagaaaaacttgatgcattgatcatattgttgatttgtgtgcttgaattctggtttttggattccgttatttccatcaagtattgttgcttgctttcctggttgtgttcggactcagatcaggtgagtgatatatttcaatatttgtgttcatactcagatcagatgaacagtgtgtgactggtgaaagagttggttgtagtaacagcttactcggctaataattgatatgcagtttgacattccaatatatgcacatggatcttactcagctagaaaggttcataaactgttctgagaatcgtcatcacatatatgaaactactagtgcaggaacaagagaaaccttgatggaacattagttggaactgaacttgtgaattacggagtatatctcagatattttcagttagatttataagtttgtacattttctgcatgcagccacaccatgcagggtacaattaaacctatctccacaaagcagtactcagactgaaccttttgtttaaaaaaaagtagtgcaactaaatttttgttttataaaaatcgtaaaatctaaaccgagaaacctctcggtttagacttaaccagctacgggcatgcactattcagtgtattagtagcaaccaaagtgaggtcgctggatatgcctaaccagcgacgatctcgttacagtcacgtccctttctaaaacttaaatgccatggaaaaaatttctttgcactccctggaaaaatttacaaatgaatggacatttcgatctcctacaaaattactatggaaatacggaatggcccatgtggcttctctgggagcccattcgtgttcctcaagtaaaaaagaccacatctgtgataaacttactttgggccgaaagcaaatatcttttggcccactaaaccttgcttcaccttcttccttcgcccagagcaaagcaagcgcgactcgaagcttctcaaccccgagctcgccagcaacttgcaccgtggacgctgtcgtacagcgcaagctacccctcgcctatataagacagcctctttctctctctctgacggtctgaccccaccacgcgtccacgcccccatttgaaatcacacgcctcgcctcgcctcgccctccatcgagatggccgatcccaacggccgccgccgcctccccaccggtgatccagatcaagccaacgcctccccgtcccggcgagtctccgccgtcgatggcgtcaccggcggcgagggcaggcccacctactcccacttcccccccggcgcgtacgagccgacggacgtggcctacggcatccgcgacgcggccaacgacgagcgggcgcgggcgcgggctcgggctcgccatgaccagggtggcggggctcatgaccaccaccacgaccggccccggcaagaccagcgcggcgaggctcacctccacgacctccccggcgagaagagcgaggtccccgacgtcggtccatctgaccaacaggggaaggaagcctccgacaccgacatggctccattggcggcgctggcaaagagatcctacgacgtcaacttcccgccgctgcacgagcaccgcgccgcccccttccccgccccggcacccgcattcgcacccgcaccggcgggcaccatgggatcctcttccgcacaggtgcagggtgacggggctcctgacaatcacgaccacgacccacgtcacctaccccggcaagaccagagcggcggagctcaccccgacgacctccacggcgagaagaccatcggttcaggctccgatatcctcgacgactccaagagaggaatgatcaacgccggtccccaacacggccgcatcaccacctccaatggcggcagcggcagcggcagcgacaagggcaagggggtctcctacgccggggacaagcccgcatctagctcgtcgtcctccagctctgctggccagcaggggagcgacaccgacaaaactccttcggcggcggcggcgagctcctacgccggcaacttcccgccgctgctgcccgcacccgctcccgtccccgcccccgcacccgcacccgcgggcgcggcgccatgggtgttaccaatgcccaccacaagattgcgctgtgcagcaagaggaggaaggggaggtgccacaacggggcagcgtgtcgctactctcatggcgaggaggagcaacgaattgtgccggagatgagagtcggcggcgggggacgtccgtgcccggagctcgccgccgccaagggatggtgcaggtacgggctcaactgcaagtattgccatggcggcgtataggatcgaggagcagcgccatgggaggggggagtccttcatcttacaacgctcgcggaggaaacacgtcaggttagagtctggatcatatgactgaatccatccgaatcatctggtcagctgttttgcttctgttgtggtcagatgaaccactgcgttttttgttgctagatcgagtctactctagtcatgcgtttgatttgattcgactcgtgaatccatccgaatctgaattcgaccaaggaccagtacactttttgtttcttttttggtcagatgaaccactgcgagttttcgttgtcagggtctaggggaaaaagattactagaacccatgaatttgattttgagtcctaataaacttgatgcagtgatgatattgtttactgttctgttatctgctcttcatctgggggaagattgcttatgaaaattgctttctggcagctgcttgggatttgggaccagtactgtttgtttctgttctggtcagatgaaccactgcgagttttcgttgtcagggactagaactcctgaatttgatttttgagtcctagtaaacttgatgcattgatgatattgttgagctctcgatccgggggggatattgcttactaacattgcttgtttgctgggatttgggaatgtggtgtactaatatggctctgcttcctctggaatccatttgagaatgttgatgcattgatatatttatttttttttaatctgcagttggtatagttattggttgttctgatttctggattcaatctagagtagaatgttgcttacttgggaacattctttcttgtttctggtcagatcagacactgcttatcagggggtctaggagaagaagacttattagaacacatatgattgattcttaaaattttgatgttattctcaattgtggtcatgaattctgaatccaatggttaacaaaattttgatcctattggaatgataacttctgatggtgatgagaccctggtctcaatgtgctgtcactctcacctgaatctgtgcttctccacttgagctgaatctgtgtttgttctgatatctggatttgatttgggggaagattgatcactattacaaagttgcttgatatgctggcacaggaggccttgatgttagcacgcgcaggagacatgttcacgtcaggatagagtctgaattcatcttaatctgaacgaaccactgtttgtttcaggtcagatcagatcagccactgtttgttaggtggtatagggagaagaagtctgtaattagaaagcatttgatcagagtcctaaaaaaccttgatgctgtttctgaattgcggtgtgaatcctgaaaatgcaacggttaaaatcgtgatcttattggaatgatcaggctgacgagaccctgatctcaatgtgttctcactgttcatcggcggcctcactgttctaataaaatcgtcaccttattagaaccccacagtagagctaagctacgaaatacaaatcactgtataactgaatcatgtaaagcgattattgatgacaagattctcaaagtacatgcagacagaatataggagtacttcctttcatacattcactttctagctatgatcaagcttgcctaagatcgagcgctactttctactaaagagaggaaaatatctccaaatatatgttcaaccaacagcagctctggaggttgagtatgttggataagtatagattattcagcattagacacatctccaataaagcatccaacagggaaccactcatcagcaacggcaacacagtaaggataatgaacaaattattcttggtagatgagacaagcatcggtatggaccaagccgtcgcagttgccaccgggtgtcacggctcgttgacagtatccgcaaaaccttgcagaggtggtctcgcttgcaagacgagtagaagaaatgtttccatggacagccttattagcttcgtcacttttgtcaactacaaagctgaagaaaaaaactcgaccatcctgtgagatatagtcgatgacaatatcgaagatcaacattttatccttgaggacaccaaatcttctgaggttttttatatactcgctttcttcacagttgtcaggcaatggaccaacggttgcaatgtgcctgtctccaatccggtagaaggatttaccaatccaacaaactcgctggcaaaggtacttggacatttcattagcaatcctcctgatgactttgttggttgtgctactctaatgtatacctgtataatacagaaaaaaaggttttccgattaattaattaaggttaaactgttaattaggcaatactgtagtaactaggtaggctaggtacttcctctgtttcatattataagtcgtttgacttttttttctagtaaaatttctttaagtttgatcaagtttatagaaaaatatcaaaaatatattctatttttaacacaaaacaaacatattatcaaaatatattcaatgttagttttaaaaaactaatttgatattttagattttgctagtttttttcataaacttaatcaaacttaacaaaatttaattaggaaaaaaagtcaaacgcttgtattaagaaacggaacgagtacgtaccttgcggccgttgatgaagtggtccttgtcggcgagagcgcgggcggcgtgggcgggttggatgaactggacgaaggcgaaggggcggtcatggcgcagccagatgtcggccacatccccatagaccttgaagtggcggcggagctccgctttgccggtgcccggagcgacgcggcccacgaacagcctcgcgctgatctccggtgatgtcctcatcgccgatcgatcgatgcgccggtgatctgcttagtatatattggtgttttgcttctgtctcttaattaatttccatatgcctaaccttgcctccatatatataactacagagagagatgatgcgagtcgccttccgattctgtaatggtgtcgtaatacgtcgtcggtggtgtggctgatcgagcgtgtgccggactggcagctcacgcagacgtacgttcgtgagttcgtcgacgaccgggactccaagatcttgttggcttcccctccctatgatcgatctcagacatgaatccacagtgcagatgccgttcacgcagtttgttgggccttgatcatcaagcaaataatcgccagaacacggatcgagcaggtggtgtgcactgtgcagtgcagcatgtacattttggttgagcactctgtaactgaagatcatatgcagagcgtttgttgatgacaaagattctcaaagtacgtgcagacatgatatactttctttcatacagtacagaaacagaattacactatgaaaggtacgttgcaatcatgcaatgtacagatacatccagtttctatctactaggatcaagctaggtacgttgtggccgttgatgaagtggttcttgtgggtgggcttgctttgaactgaaggtgggcccggaccaacgcttcgtttgtacatcgcaatttcggcccgctgggccggctacctcatcgcccaccgtcggatcgttcgatcaccgcctgtgaatgaagtactaataaaccctaagcagccgccgcctagccgccgccgtcttggtaaggctcgcctctccgcggatgctcgcaagagaaagtaatgccgatctcccactctttttcttcccgtgtttccattcggttcgaggcttcgagcagatgtgctgttgtcttgttgatcaggtgtcttcgatgagcgcgtgcttagatcgttttttattttattttggatgagttcatgtgtcatgttaataaaatataattcgagctcaacacaaattagaattgaatcagttatcattagaaataatctataatttatcgatgtgtcatgtcaatgaagaaaatcttagactcatagttggactgatgtacataggttgataggaacttgattagcaagggttagtatgtgttatgtatgcccttgataaatcttatcagattgcacaacttgaataaatgcttgtcccaagtgaataatgtatgttctgagaaactttcccacactaagttagtggcaaaaattgtaaatatagctattactatactttgagtttcttcagtggacaatcatacaatacaagtatggatacatttcaaaattatatctttcgaagcgttttctgttttttcccctggagtttgatatcggatggcagtgatttgacattacccgcgcttctgatataatccgtgaagcaaagggaaaataatggttgaattccttaatatgagccattcattcagctatcatatttcctctaaagtattagtgtttttgtctggttgatttacttcgactgctagatttggtggttggcagtgatgatacaaactttcagcttacaatgccagttctgcttctgagaatacatgacagataaagctgatatatatctgagccttttttttccattatgtgtttgtagtcatagcatccaaatatctaatctgcccatgatgagctgcccaatgattagagggtgtagttggctcaagttcctgtttatcaggaagaacctacttgcagctgctgcattcacatgttatcaacgggtttctgaggttatagacactccttattttgctcgtccatcaaattttggtgttgtactttcagggattcttttctccattgagaagttgcataatttttgccgagtttaactatccttccgcaagttaagtttctgttttgtgtgtaggctgaaaaagctcggagattgtgtgttgacatcagcttcgtctctttatgtctgtgagatgggagttaaatgacagcacgaaattccattctctttgggtgcactggtgcagtcctccccacctacaaggatcagccaccatcactgccgctgctgcaccattgcagctttcctttctggtctgtgttttcgtgttgccttctacatgttcaatttgatttcttttcatggatcaatggtatatgattttttttcctgtgtgttttgaatcgtcctctcttgctccttaaggttggggcaccaatatctccatggtgtcaccatctttgcaagaaggggatagatcgacgcgtcaagaaatcgtttctgttgccatggctccagtaggcaatacgattgttgcttgcgtacaattttttcttgacgcagactagtttcttttcttgtgctctgctgtaaaaattctgtttatatctgttctgttcatgcacggtgctaaccccgggcttgtcggattggaatcctctgaagaatgaagccccaatgcctgtgctagatccaccatgccattcagtgttgcaggtcatgatgcttcgagctcgtgattggtctgtgtcagcgtaatggatacatttcaaaactatatctttcttagtgttttctatttttttcccttggagtttgatggctgatggcagtgatttgacattacccgcacttctgatctaatccgtgaagcaaagggaaaaataatggttgaatttcttaatatgagccgttcattcagctatcatatttcctctaaagtatttctgtttgtgttcattagatttactttgttagatttggtggtttggcaatgatgatacaaactttcagcttaccatgccagttctgcttctgagaattcatgacagataaagctgatatagatctgagctgaatgtttttctttttctattatgagtttgtaatgtagcatccaaatatgaaatatctaatgtgcccatgatgagctgcccaatgattagagggtgtagttggctcaagttcctgttcatcaggaagaacctacttgcagctgctgcattcacatgttatcaacgggcttcctgaggtcatagatacacttcttgttctgctcgtccatcaaattccgtattgtagtatcagggattcttttctagttgatacacattgatttgctagtttttttttaaatggaaaattctgattgagcattgaattaattttcattgagcattatcgtgctgcttgctcttctgcaggaatctccatgatacaaaacaaaaccaaccctagatgtgttctattgctgacacagggagttgtaagtacatgttaaatggtggcatactatacagctgtacaatagacgcaagaaacaataaccacttacatgccatcctccaccctgaaatagaaaaccatttttagcatgttggtgcttcattttgtattccattgggatataaaaatggtagagaacaaccatttttaacccaattttgtattcctttgcggatataaatatggtatagattgtaacttgatatctggactcatttcgggtttggtgttcgctatttgttccacatggtacctggacgtgagtggttcatctgattcaatgccattttcattgatttgaaatcgcacttttctcacaattgcgctgattaacttatgaatcaacagatacttcggcaccaggatcttcgaaaaacttttccagtaaatcagattctacgcgcaattttcgagagtttgtcatt

SEQ ID NO: 81978 - DNA, 11267 bp, Oryza sativa
acacatgaggactcacatgtcatagacagcgagtggcaaataattaattgtcactttttaaaagtggccacacaagttaaatgtcccgcttttctaagtatcttttaataaatacagtaataataatagagctttatataagtttgggccccatactagtatgggccgcaatgggattgctatgcacatatagcccatgtcgcttgcggcacgttttgcttcgtccagttgagctagtttctgaatattattgctgcttctgtcgccgctgcaaactgtaattgttgccattgaattctttctttttggtgaggaatattgccatcgaattacagcctccgtcgtagaaaatttaacctctgtttatgaatctgaacttagactatgcacaattttctggtctaagatatcgcgtgttccaattaattaaaaataaaaggcatgcagtgaactgatgatccacgtcagagaattaatttgtcctgaataattacacatcagtgtggctgctgcactcaaaacaatacaaagaccaggtgcaacagaaagagacgtgcacaaaaatcaattggtctcttgcaatgttcagctatgcttgcttgaggtaagcaaggttggctggctctagcaaagctttcctgtcctctcacctaccatgaaagtgacaaaggaatgtgctcttcgctctgttcaatactttttttttctttagaacagctctgttcaatactccctccaccccattttaaatacagttgcggatttccgtatccaatatttaatcgtctatgtttgtttaatttttttattattagtatttttattgttattagatgataaaacataaatagtattttatatgtgatttatttttttaatttttttatattttttaagcaagacgaacggtcaaacgttggatacgggaatttataactgcacttaaaatagaacggagagaatacttctatgtttttttttcactccaaaagctttagacaaatcgccaaaatatagctgggggtgatgcatatatgcattcgtgatatcatttattattatttttttgttgccggtcggtggattagaccgatcaaatttcagtaagataatatatatatggggagagtgcataaaaaagtatcattcaattcgtccaattttttgttttaacactgttatctgacggcactagtttgtatgagaatcagaacagtctttgagtagttccatgttggctcaaaagtcagaacgtacgtgtacttatctggttcgtatttatacgccaaacagtacaaggctgctagtctgggtcaaattgtcaggtggctgcaagtatttcttttatagttccttacttattttttttctttctttctaagaagaagaaggtcagacggctgctatagtaaaacaacaatacaagagtacgatgttatgagctacgacaaaatacagataaaaaaagagacttattcttcagcttatgaattatatacatgatcttggtaaggctgtgctcagtgtactccagttttccatcctctgctttctccttttttaacacacttcctgaaccctttttttaaaacaaaattctacagaaaggttgtttcaagaaatcttattaattacttttaagattttatggctaatacttaatcaatcatgttaatgttttatggctaatacttagtcaatcacgtgctaatgagccaacctatttttcgtgccagagagaaaacttgtattccctccatccaaaagagttagacacattacttttgacactaagaccgagaaaaaaattaactcatttgtaacaaagatctatacatgcataaaatcaatgagtactacgtacgatactccttggatcgatcaaatatttaatttatctcttcatttaagtcttggatatataaaactacatatatgatcaatttaattgagaaccataatattaaataagtcaaacattttttggatggagggggtattgtctaacacaccctaataataatacttcctaacccagtcaactttgcgaccctacctacaactagctcctatcaccgtagctctagctagcaggggctcatccagtatgggtgttgggaaactcaagtcccatctacctcattggatcactattgagagaaaaggagagaggaggacgcaggaagaagagagagaagaaagtgtaggggagggaagggggagggggctggagaaggaagaaggaaataagcccctctctattctttttctagatccgcccctgctagctagtggtgtcagcaccccttgcgtcgcgctcctttcttcactataccaatatctatatctcttctaactatccttgtgtttctattgtccctactcctttttcccgcctagagtacccgccagtttgccatttctcgcccgctccattaccaaattttacctacatttgcgctaatgaagtggtcacattcacagagggagaagtagcatgggctgttggatttttatccaactacctggatcatgctaatgcttgcaaattcatgatgccaattaatatgatcaagctagacgttgtcggacgtttgattattctcccaaaagcgggcgttatttcatcagtttgagaaaattgttttagtacttggtccaatatttctaagagatgcaaagtccaagaaagattggttgtgacaccaacaacccgctatataaaacattgagtctcaatgactgcaatatcaaaaaaagaaattataaaatcaaacttaaaatgtgcaacgtagttggaattctagttgaaacattctcttcttatgtatgaaacatcaaattttacgactaaaacatgtgtatattttttcatcgtaatataataaaatgatcttgttgtaaacatttaattgtaacaaattcaacagtgtaaccggatcgacaattggataagtaatttagaagaaaaaatttttaatattagttgatagtcttcgtgcatgcatgtattcatagtttgagtacagagcatggcacatagagaaaagaaagagaggtgaatttgagggtgcccaaccatttgggttgtatctggcgtacgtccgaggctaggcatttttgttaaattaatatgtacttacaattataacactcaatcactcataatcccctataagatacacattgacaattattactgcctacaagaaaaataacaaaaaaaaatcaacaaagggcctctcggccatcaacatctatcctaatttcaccttcttcactcttcagaacttccctcatgtgggccctacatgccagtctcctgatttgtcgacagatttttttttgggtgctcattaattgtctctgctgcaaagcttaattctctgtaacaaattaaaaactgagctacaaactgtaaaaaaaaaatcaacctaattaagcatatatatgatcatagaacaagctcggatcggcgagctccatcaccatcctgtaaatgtcatcgttgcatccatccttgtagtagaaatcgctcggcgccggcgagctgagaacgctctgatcatggccgaatccggccatcgccgtcgccggcgaaggctccggcggtggcgccgccgccgcatgctgatgaaacactgtggtattatcattgctgctactgttccattgctcctggaagtagcgctggttgctgtagccaccgttcacgttgctcgccggcggcggctggagggtgttcatgtactcgacgacgtcgtcgccggcgctgtcggactcgaggctgccggtgatcgagctcgtcgcgtccggcaccggcgccggcaccgcggcggcggcgacggcgagctgcggctgcggctgcttcttgtgggtgatgttcctctggaagattcggcagatggtccaaacttcctgcatttttttcacgcacacaacaaaagttcagttcgtcgtcgtgctaacatttcggcacgttcgaggacacgtgtcagtgcgtcacgccactgtttccacgcacgtgtgaatggaaccaagccgggttcgcgggaaagtgcatgcaatggccgatcgacggcgacgtcgccggagatgaagaagatgcatgtaattaacaggttttaaatatcccgctatagctatttgagaagggttttaactaattatttactctcatatataatttagtcgctatagttctacttaacccgccgctatatctatctaagaagctactccctccgtccaataatataagggattttatgttgatgcgacacattctagtatctgtccagatttattgtattaggatgtgtcacatctactcaaaatcccttatattatggaacaaagagagtaaccgctagtaatgtcttagcacgctatttaaaatattggtaattaacttaccgcttcttggaggctcggaggaggggaggagcggccggcggcgaggtcgtcggcgggcggcggagggaggcggaactcgtgcatcatccagtcggtcttggtgcccttgccggcgctgccgcggtagtagacgagcgacttcttgaggccgatgcagtcgccgccgccgccgccggcggcagagcagattgggcggtcgattccggtggccttccagaagccggagccggtgacccggttgggtcggatgctgttcctgtacttcctccctcgaaggcagaagaagtaccattccttctcgctgcccaccgtgctcgtctctgcatgcatcaacatggttaattaattaatttgattaatccccacaagatttagcttttcatgatcgaatgatcgatctagcttatagtttgaaacaaaaaaaaatcacgtaaatatagatattattcatgttgttaattatatgtgttaattcttgaatttactcaaggcctggtcactaaatctgtcatgttattctattgcatgcaaatgaaactacccaatcttagctgataggaacatcatgctccaagcgcatgagcttgtagatcaccatgaactataagcatatatatatgcatgcatgctgtgattttttttctttaataagtatttggtgatcatgaacttttaattagttgaatgaacttactgaggaagtcggagggatcatgcttgtagatgtccatctccttgatgatctcgatgctcagccgcttctcggcgatcttccggcgaaggtagaacgtcactagctcctcgtcggtaggatggaaccggaatccggggagaaccaggtcatcatcatcttcctcttctacctcctccacccctcgtagaatcacatcaccagctccaagttcatcttcacaacccctcttcatctctgcagatggcaccattaattttatctttgatgatcagtgttcgccggccgttcgatcgaatcgtcgattcgatcgatcgcctcctcttctcaaacaatctaggagctagagaacgaaaattgttcttgtgttgttcttggaattaatatccctgtaaagatataggggagatcgatgaagttgttgagaggagatggccatggagccatgtatatttatatggctctgatggatgtgtatagtgagctaaactaagctgtctgttggtttgtgaaagctgcaagaggatggagtcatgaagtttcatggttgcttggtccaagtcacttgctttgacttctcttctctctagcaaccatgtccatatcgaaatatatcagcattggatgcatgtgtgtgtatatcctaatttttttttgacaattcttttcatttgaaataaatgcatatctcgtcatttatatagattatttgcccgtggtacggccaattgaatggcaaaaattaatatatgcaatgacgtagattaacagtgcctggtagtacggtgcgtgtttggtaaaagttgttgagtagagttttaatttaatttattcatgtctgttggctttattaactacagtatgttgttgttacggttgaaatttagacatgacaagacatgctcccaggcccgttcagccacgtcccgggagagacgtgccgccaaagtttactgagtcatcttgcagaagattaattaataatatcactacatggtttaatgtgactgccggcttcttaatggtgattatattgatcagtatatctttcttaaattcttactccctccgtcgtaaaatataatttctctatcaacattcttttcccaactaatcataatcctccaccattcaccttttccacttaccttcactgctcatccaatcacaacattccaccattcacttctatctactttcttaataactgtgttcaactttaaagcttcttatattatagtacagagggagtaattatttaggatagaagctgatgaacacattcgatcgatcttggccgtgggatagaacaacgacgatcgatattgcttagacagataaatacggaaaatatatagtgcaaaccacatattttcccagataaataagggccatatatggtagagagctaggtttgcaactaggtattgctctttttgataattcgtggagatgaaagctgatggatgatctgtttaattatagtggtaaattaaatattttatataataaattaaacaaagagcttatatacaaagtagtataatcaatgcgttagaagattaattttatattattagaaaacatatttttaagaatcatcaagcaaataatccgcgacaggatcgaaagtactcgatctgcataattggatcaactcttcttttttaataacagatagaatcgatcaagcctcaatgaaaattttcataggtggatatattcaccgccagtctagctagatcacgctatattatttacagtggttgatatgcataaataataatgaattaatcaatgatacggagtatccatagaccattgaattgaattaattgacattcttaggtggtatagcgcatctacttgttctttcttatttcatcaataatttactaaactaacacacaaagtgcaaagcatgcagtgtactgatcgagttgtgccttcgagaaaagtagaaagtaaatttgacgtaccaaccaactaccaagtcgatccgttcaccctgtcaatcaagaaacccaccaggccaacaagtctcaaatttttttactacaggatctttgcagaagagaacaatatattttctatagaagactgaatgcgatgttttccaatacaacgtatctagatagatttcttattcagatacattgtactaaaaaatattacattcgattcgattctatgttcttgtgtttgggatggaggtagtactttcaaagacaataagtgtatgcatggttattggtaaagaagaaagatcagaattagcatgtgtagaattctccttgcccgtatatgctatgtgaaactattttcttgcatggttgttggagacaaagacgaaagggaccagtataaacagtcgcaagaaggagtcaacttcatcaagatttgatggggtccatttgtgagaaaatgtttttcgacattcaattgagacacgtaacatagttttatgccttttggtgcaactttaagtattgttaattaggagaatatcaattttgggctttcttctacttacactcctatgatgttttctacttactgtgcatacaatctagctagaggctagtaagatcatttcagcatgaacaatggcgtgacgtcagcactgggtgtcaattaggattaatttgtgataatgtgaaggcaagattaacagaagagatcaatattttgtctgttgattaacaaatgttataatatgcagcttcataccatatatagcgtcatatactatctatatacttaaaattaaataattgaatgtacaaatttaatgtaaataattaattaactaagcatacaatacgctgtacaagttgtctgtgtatcatctggccggtatgacatgaaaagattacatagacgactaatctttaaaccgttattcatgcatgcatgatcttccatgtggaattaattatggttattaatacaatgagctatactttacacgatttctcaaacaatattttagttaatttgctatttttaatttatcattacaaatatatacccctatcgtccacaaatatatataagggactccaggttgtttagaagagtttaacgttaaggcaaaattgctttgttgcccctaggacttgattgagaaaaatcacataccagtgagcaataaatgcagcatagttggatgaattgaaaaagtagtactaagaaatgtcttatatttgtaaacagattttgaatttaaaatcctttatatttgtgaacagagaacactaaaatttaaaataaaagtattgtattttttatgtaataatgtagtctattcggttattttgtttatgaaagtaaaaatatgactacacatcaaattaaccaaaattggttatttccagtcgattaatttgtttaagttggtttttgcccacttagatcatacggtcaatgtcttagaatatcatactttactacttaattaacattctgaaaatgtttttttttcgcatcaagatcatatatatacactatatttcccatagtttgttttgtctaaatttttatatttaattaaaatattgttttgaaactaagccaacaatttctggtaccaactacagtatgtccatgacttccgaaatggagcttagcaacaaagtacaagccaagcggctgatgttggactaatgcattattatcctcgctagacttttggctccacagattttccataaattgatttcctccgtgatcttggatagtctcttagcctcacacatgctccctccgtcccgaaaaacaaatctaggactgaatgcaacatattctagtacaacgaatctggacaaatgtatgtctagattcgtagtactaggatgtgtcatatccggtactaggttggttttttaaggatggagggagtatccttgtttttgaatattcttctctttcactctttccaagcaatctacacaaaaccatcaccacacacacatatatgcatcacagacctattgatcttcaaagatatgagtttacaaaaagaggaatcagggtgataaaacaaagtatagaaagaagtttgggagtaggacaataagggactgtctactctacatttgatagaaaaccttcaaatacattgtaaattttagaccgttggatcactttaagatttttgcaaatcccccaaaccttgtcccttctccttttttccccctcttagctgccgcacgacgcgcaagagctcgacttcctgatgtctctttgacgacaccgcttgagctcgccggctggccagaaggccccaacgatgcctgcgagccccccccccctcccccgcgcgccctctatcttcctcatgaatgcggcagtggtgtggtgccctcatcctcaccgtcttctctgtctctaacaactccccaccacctaatccgtcccggctacaacctcttaatcacaaccttgctttgccccccccccccctccaccaccctcctccatcccaaatggcttcggctctgactccggcgccttgccgccgtccaaccccgggccatcgcctcccacaaatatcacactaagcctgactctcactagtcgagttcatcatcgttggtcgtcagtgtttatcaaggtcgttggagttggaggaaaagtccatttgagtacaaatcatgaagcggatttgaggttagaaatttgcaatattgtatctctatttttctgttggatgttgtttagcaatttcgaaaaaatatatatgaccggttgatgatgcatgagtcaatgtgcaatatatctttcaaggtacagcgagagattgtgaaccaaacaagtagtttatatggaatcttgtgtttctgctagttatggctcacgtgccaagcaatttgaagatctgaactttcgtctgatctctctcacaaatacctgtcaatagccatatagttggatcaaaaatatatatgtccaaagaccccacatatttttttctactttattttctctccaatgtaaatcacgcaagtggattgtgttcgattggtcaatggagcaatccgtgattatataattgcgatcttggttgatggatttttccatggatgaaaaagaaaagacaagctatataagaaatgtcgccatggtaggtaggaaacctgtcagtgtgttcaaggactaaatctattattatcgttcccacgtgtggctagagataagtcaggtaattaagcagcaaactagtcatttttagaaagcccgttatgaccaacaattgataaattatttataaacatgttgttgaaaaccagatagaaagctgatgacttgtatcgattttgagaggaatcgtttgtacgtacacaagcatcttttggttcccatatgctcttgtgggtctaatacgctaatgctacaagacagcaacattgcacttctagttgactaaactcaccttgccgtttgacaaaactttctttggaagcttatggaattcctgtagaagttagtgtgtttagtagtatatatgtacatattaatgtatttcaaattcttatattagatgtataaatatcatatgggaagacaatcattttgtctcaaatgtactttcgtaattagtattgaattttgtaaatgtattagataaaaattagtactagtttataaaattgtaatctggactgtaccgatgtgcaaatcaccccgactgtttgtttgacagttatttggtcaatgcatgcatgggctcaaagttgtagcatgtcaaatcacacttctagctacagtagcaaagccagtgaccttgtcgagcccggatgactaaaatcacttttcgatgatcaactaaattttaggatttatttgaaatgtaggaatgaaaaaacaaataactttaatagaaatataagtgtaaaatagagaattgtaaaatataggaaaaataaatgaatgattgtttgagtagaccaaaaccggaaaaaaacacatgaattgagtgagatcgaaatagacttaaaaagaaatttcgaaaaggttgaaacgtttgataacttttctctacaatctaaatagactgtccattccaaaataaaattaaaggatgggatatgatttttttcaaaggtattcttaattaggatttttttatgtaggattgaaatccttaaataggatctta

SEQ ID NO: 81979 - DNA, 1536 bp, Oryza sativa
gacataaaaatgtttatattttgggacggagggagtggcttccttgtacggtcgtagcatatgaaaaaaaaatgcacctagacaaaatatccctgtaatgtgaacatgagacacaatgacttccgagcacttaaattgattggttaattcatctttgactgatgttttttttgcgagttaatcttctagcacttttattgtcagaactcagaagccattgactgtcctcaattattcgttctgctattcccaaaccttatcttacacctaagttaatttgattaactccgttccaacaatatgcatgcatacacatgcaggtcgtaccgtacgtatatgatgaactcatctacaagaaattatgactctggttagtacaagataacttcaatattgggacggtgaccaagttttttaacacatgcgccgctatgacgactcaccttattaattatggacatatatatatgagttggtgagcttggtaaagaaaagtttactgaagttagaaattcaaacagtttataggtcatcactagtaaaaactatttaaatgaatgtttcctgatgtcttcttgtaaagcctgtgtaactcagctagtaaagtttgctcatccggtcagttttagacttgtggtacagggtgcccgcatttacatctaattattctttaagtggtaaacgatctttggacaacaaaataaaacatatgttgtgacttcgtcgattttaagatatgacagtttagctttttagtatgctcattgaggtagagtgtgcgtatgtgattattttgtcgattttaagatatgttggtctggtattttggagatacttataagagcatgatatacatgtgtatatataaggatgtgtatgcgcacccttgagcgtgatactgtgttttttttttaaaaaaaaaaagaaactccaccagaagacattgaccgtccaggtcgtacaaagtacgtacatgatgaactcagctacgaatatgagtataggggttagtacaggattacattattaatgggatggtgacagtttttttaaaacatgcattcgcggctatgacgactcaccttaattatggacgtgacgagtttggtgagcttgtttaaaaaaaaagtttactgacgttataaattcaaactgcttaaaggtcatctctagctaattaaaaactaattaaatgtatgcataaagggtaggatgttctatttcattattaaaaaaaattaaacgtatgtatgaccaaatcttaatcgagatccttttcaaaatactgtaatacacactcttaccacgtacggttaaaaattaaacttcaccaacatgtacataccgtcactgacacgtgtatatatcaaagtttctgtacagtcggcatgttgatatactcgtggttttgctatttacaaagtcgccatgatatcctaacctgctacaaattgagatgtcaagttgtcaacagcgttcacggccatataagtatccacgtatacttcgaacttacttatttcatgtgtcagttta

SEQ ID NO: 81980 - DNA, 1292 bp, Oryza sativa
tgattggaagagttaagaaggttttggaatatcttctctttgcagccaagacactagcacaaaacaagtctgcgaggagaggtcggagctgtgctccacgtcttcaaagcatgtagacatggaagatgataatgtggataaagcttgcttaagtgatacagatccaatacccattactgagaacatagttgatttggatgatgatggagtcgatatccctacaattggggtcacggagtggaataatcctcattcttctgaagtatctgatgtaagagaagtaaccactgaacctgaagataacagcttggatattcctgttgatagccaaccagtatctgagaatgctttccacggttaacctggcttgtttctattcttaaccccgttggcttgtattctatgttctcattttagttcattgcaaacattcatatattcaaattaaagctcgctatgagctcatggactttagttccacaacgtgttcactgtatccaagtggaataaaacagtgcaattgtgggtgtgtacatctgaaagtccatgtttgtcaacgtgattcagggtatcaggatagtgctctgaactaaattcacatgagctgcataatgcatcctgttcgagtattaattagtgacatctattactctttgcttgtatcatacggagtatatataaacaagtaatgaatgaacatcttgtcttcctagttttctttaataaaaaaggaagccgtcgttctcgtgcatttttgtggagataagtactcaaatgccctagctatttctctaatttgggggtagtgtctttcagacctatagtttcatttattcgaggaataagcgaaacggcatatttacaaatgaatagtaatttgtgaataaaacttttatatatgtgctcttaacgatctaaaagcaaagactgaaaaaataaacttatgaaaaaacctcaaaactaattctaaatttaaggttaaaaatttaaattttggcggatacgcatgagcgaaaacatgatgcctttctgtctgtaccttcaaatgaaaaaccaacgtagtgccttctagagaaaaatgaagttgtttagtgcctttctgtctttctgtctttctgtcttttttggggacaagttgtttagtgaaatttgtagctagtaaaatgaagcaatgaagcccatttttcatcacctgctcactaactatcaataatttactgtagacatcatcacaaaggaacagatcaaattaattgggaagacaagtaaaaggttggtcaaaaggaagagat

SEQ ID NO: 81981 - DNA, 6939 bp, Oryza sativa
ttaccatattggtacccagttttgtatgccattggggatatcaaaatggtgtactagattgtaacttgttatccggagagttggtaactcgtttccggttggtgtacagtacttgtcctacttggtacctggacgtgagtagttcatctgattctgaaacaatggcattttcattgatttgaaatcgcacatttctcataatatgaaaattaatggcattttcatttttttgagtcgcacttcttataattggataattaatttcgttggcatcagacctgtactgtacacccaacttatgtcagttgattaactttctggtcggttgatggtacccgtacgcacggaaatctttattaaatgacgaggcgaatttcttccgcctggcgcatgtgttttgttgttgctgtgctgtattgcatatagatatagtagtaaatagtttcatattattctactttctccgtttcacaatgtaagtcattctagcgtttttcatatttatattgctccgtttcacaatgtaagtcattttagtatttttcacattcatattgatattaatgaatctagatagatatatatgtctagattagatagatatatagatttattaacatcaatatgaatgtgggaaatgctagaatgatttacattgtgaaacaggggaagtaataataagatatatgttcaccaaaccagtataacttgacaataaacagattcttttgcaccagatcgtttgaaaaaaaaaaactctttaagagaaacaaaccaatctgcttctaattccattgtaaattgccgcatatttttttgtcggcacggtgaccacaaaacgtttttcggtttgatgactacaagagggtaagtactaagtacactgtacacacccttgcagttcggtgagaaaccaaccaggataacaattctgaggatagcttgttggatttttattgtatactgaatacatcaacaatattacaatcttctaaaatcctcccataatatgaatctcaagaattgaacgaatgaccataagcgctatattacatataacttctgtgagtgagcaattgaaagcccttgatgatgaacattcctaagaatatatccacctaagtttttaagttttcagccaatagatgctacagggtaaattctcttcacaaaaccatggcctgagggggtccgtagccgctccggtgcttcttctgccatgtccaggcaaccctgaggctctccaggagatcggtatgttgagcagtccagttcagctcgctgttgatctttgcgggatcgctgtacacttcggcatagtcaccgggtcgacgagggaagtagtcgaccttgatgtcaactcctgttgccttcttgcaagcttcgacaaattctttcactgacctacctgaacagccaagtggaatgaacatatgttagctaattaagatgctgaaaatgagtttgcattcatgttttcccttataatgaacttatgatcataatagaatacgatcttgacctttgcctgtgccaacattgtatatgccaactttgcccctttccgccttgttgagcgccttcacatgggcgtcaacgaggtcagtgacatcgatgtaatctcttacacaagtaccgtcaggtgtttcatagtcagtacctttaacctgtaatggaaaatgctattaatcagcaatccactaaaagctaagcaatccttataaatgtgaatctcaatgagtaagcaataggctatgctagcagcaatcagggcaccctgttcttgaatgtaataattgaaatactgggagtgaagatgtaccttcaaaccaggaattatccccagtgcagcatcaaagcatgcaccagatatacggccatgctcccgtaattcaggttttggagcctcgccaagccttccttcagggtcagaaccaatgacgttgaagtatctagaagtattaggttacatattcgtaagtcaggaatcaaatggtggtttaaatagtgggtttcatgcttttgttttgtaaacggtacataccttagaatcatcacagccatgtctgccttcttggatttggaaaaatccaagatgatgtcctctgccatcttcttggctttaccatatgggttgatcggaaactgtacagtaggatttggtgagcaaaagccttcagcattatctgaaagtaaagaggatgcagaagcaacagctgacctggggagttccttcggtgataggcatcttctcgggttctccataggtggcacatgtgctagagtagatcagggttctcacattgtgtgctgccatagcctctagcacaactaaagtgtttgaggtgatgttatgatagtacctgtttaaaatgttttcagtatctcgtgtgtcttgtggagaggtaatttgatggacaatagagactttagtacctcaaaggctcaagtgtgctctcaccaacataagcgacagcagcaaagtgcatgacagcatcaaaagcattttctgcaaatattctattaacctaagcatgtgctaaggaaaaaagatctttcaaaaaattccttcatcatattttgccgcattttgaatgaaagatatatctctacagaaaaattcgatttgagttattcagagaaataaatcaggatacagcttttggatcgcctaaatcagcatagatgaactgcaaccgcccaggctctgaaaacaagttctgaagaaccttgattgcccccatatttcctcttgaaagattatcctgcagaaaccatataggcacaagcattccataaattgcactacaacaacaccaaattcgaggaagaaatggcaacacaaagtcgcgaagaagtaccactatggtgactctgaaggaatctttcagcagccgaagcgcagcgtgcgaaccgatatatccagcgccgcccgtcactagaacatgcgtgactccgggttcatggatggagaactggacacatcacacaagtgaagagtgaagacaaatgttagctgcctgaccatgaattgttcatggcaacatacagagctgctgaaaaacatctgaaattgagttaccacactgggagtcctcctatggcagggcggctgtgtgagcatgacgacgcacatggcggtgaggagcgccaccatgaggatcttactgaggtaccgcggcttgcgcttcggatcggagaagtccatgtctggcacaacatgatgagctcaaattcagaggcatgtacaacaaggggaaaaaatatttctagcaaaggactaaaattacagagctcaaaccataaaaaaaccaaaattcctgttgcacaagcaacaactggacccaactatgagacaatcaaaaggcacttgcagataattttagagctatccaattacatgaaccaacaattatcaactaattcagaaaaaagagagaaagagacaaggttatcagtaagatagggtgagatggaaggaagcagacagacctgagatgaaataccaagatctggcaggcctctgctggggcctgttcctgttggtgggaagcatctggagcagcagcagcacaccaaatcccctcccagaaagaatcaaagttcctcggagacaagaacgccagagatgattcctcctgctcactgccggccacctacagcggcatcgaggaagaaaatctcgtcagaatcagcgagaggacagcacacacgacgcggccacgggtcgcaggagcagcagatccaacaaccacacacacgcaacttcaatctgatttaattacagctaattcaccagcgaaaagaaagcagcatcggcgctggcatggatggatggatggagcgatgaaattgcagcgaacacgcgtaaattaagccgccaagaaaaagggaaaagaaaagaaaaagaaagaaaagaaacagcaagaagaagaggaaggtagcttcgcacctagcttaccagaactcgttcaggatagcaatggcggcgaagcagatcagaggaaaagaaaggtgagctttaacacttacccggactagtagcctaccacctgctgggacgacttggctggctgcctcggcgacggcggaggagaggagggaaagcaggggagccacctacttcccgaggcagtggcggtggtcctagctctccctctccctctctcgttggccgcgagaagaggcgaggcgaggtgaggttgttgatgaagtgagaagaagaagaggctttgaagggaggaggcggcgctggctgctgctgctgctctgtccggtcgaggggggagtggggcccacgcggaggaaggggacacgtagcgtatgcgagagggggtgacgtcgtcgcgtatttgctgggccccacaacctcatcggtcggaacacgtctgggagcactacgaggaggttcaaaatattccgtgtctttcgctctttttttttgttttaataataataataataataataactggggaagaaaaatactgctgcactatgtatatatcgccgacacgcttccactgtatttgtcctgaggagtttatttttagagcttcttttatttatgctaaaataaatttgttgttcgtaattattatatagaagtttataaaaggcaaagataaatgtaataggaatagataaagtgaggaataattatattggatttaataaattaagttggaatattctagtcttttttttattggtatatgtgtgggatgggtgaaaaataaacttattttaaaaggatggagtatttctaatccgtgtgcttatttgaaaaactttctatatataattgtcttatatcgctagaatttaatttttaaaatttttaaaatttgaactatttatttacgcccttcaaaatctatcataaaatctgaatatagtacctagttcgaacggacctacgtactactacatatttgcatcttcgaggttcaattttctttttctttttcttatgggaaattcggtctcgattggtactagtagcatttttaccgagagtggatcacgagtagagtgtactgctgtgtttgttaaattttgagtgtatgacagtcggcttgttccaagaatccaaggacaagtttcactttttcttatgtactcctaaccaacaaaaaccggcaacacagtgtgtatagtggagtacataagaaacttctgcaaacacatataggttctatttagttcacaaacaaaaatctttcagcatgtcacattgaatatttagacacgtacatagagtattaaaaaaaactaattacattgatagcgtgtaaattacgagacaaatcttttaaacctaattgtaccatgatttgacaatgtggtgctacgcaaacatttgctaatgatgaaataattaggcttaataaattcgtctcgcagtttctatgcagaatatgtaatttattttgttattagcctacgtttaatgtttcaaatgtatgtccgtatattcgatgtgacatgccaaaagttttcgatcgcgaactaaacatgctcatatactactacgagcataggggcactgtagagtgttgacttggcacgacgaagaaatgaataatactaaagcgttggacgagcctaacaaaaccacttattatcatcgaattagtgggacaattttgttataaaaacatgattccaacatgtaaaccatgagcagctagcaggcatgacacaagatcaatgtcttacccggaaactacttaaatcaaccgtgtattccaacacaaaacgacagtcggccaaagactcgtggacataaagcccgagcagccacatatactatggattgagatcctctaacttacgtccttttaacttatgccatttttaacttataccattgacacgtgtgccatctactcagtagacccacatgttagtgactcaaagttagaagtaagtaagagaatcctcttcatatgtactatctaagagtaaaactcgcttggcagcccctaaaagtaatgttaaagaatgtacacgtgtgggtttgcttggtttgctttaaatctcaaaactaaggtagtacattttacgatcaagatatacacatcgagtcgatctatatcagttggaaaaggtaaagtcgtcatctatcgctatatattatgcgtgttatcttctagattattttttgtatttacatacttttatcctttatgtatgtcgctctctatttacttttgatttataaatgatagttcacgtagaaaattttaatatgcctgaatttgagtaaattacacaagcggtccttaaacttgtaatgaagtttcacttaggtccacgaacttgcaaagcgcgcatcgaaatccttaaacttccatgtcatcctggtccaaagtctggtttgacaccgtgatcttgcctatatgtcatgccacgtggtcgatgacatggctaatttttctttttccctttttttcttcccatcttttctctccttcctcacctcgcgtggagaaaaatgcggcagaagggagaggaaggaggcaaagtggagaaaaaaagggataagaagggagaaaaaaagaaggaagaaaggagaaaaaaaataaaaattccatgtcatcgtccacgtaggtaagaccacagtcaaacgagactttggacccggatgttacattaaaccaagtttaaggatctcgatgcgtgttttgcaagttcatggacctaagtgaaacttcgttataagtttaagaaccgctagtgtaatttactccctgaattttatcgtgtaatgcaattcaatgcacgaattaattcacaatgaacttgtgtagaaaaggctcttactacaacaataacaacaataagagctaacaccatatgatgtttaataaaatttaacattgttatttcaaacaacattaagatccgatcatttcttgcctgtttcaaagtgca

SEQ ID NO: 81982 - DNA, 960 bp, Oryza sativa
ctgtggtcacaaaatagatgctgcgagaatcagaccttaaccccataatcagttctttccctttttgtttctctctttttggatccgtaacttgagctgttatgcaaacactctattttatacaaagacacacaaatcttatatatattgctgaaaaaataaaactccaacgcccaccgagtgaatggccaaacacctccattccactctacctcccactccctcaccttccaatctaggctctatctacttagtccatccgttgcaaaatataacaatattttctctactcccttatctcaaccaaatcgcaatcacctcgatatcattctttttttcctactttcccatctcaatcagtcataattatttttattcaaagtcacatatttttttaatatgcatgagtatttttttctcttagaaaaatgtttatgttttgtgattaagaaagtagccttgtgtattagcaatgtgatgcctctgtcgtactatccctttccgatcttgaagtcgtcggttttctatgcgctgtgtgcagttgagaacagtagtgcagttgaactaaagtgaggatgatctggattcatattattttgacttgctaagaataatgaggtgattaaacaacaatggatgctgacaagaggatgctcgtcggcatttgctgcatttatctttccttatttcttttccccttcttgcttcttggcagcacgtgcattatacattcatatctgtcactagatgccaatcagaagcatcttggtttgggtttccatgttcactgctactactagcagtacaaaattgttattgtgcaaaagggcaaatagtggtcgaaccggaaacaaagcatatgttcgcgtttctaagttctgatcacgaagtattatatccatcatcaaatataagacttagctattccctttgttttaaaatattattataaatcagata

SEQ ID NO: 81983 - DNA, 10610 bp, Oryza sativa
aaacctgaaaaccttggcctccattccaacaagagaagaggtatatccaacagagaaaagcttgtttcctagtcaccttaacagaaagaaaaattgaaggttaatcagaaaagtgagcacgccaccagtatttagaattcaatgtactatatacaggagtttaggtggatcaaatctttacataacactgggatatattgaatagcatacgagtaagaacaccaaaaagtcatgtcccagtatctcaaatatgatgaaaggtgccactctggtggtctttgcaaaataaagagaagaggaacctgaaagaggccacactcaattcctgaacaatgaagacggtgacaagtagcactctccaaagcatcagtgtcttgtatcaaacagataatagaaaaaacatatattccagattagataacaacatgtcctaaatcttcaaaacacctaaaaccctcttatgatcgaaggtgtgaaacaaatcacaatagctgtatactccctccgtcccataaaaactcaaccgatgaggggatgtgactcctcctagtacaacgaatctggccaaccctctgtccagattctctagcaggggtcgcatcccctcctaggctgagtttttcttgggacaaagggagtatgttgtgaattaaggataggggtcgccacggtgactcaattactaatttggacatggacaaagtcacactgatggcttggtgagtagtagtgaggcacagatacacgatatagtgtttttggtccaaactagaatcattatagcagctgcagaaattttactttgatgactggaaagctaagcaaaattcctattaaggcgccatacagcgatttttgtttggtactacaaactgaatcattctaaccttgcaaaaaggaaaaaaaaatcaaaaccattgtaaaatgggaatcatacacctgtctgactcacgattcaataatctatgatgtcatttcccatatcatcttagactacaaacacccctcctaagcaatgtacttagtatcatactagcggcagaatgttaatgcatcactcccctagttggatcttttaggccttgttcggttgcttgagaattaatccccaaggggaacctatccaggaaggggttgggtgaatcccttccatatcacccaatccctgtggggtttgaatccctttcctgtttttaatccctatcataaaaccatgtgcttgttttggcagggatttcacacaaagtagcatgttgggattccaaatcccgctactttgccatactgaatctagacccaaaaaactcctactccttccttcctgcactgcaataataagaaatgagtattcagtctgctgaatcaaagcacaaacggtagctttgattcagacagcaaaaggcacattctgatagcatcaaattgatattagtatttggtttatgttgatatctccgaatcaagctcgaaaaatccatttgtgaaccgagctagctagcttagcttgcatttccgtactccgatccagccaaagaaacaatactagtgaatccgaattcgaattcgtgcattcatggtgatacaagtttgggatctactatctatctgatgcgatgacaagaagatagaggtgctaggctataagaatccgaacaaggttgagacaaaactcgtcagtcgtcgaaggcagcggcggcggcggatgaggggtcggcgaggtgggcaaagcgggcggcggaggcggatgaagctagctacatcaaaaatgcacaccatgttgacggtggatgaggaggagcccttgcagtcggagacggagacagaccaagaaccgaggatcaaagacccaaaaaccctaggtaggacagggagaagagaggggaaggaagagatactcaccggtgagaaggtggccagcggagggggcggtcgccggaggagagagcaccgccgccggggagagctccgcgtcgctgtcgcgccgtcgactcccagtcgcgtctgcgtcgccaccgccgccgccgctttcccctacgcgctcctcgtctcctccgcgcgagggtttttttagcggtttcttacccggcccaggacggggtcggcctggattggaataagttcacctaacgtccctcaacttttacgtcgagtctgccgaggtccccaatacgcaaaaccataaacctctgcccctcaactatcaaaaaaatcccgaggcagtattgacccaaatttttaccctttttgctgacgtggcatacggcgggatccacatgtcccttgcctcctcgcgcgcaccaacgatccaccgctcgccgtggccatgctctcctagcatggcgccgaccttcgcccgtcctgcatcctcctcaccctcctcccggcgctcttcccaaccttccctgcgcacagccgccacacgctctccgccgtcgcctccatgcccacgagacggcggggagatgtgcaagatggcgcgtgcggtgcggcgggccaacaagttgtggtgacacaccatggaagccgcggtgaaggaggtgctgacgccaacgcaagacaaagagttcctaaagaaaaaagaaaaagaaaaggagaagatgagaagagattatgctgacatgtggaacccaccgtatgccacgtcaatgaaacagggaaaaaatgggtcaatattgcatcgggatcttttttgtacgatttgtaatagttgagggatagagatttctggtattgcgaattggggacctcagacagacagactagatgtaaagttgagggacgttaggtgaacttattccgtcttgattcaatccgcgatgggcttaaccgaatgcacatttttatgtgggccgggtttcactccgcgtctgtccaatccacaggaattgcagcccaatccagctcgttctcaggacaaccaaataaggacctagaggggcagtttctgaagcaaaacctgcaagatgtgtagacgaagttcccagtttgaatgcttttgtagactaccggtactacggaacttgttgtaaacatgaagaatgttgtctgtgccgtggtgtttcagtcacgacgaataggtcaaattgtaggtttgttttggttactacctggatagaagaagcctaacatgatgcctccttgtgacttgcctaaaaggtgtttgattggaggcctgataaattgagtagctccaacgcatcattagcatgagtccggcgtgcgaattcggacgcctgagatccaggcgaaactgctcaactttttaatcacaagagagttctgccgacatcttctcgaaaagcaaggtagaaggggataagaatttcacagctagcaaacccccattccacaaagctccatgactacgtcttagatttctctatcctgtgcaccgatggatctgacggcggcgttggcttgccgcgcacgcgctcaactcatcaccgaaacaactatcggcgtcttttcatttatacttatgcttctcagccaaattttaaatttttaaccttaatttagagttgattttagagttttttcatcgaagtttattttccagccattacttttaaatcactaaatacacgcatatgaaaattttatttataaattacttttcgtttacaaatatattgtttggtttattccacgaataagtaaaacgatggggccgatcgcgggaggcttgcccggtcaggcaaaagctacgacaatatcagtttaagtctcgggcgtgcaactttctcaggcacatgctaatcaagcaaccaacccaacacggccaaacacgcatgtttcaatcagtgacaccccctgacccggtgacccctgtgacaccatcagagctctctaactcactttcgcaaccaactagccatgaaaaacattgacagaggcaaataaacaacattaaccttgggggcatcactacccggggaaaaaaaaacttggggcagatcctccgctcgatggaggaatagtttatctttcaatgcaaagttgccaaaatagcactgactgcaaatctctaatgcaaagagccaaagcctatatcacaaagcagacagagtaaagaacatataattccagacaaaacagactgtacggttggaaccattggattgtcaaacagttaatcgtgctatttagttattttgagcatacaagaagagagatcttttagttaatagaacaaaattataccaccaacctaactgaaccagaacaaactgatcacgacaaatgtcagcaaatgaagaagacaaggatacaaggatttaatagaactagataaattaattactctgaagtgcttcaaacaaagggggaagcgcgcacaggttacgacaatctaaagggccttaacatgctctcttgaagaattaaagcagagccaacaagtaagattcgccaatacaaagacacggaaaaatgagaatatgatccctaacaagtgagtattctagctagctaaacaccactcctttctcatcttcctacgtctctaccgcatcttttcctgccaagatagaacaagaaggttagatcgatggcaatgatgtagtaccatgttgcttgcttgctgcaaagggaaagaataataattttgaataccagagttaaaacagaattaagcgtttggtagcaacttcattagtagagaattacctggacgcgactgctaccagtccccagatgatctcgttgcatcttccttggtcgaactgtaagcacactggcttcaccgcgatccctcttattgggtggaataagctggcacagattatgcttcttgatgtgcttgaatatatcagaccccattagggatggagaaccagcatgccgccaacgaggaaggtgccaagctgacacaaacttgcaagtcaccatgtcaacgctgaaggcatataggctcctgtccttctcatcctccgcatagaactcacccatcaagagataaacgacaccatcgtcctcagtgctcagcatgggatgggtcggcgaagtgttcgtcggcagccctgacctcctgaacccctcctgctcccacaatctcccaacacggatgctaccgaccttgcgccactgccctgagctcggcatcatcaactcccacatggacagcagcatgttgtatccgggcaaggtgttgtatccctcgatggacacgaatctgatcgagttgccaacgcagcggatatcgcgatattgcgacggcggagcagtgagatagagcgagtcgaaatccacattgcaaccggtgggtagtgcaatgtaacggaattgcacgtcgtcgttggtattagagatgagatcgtggcagctgcaggagaggatgccttgtccaagatccacccagtaagatgaaccttggaacgagaaggtttgatgagcattgaacttctttggcttctcggagcggaagattggccttctggttccccagcaatggcggtcgaatggtgccgatgacggcagcaggcagaggacttgcggtagatacccatcgtcatctgcatccgcgtccatgtccattgcaaagaggacaaggaggtagccgtcgccatcggattgccggagagggagcggggtcacagaagggcggaacctcatcgggacggtggggaacatcttgagcgaggcgttgtccgtggcggcgtcgcagacgaggtaggagttgtcgccgcgcgtgccgggaaggcaggaggagagcacgaggaaccggggtcggcgagcaggacgccgccgaggaacccgcggcggccctcctcctcgtcgtcgtccgggtcgccgtcgaggcggatggacaggcgggagggccgggggggatcggcgacgagcgcgagcagcttcaggccgtcgtcgtcgaacggcgacagctcgtcgtcgcggcgcaggccctcgacgtccgcgcggagcgtgacgtaggccgtcgtctcgcacctgatggctgcccaccccgggttctcctcctccccgtccggttcgtggagacggacgacgggatccagcaccacccagggtggcaaagagcgcgcctccgccgccgccgccatggccggtctgtgttttcgcttctttctgtttttccctcttctccgagtcggaggcggtggcgttgaggaggggatcgatttcatttttttattttttggcgcggatcgtatgtccatcggacggtggatctgcgactgcaagaagcccacggccacgtgtatttctatttcacgagcgcccgtgaatccacctcagcttcggaattggtttagagcctacaaattcgatttcgttaaaaatagagagagtataaaatttgctaaaataatggagtagttacgacttacgagaacgaatttgtaggctcaaaagacattacgtctttgtccgaaaccgagcgtagatcagccatggcggcggcgcgctctttgccaccttgggtggtgctggatcgcaacgcctttctccacaaaccggacgacgaggaggaggaggacccggggtgggcaaccatcaggtgcgagacgacggcctacgtcacgctccgcgcgaacgtcgagggcctgcgccccgtcgacgagctagcgccgttcgacgacggcctgaagctgctcgcgctcgtcgccgatccccccccggccctcccgcctgtccatccgcctcgacggcgacccggaggaggaggaccgccgcggcttccgcagcagcgtcctgctcgccgacgccgggttcatcgtgctctcctcctgcctccccgacacgcgcggccacaaatcctacctcgtctgcgacgtcgccgccgcggacaatgccgcctcgctcaagatgctcccgactcttccgatgaggtttctcccgtctgtgacctactgcccgcaccccgtccggcaacaacccgacgccgatggcggcggctacctccttgccatctttgcaatggacatggacgccgatgcagaggctgacgggtatctaccgcaagtcctctgccttctgccgtcatcggcaccattcgaccgccgtcgctggggaaccagaaggccaatcttcccctccgagaagccaaagagtttcaccgctcatcaaaccttctcattccaaggctctgcttactgggtggatcttggacaaggcatcctcttctgcagctgccatgatctcatgtctggtaccaacaacatcaacaacaacgacgacgacgatttgcaatttggttacatccaattacccgatggttgctacgttggttgcgactcgctctatctcactcatctgccgtcacagtatcgtgatatccgttgcatcagtgactccatcagattcgtctccatcgagggatacaacaccgatcctccatacgacatgctattatccatgtgggatttgacgccgagctcaaggcagtggcacaaggttggtagtatccatgttgggagcttgtgggagcaggaggggttcaggagatcagggttgccgacgaacacgtcgccgacccagcccatgttgagcagcgaggaggacggcgtcgtgtatctcatggcgggtgatttctacgaggaggatgagaagcacaggagcctgcacgtcttcagcgttgacatgacgacttgcgagtttgtgtcggcttggcgccttcctccttggcgccattcgggtcctccatccctgatagggtctgatatattcaagcacctcaagatggataatctctgtcagcttgttccacccaatacgagggccaaggtgctccctcgtccaccaaagagggatcgaggtgaaggcaatgtgattacagttcgaccaaggaaggtgcaacgagttcatcatcaaggggaaaatgtctaaacttttttagggaaaatgtcacctaaattttcgtgtaagcatcaatattttttgtacatgtatggcaagataaagatcaacaacgttttccacggagaggggttattcggactttttttcaaagtgtatttacatggataacagtggagacaggttatttgagattgttttgtagttaaaatcaaatcaaagaaccctataacactacaaaagaagtgagacgcacgttttcactcgtaaaattctctaattgataaattcccattgagctaatcgccctcgtgttactgggatcgatagaaaacaagcattcactgattcacaataccagcgcgtcgtacggtccatttagcaatgcccttcttgcaagttgcaagtgacactctagatgcaaatcatttggctccaagaacttcttgaataagcctctcagtgagctccctcgggagtcctcgaacgctatccattgtgccgatctatgcaacataggaagaaatctcaaaatcagagcaatggattcgatattattgttgttcagacgttgcagtgacactgtccagtacagattggccgttctaagagtagtaatactagcaatggtggttgtttcgaaagaattgctcactaactgcttgatgaatggcagcaccgaaggatgtgtcagcttaaggcctccagccacgcaggtcatgtgtccttccttcacctaattgaattaagaagtactagtacataagattgcattaccaagcagcaacaaaacaggcttccacggtgggtgaaaatatatgtccaaatacttttgcaaggttcagaagattaccacactttggatgaaatcctctggtatgtggtgaaaatagatctgcagaaaccaaaacatgcaccgatttgatgatttggtatagatcatttcagttgaactcaaaacaaactcgagatcaaattcgcagccgtcatcactatgtgcataaccacataactaaaagctcagattatgaatgtgcagctacctcaggtatatcccatcctcctttggaagctccattgcttaggttagtcacaagaacatagttcactgcgaatgctttatcacccgaataccctaccaatagcagcgaaacacacagccaaaactttttagctaaatacaacaaatttactggtacaattcctaagcagagatttgagatagatatacccttgatgaactccctggcttcttcctggccttttggcctctcccttatcatccctttgctcaccatgacctgattgatcaattcaccaaattaattagtcaaacgaactccgttcaaatataaaactcaagttgtttatgactgaaactgatggccggtacctggtcagaggtgatcagaatagtaggctgatctctctcttgagcagagtcttccccatgcaacttcagtttgatggcctctgcctgcagttcatcaggaatacaattttagctgctctggttgcttgacttgcttcacctcgactgaacacagcatctagcatcttaaaaattcttaattaattatactgttcggtgtaattagcagctgaaccttagcttcagcgagggccttgacaagctcctctggcttctccctcctgatggccctctcatcgatgtcagcgcactgaacagttaaccagaaccaaacacacttaattcgtgagggattaattacagggtaatagcgagattaataacgagagagctccaagatgatatagccaatcaaatcagctaaccatgacggtgaactcgtatcccatgtccgccagtatctcgcggcgcgccggcgacgacgatccgagcacgacctgccggcgaaaggatcagtaatcaattgaacagtggctatggctaattggctagtgaatcaattcggatgaatggatcataagcaggaaagggagggagacacgcaccttgaaaggcgaggagttcttggccatggaagacgccatggctgaactcatcgcagagctataggactctgaatttctgaaacgcctgcatgatcggaggctacaaattctaaccgaattaagtacttgttgcttccttgcatcccaagtagtatcccactcaagagattataatagcatatcatgaggggattagggttgatctcaccacgtaaaagctggttggtttctgtttgaccgtagcgttgaccggagtgcgttgagacttgggagactgggagagtgaagcgcggcgagattgtgtagaagcttctctctgtccacgtgtctgtgctttgggggaaataggccaaaggcccactttgtcttgccccattgggcttctcctcgagcccgaggagatctcacagcgtggtgacgtggcgtttcgagccgagcgcttgtgggcccaggcgtacgatctttcatacacggggtcgggttcaggcggactcagcttcggtgacttaggtggtgtttacatctagggacttaactttagtccatgtctttagacactaatttagagtattaaatatagactatttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatcatggatgggttttattaatagtct

SEQ ID NO: 81984 - DNA, 3702 bp, Oryza sativa
cacaaaagcacatcttcttttcgcccaagaagagacgtccatgttttgtccttgcaatttgctgggcccaccaggccagtctcagcggccggagaatccggagccccaccgggccgatatgtcagtgacacaagcggatgccgtggtcccactgtcagagaagcaccccgcctctctcctcctcgcgccccgcgcgcctccaagccttctctttctttccaaggcaacccgcgccgcgcagtataaagcaagcgcagcgccaccattgccaggaacacgaaaagcttttggttagtggagcactagtagtcttcgtctgagagagagagagagagaggtttggggggtaggtgttgttgggggagtcgtcgagatggagaaagagggcggagtgaaggcggcggcggaggcggaggcggaggcggagggggagatcgtggcggcgccggcggagaaggtggcgtgcttcaagaagacggcgggggaggaggcggacgcgacgttcatggagcgcgtcaaggactactataaccagctcaaggagagctccgccgagaagcactggatctgcatcaaggacaagttccgcgccgccggcgagtacgtctcacagaagagcagctcggtaattcctccccgcttaaccctctcctcctccctcctctgcaaacttttgcttggatccaacctgtgatgcatcatgcatggtgttttcgcttctgagtttttccctgtgtgttttgtccgcgcgtgtaggtagtgtagtactcgtgcttcgtcttggattcttggtggttcgctggtgtttctcggtgtcttggccgcgcttgtagtcctagtgcttcctcttggtggttcgcttctgagtttctcagtgttttggccgccgcgtgtaatacgagttcatcttggtggttggttcatgtcgttttttttctttttctgtgtagttcttggcgtttaattcatctcgtgcgtggttagaatgttcgatcggtgggaatgtaatcgatcgcttaggttaccgttcgtttttttggtgaatagatcatgtcgaagacgcgattagcatacaagttctagtgccaaagcggttctgttaatttgacaagcatttgatcgtttcatagcaatgcgagttcgtgctgttcggcatcaagccttgtaggtgtttagggggaacagtcttgtctgcgaataggttcttatctctccattttaatcattggcggcttcaatgttgtatgatttgagacggagaagcatttggggggttttcccccttcgatcctgatgttcttttttgttgaatcggtggctgcttaagcgaacatcaggattaggatctctcttgctagaaattgtggagttctcttcgctacgcgcactctgttctgcttgctattagtactgccaagtctctgtttatgtagaaactccactagtgcttgaggtttaacaagcgttgtgagttcgattcttgcctttcattatgtttaagggaaaacctgcgtgaatgggttcttgtgtttgcgatttgaatcgtcatttgtggtcgggttcactgttattcgatttgcgacgtagagatcagagatgcagaggcattcgttttttttccctgtggatttgtgatgcttttttttttttgttctctattcatttggtggtggctattaacctgtgcgtacatcaggatctgtttgttgctagcaatcttgttgaaatagtggcaaattatagattatgttgcaaatggtctgcgcattctagattgccaatgtaaaaaagttgttaatgctcaatttaccccgtatgtttcttagctacatggaacctgtcctgctcaattttatcctgtcaagtctctctttctgcatatacttctaccagcgataaaatttctgcactgttttgcctttgtgctgaaatatttgcaaatgattgtgcgatctctatcttgatatatgcaaggttcagctgtatctgctggtgtgatgtctcctaaacatttgccatggacaatcatttgtctgcagtagtgtatcctagcatttgcatttcaaattagcaacgcactctaaattgcaatcgggttctccagttgcaacgaatagcatttgtcatgtactctctgttcttggcagacttggcagactgaagttaattggacttctttttatgctgttatgttgatagctaattacaacatgctgttgcctctgatggatctcgtgggctaatctgctgtttcctgtgatgtgattcaggtgttcggcaagaagaaggtcgagcccgtggtcaaggatgctgcagttccaggggaggcgagttcggtgacagtcgagtctcagtgagggggggctagcttctgatcagtaccaactttgatgagacaagtgtaaatcctcttaggtgctcaacggtggaacttgaattgtgaggtcttatcgatcagcgagtagtttttttgctatgtcatcttgttcgtagattctagtaggaagagtagtttggacatggttggctgagtggttactactgctgtgatctccggatgtttctacctgaaaaaatatgtgaaccttgaatctgcttggtagcatctatgatcaatctgcagtgcagctggttaaattcgtgccgctgctattctgatatagacatatagttatatgagttcttgtgttgagcatggggatgatatacccactggattcatcttggttttctgaatgcaagggtcaattagcactggttcattgtgaatgcaaatctgtgctttgtgcatgcaaagatcaatgcattggttaattggctccggtcaggtccttcctcagatccacagggaaaggaaaatgttccagttagtgcttatatcgtagtagtattcaaaccacagcctttgccatcaagcttttgcagatgcttggggggggggggggggggggttaaattcactgtatttgctgatttttcttggttcaccatgaattgttgggattttcctcaaaaagaatcggtagtatttccatcaggtaccggagttatcaccactcaaaatatttaggggaatattatgattcatgagaatttataaaaccttgaaattttctccgttccgtgtgcttcatcttcctctccctctccgcgagccccttgattaggtttcaggtttacgggatagtgccgtcacgggtaagatagagacattgctggggctgtggtggcattgcctcgcgagagaggaagagggcaatggatcagactcctcttaacatttttaggtaatattaccaaagatatacatacatttagtttattttggtaaacacataagaaatcctgctaaaattttgatagtattatcatcaacttaccaaaatttagtaagatttattttgtctacaatctgaatgacccctctatctttaaattccgatgaactatggatttacatgtcagagataaaaacacggtaatttgtaatttagaagtctaaaatggtgcgacgctgaaatgcgggagagatgtgcacagtgggccggatactaggtcaggccggctcggcccaagcctgaacacactgcgaggcccaaagccatctcgaacattccgggtgtttcctcccttcccgtgtgctatcccctccgctccgcggctttctcccgcggtttcccttcctccaagaaagaaaaaccg

SEQ ID NO: 81985 - DNA, 2819 bp, Oryza sativa
cgtttagcagcttactagcttagtatgagattttcactgccttaatccttaattgttaaattatgatctgatcgcacccaggcctcttgaaagctatagttctggaaacatgattgtatagataaatatgaaaacctacgtagaagctgttttttttttcaactgatttttgtaactggttttatatgcacaatggtttggtgcaactgagaaatataactgaacactcatgagatattgagatataaaatttgacattgaacttattttgtgcttctgcctgccctacaaaattgtttctaaactctgaaggttgcatactgagtagcgctgtttaactttggcattctcctttttgacacatgttgttgtagacatattattttagagctagaaaatttattatgttgctgccgttgttgttttgttcttgctatatgctgttcttcaacctcaaccataccgctttacatgttgaaagtttgatttgttcatttcctatgttatgttaaacatttggtggaaatttcattatgtttaaccttctacctgggttaagtgacagaagatgtcgaaccaatagttactccctatctctctttttatagttctgagttacttatttttagttcctaatgcagactcatgagtcatgatttgatctctgtttctgcactctctcagtttgatggaattccgaatttgtttatgttctggcttatgtaactataccacctgttgatggttctggtagctaaattttattcaagttgcatttcattgtgatatgacgaaagcgttcctcaaggtgttggtttctggctgaaaatatgcagatgttggttctggatcttgttatgttgatcttttcctaagaatccacacatcagctttactttgctggtttctttggtttatttcagacttcggatggaatccattaagacacaatctcaaggttctgcctcttctgttccaaagaacccagccatgtcctcttgtcggaagaagaagtctgacgacgctacgttcctcgaagatctgaaagaccatatcgacgagttcatccatgcctccatggatgagcacaagcattgcttcaaaaacaccatccagaaggtcagttgtgctaacactcagatactcggctcgttactctttctgcattttagacttgtttgacaatcaagcgtttcttgcgctctatacctcgcatcgcagatgtttgggatgtcaaaggttgtcgcagagcgttccgctgaagcaaaagaagctgaagtcgagagcgctttgcctcttcagaccagtgtctcgcagtaggatgccatggctgatggcagcttgtttgccttctgttgcctgtgttccgtcctgtggagcttaacaatcagtaatacctgtaatagcagtgaatatggagtctactgctttatgtttccttgtattttgctgtttttttcatatattttgagaacaaatcttgaacaaaatggggtataactaaaaagtctacttcaacaagtgtcgaattgctgatctgttttgctcatgtagcagattcctagtctatcctaaattcctaaccttgtttctggggtcaacaaagaattctgcccagaagtttcctggagctaatgatgagtatgggccgaatctcacgtgggcctgaccatcccatgtgggcccactaacagtgggatactgggtgaggtgtttctttttcatttttgagctgtaccctgtagcctctgctactgtccagctttatcacgcattagccgaaaagccgaagctactagtgtaaactactccatccagttataaatatttgaaatttatggtaatatttggttaaaattctgaaatcttaaccaaatatttataactggagagtgtatgaaaaaacttaggtcctgtttagataggagggactaatttgaggcccttaggccatctaaacagtgaaaaatacccgtataagtgaaaaagaactactcgttatactgctatcagtgaaaaagaactactcgttatacctcaaattagtattaatacccgtatcagtgaaaaagaactactactcgttatactgctcatctccagtgaatttgccttgctcgtttcactaattaatactgcaaaaaagaagtttgaacactggtgatatttctggctttctgcatccaaattgcggctctgaattttccaggtaccttgaaggcgacaggtgcaacgggtttatttaaatttaaacgaactggccgaaatagacgtgatcttgatgtaactaatcaaggttttttgttggaccagtccatgtcgattgtcaaattctgaactctctactttatcatgcctagtcttaatacgtgtattaattaacattgctgcgttgttacatcaaataatcagataaagggtctgttcactttcatgccattttcaactttactaaaaaaatttggtatagttgccaaaaaaaatggctacatttagtttgctgtaaaattttagtaactatataaaaaatcctgttaaaactttgtcaagttgccaaaattttgatatagttaccaaaatttttgtattgccaaaatttaataaggttgaaaatagcatcaaagtaaaaaggtccgaagataatcgaaaaaaaaagaactacttaggagatgttgtcaggaaacaggaccacactgtagtactcctagatggacggtcaaacaacactcaccagttgctgtgggcaaattaatggatttgtgtggattatacgtgtatgtgacttgggatgcgtgtcacgtgtaggcagccaccctttt

SEQ ID NO: 81986 - DNA, 5247 bp, Oryza sativa
tgtttctaggtctttgctgtggaaacagattggcttcctttacacctgctggcttctatcgaaggaagacaggcgtcgctgacaggcaacgcggttttggacgcaagggggcatgcgaccgtgaggattattggatgggccgtccatacatccacctaactagaaaaaatgcccgtgcgttgcaacgggtaaaatattttttattgctatacacttttcagtcccaacccaccccgctatctttctctacttgcctatctttgatgtagcccacaagtggagctgtaggctcagctcgcatggtcggctgtcgtatccaacctccggaagacagttctatgtccgtacgataccagaactgatcattcctatcaaatccggttgaatatttctcgatttcccaaaattggttaaggcgttttgatacactcaacctcctctttttgtttttatcaaaatcgaaacggatctgtaattggttgagggcttttgatatactcaatctcctccttttgttttcatcaaaatcgaaacggatctgcaattggttgagggcttttgatatactcaatctcctctttccggttttatcaaaatcgaaacgaatctggaaaactcggatagaatggtgacttttaaatggtgattaaatccaataaattaaagcggaattgaaagggaaaatcatgtggggaaatgatgagggagtagtggggaatcgacttttgcaatcaattggaggaaagaacgtatgaggaagtagatcgacatagcggcgacgttagggtttcgtccggtgacgaaaaaactgagcagataaaaacaatccttaccagccagacggcggaaaattcatgcaaataaagaacaaatccttactgcatgtgcacgtactcttacgcatgttaaagaacacttaacacgacattaaaaaataatgaaaaaaggatgaaaaagaaaaaaagtcagcggaaaaaaagacggatagaaagaaagggcgacaagaataagacgaaaaaatagggaaaaaagacgggagaaaaaaaggcgaaaaaagagacagccaaaaaaaaggaaaaccggagaaaaaccgaaaaacggagaaatggcaaaaaaagggaaaatcggaaaatcaccaaaaaagaaacggacgaaaaaaacacggaaaccttgtgtatttttatattaggtatagatatagatatagatctgggattggccgctaaactcaggagatgacgtctgctatcagacagctcagatcaaagcaagaccgacgatccaatggctatgacatatcgatgatgtggctgcaccagagggctgctttatagcaataattgctagtagtgggtatcaactatctaggaagaagggattacttctgattttcttgagcagacttagcatattactgtttggcgttctccttcagctctcggcgacggcgaaggtgacggtggccatggctccttagatcgacgatgatgtgggcttcggcaatgacggcggcggggtcacggggcaccgtcgggagagctcgtctacatgccaattgccgtctacctcgtcctcttcgatagtttgctgatttgttgctttcaatttgtacatatattgtggatctgttgtgcatgagcttgggatctatattctatgaatttgtaatgtggatgaaatggttgattttgtgcataagcttggggaatctatcgatttgtgatccaatcccataattttttgaatttgaagttgggatttagatccgttttttctctttcttttttttttttgcgaaaagtaggttttcattggcgggcctcttacgctaacgcctctgataatcagatcttcacttgcggtacctctaaaggggccacctgccaaatgttttttttatagcgggcgtgttccacctatgaaaatcattgattttcacttgcctttgatctctgtaaaatcaaagtgtgtttgattcttattctatgatgaacaattggcatatgtgattgttggttttgatatttggagattatcggcgaagtggttttggagatgattggatttgcagatgatttacaggtgttgctgttgtcgggtccggtcagaccggcgctatgcgagcggtctgaccgaccagcccgcggtctgaccggccgactctatgtcggtttcggtttcgggttgtttgtttggatatccgtggatgtttcgtgtttatggcttctcgatggatactatgtgtatgtaatactgttgtttgttaacaatgagtcaagttggagatagcttggtctcggaatatatggtttctttgtttgattcatgtgtaggtaacttgatgtctcgggagagtattgtcggtgatggatcgggagtaaacttggagataaggtgacgtctggacggtcagatatcatgcgggatacttaggctaaagatcaatgcacgtggttggtaaagattccatatgtcatacgatggagatattgtgtgcgtgtgggatgcggagtcgaatttggaaagactccaaatttggtatgattggagtttgtaaagtttgtttcttgtacggaaatgttatctaggtggattaggacttcttgtatgagtttggttagtggctttaggctaactacctcatgtataaatagagagggagcgtgaggcttcatggtatcgcttttgagagcattgagctgagagtttagttagagttttgagtttagtcgagatttttgtgaggagtgttgttgttgcactttgtaaacacagagagaagtaataaagttgtcatctacatcaagagctattcgatttatgtttgctcaggttcggcggtctaaccggtgagacaccggcggtcagaccggtggcatcacggcgatcagacaggcgggtacatggcggtcagaccagcgacggcgacagggagcagaggcgacttcagagcgatcggaccgagcgatctacaccggtcagaccggcggcgcaggagcagtcagaccgactgatcaacctcggtcagaccgatctacatcgatttgagggtaacttttaattccactaaaactttgaatttttgggtacaccaactattcaccccccctctggttggcttagttctttctatttgatcttacaatctctagcgactggcagtgctgtaacaccccaggtaaccacgtacctagagtgccacaccaaacatacactcaaaccactaactcccaaaattattagaaatttcggcagagtctcccctgtaaatacggacatccacgacaggcaattataagttaaactaataacaatatcattcccaccatacgatccatccttataatccatggggaagaaactattaaaaatctaaaagattattacaagaccgaaccatgatataatttaagtatcattatggacttaagcaatatagtttgatagtatgcagataaatgtgtatataagggtgctacttcccgcccatgcatgtcggtctcaatatgtacctaaaaccaattaaaacacaagagtgagtataaaaatactcagcaagtacaatatggagctagaaaacacatatacacatcattggcaataaagcatgaacaaaaggctttctttctttgataggaaacacattttcaaataccaagtcaaagaagataatagttctcatcccgggcaggcatgaattgaaatagtagtttccatcccagaaaatagtgaatacatcctagcatttgccggcaaagccgagtaagcgtaatcagcgcttacccacaggaacttgaataaacaaccaaattgcactcccatgactacgcatggtacttgaataattgaaaccggaatcaaagaaccaaattgaaaccatattgcacattcatggcaaacagggaacttgaattatttacccagaaccagaatccggaatattgaaacaagaataacatcgtaaacataggataaacatgaaaacctaaatggcgcgaacaacaatatgaatataagcagtcacatgtcacatagaaatatatcggaaataaatagatagagcaaacaatccatcaatcacacacttagttcgtcatgcacttgcctccaatgaagggttggtatcatgcacgatctgaaggaccaccacctaatcacaaataaaacctcagcaaacacattcaaacatgcatataaaacaatgaaaaagatgaacctactgccccatcccatcaaaacgcaataacaaggaacgccgcttgcactataaacaatattgttgcttcaaacctttatatcttgaaatatgaaaaggctatgactgcaaataaatatattttagaaatctacagaacaaggcctacaactcttatgtggaaatcatatttttattatgccattaaaatggtctaatttgcgcttgaaagcaggcttcacaatctgtccagaaaattcagactatccgcactaaaacaatcataactggagttctacttgcccaatcagggtgtactttaccaatatggaaagctaagaaaaacctctacaactttgtctataggcgtcttggctgttccactgtttagcccatccaaaaacagttcaatctactactatccagattatggcataaaaacaacagttatactcaaaaattcgtatcgtctaaaccacttgagataaaatcgcgccctttggtcagaagatagatataaatattatctacaactttctagttatacactttcgcataaaatatcatttagatctccaaaacttcaaaaaaccgaaacattgtaaatctgccaacgtgcaaaacagccaattcgaaccacaacaaacaaaactccttctctaaccttccttatccacgaattaaaccactaaaaccaccctagaacaactgatatgacaaggggaaaaacctcacctagggtttctttagagaacttgtgagaagacaataggggagactctgatctaatccctccttttactcccctcctcctcctcgtttcgtttttctatttcgctttttgatccaagctatgaaggtggagatctagggagggcaatttgttgtagaggggagagatgcgaacataggagaaggggaggaaggaggtgccggccagggagaggggtggcggcactatgaggggaggtgggagtcgggtcccctctctcttggttttagggagaactaatgggctggatgtatgggccttctcatgttggcccacttct

SEQ ID NO: 81987 - DNA, 1841 bp, Oryza sativa
atgatgatccctatataatttatgtgttagcattaactttgaggatcagcttaacagtacagttagccttgattagggtcatcactcatcactaacatatatgtattatgttaggtcttgacaaggagtagtttttctagaactccttgataagagtcactccgtccttaagaaaaaactaacctagatatagacatgcatattttttagtacaataaatccgaacataaatctgttaagattcattatactaggatacgtcacgtatttgtggctaaggtttatttttttgggacggaggaagtagttaattacatgtagcgtttaaaatttgtcttagaatatatatatatatatatatatatatatatatatatatatatatatatatatatatatatatatatatatatatttgattcttcaccaacttaattatctgactctaccaatcaaaagttcataataatcttttgtttaatttctctacttatttttatcttaactaatcacaaccatcctttatttaatttattctttccttaattaaaagacatcctctatttaatttcacgagtataaatcaagcgtaagcaaccgaccaatcatgtgctcaatgggagtcaactatggtcttagatcagcccactaattaaccggacaccacatcatcactcagatgaatgtattataaggccattcccaactcaatgaatagaattgtgttcatagcattaaataagctgccacataggataaaaaatgatgtgacaagtgaataaataagaaaagagaaggaaaccatgtcttgcatgagatatagtttccacacaacatccaagacatcatgtgagataagtagtattgaatttaagtatggaataatggtgtttgcattggaagagtagtgtatagtactagtttcttgatgatgtggagtttatagaaagtatgagtgtcttgggttgggaatggcctagatggttggcagatgcttattactactaactcctatcataattcgtagcttgtaagtaagtacctatgcttagttgtagccaaaataattgatgtacttatcaataacttgatgagttcatgttaaggaaatgcagctcgatccgatataaatttgtttactatatattgtgtcatcattggctacatgcatgcatgtgactgtacttggggttaactgttactatattaagttcctgagtacatgtgcatcaatgcatcgtcacttgatcagcatcaaagaggagcgacaatacggcatttcggagcacaaggacacaataagatcattttccatcactaaaagttaagatccaatttttttgcttctctttgttttttcaattgtcctgcctgcagcattccttccaattttatccgcgtgttttgacattattctcgtgttcaaaataagacatcatcagctaaatcattgagaaacgagtggttatatttttttttcttttgaacaagctaccaaacattggatgtttttgttagaaatatgaagaacaccttcatatatacacgccttgtcatacacaatcttggaaacacccgaaagttttccgactagattcataaggtagtgggcctagccagtctggattcgaagcctcaccccttctgtttatttgatattagattattctttaatatttgtgttttttttatcatacacaatctcaaaaacgtgtgaattttgcggtgtacgtatatatatttatataagacacgtatgccaggaatatccactatagtacggaatagggctagtagagacagttcagaactgccaattaataataacaaatttcgacctg

SEQ ID NO: 81988 - DNA, 564 bp, Oryza sativa
gtgccgtgccgggcggcccacatggtctatagctgttcctggatttttgacaatctggcccttttagaaaaagcttaatgtatagatagaccgctgaaaggccttatccacgaaaacgagcttttaggagggtctatttacaaaataagttttctaaaaggggctagattgtcaaaaaccaaagtcttcccgttcccctcggcgtcgactcccccccaaactccgtctcctcgcgcgagttcgcccgccgcctgcgccgatctccatccggcgaggcgccgccgtccgcccggctgcttccgccggtaagcttccatcgtcctcttcctcatctctctctctacccacgcgctctttctgtttttctcccctcgaattcgcgtgaaccctagcttctgttctagatctgggaaggtttttttttctctcttagtttgcgttaaatttggtactaatattgtcacatgtttgatcctcccctccccgcccctgggagctaacgcgtacaggacagtttgctatcgaggggggaaaagttgggagaattaagtaataattccgtag

SEQ ID NO: 81989 - DNA, 5292 bp, Oryza sativa
tttctgagtacattaggccaaacagagtacagagcaccagtcaggcctgttttggcaagatcatgaacctgaccaccagagagcttttaagtgtgatcagtgctcggatacgctcgactctcagttgcgtaagttccctggatctcgtggccactactggttgtcgggagacgaaggcctctgcttctctccccaccaggcaccaggccaccaccggcactgtcgcactgagccattttctctgtgagaagtgaaacgctcagaagtgaaatggctttgtttgaaagagcttttagccgctgtaacttcttttaaaatccgtagctccttcaacagttcagattttcatcaaaattctgagaattgatagatgtaaaacatagaaataaactgaatgtcaaaaggtagaaagcataacttttcagattttcattcagcttcttatcagcatcttgaactacccataggtgccatttccactagctggccccaaccgtgcagtgatgattgtttcattgactagtttgaacatttgttgctccagccactgatctggccgtgtgttcctgttacttcatgcagtcgctcaataatgcgtttatgcccatgctagtctgatagtagcagtttcctagtgctagtggctcccatgattacgtcgtaatctatcactctccctcttgctttgacaagtgaaatctcttgacagactccatccgtcccctaatataaagaattttaacattttgcttgaccacttatcttattaaaaaatttaagcaaatataaaaaacaaaaagttatgcttaaaatactttggataataaagtaagtcaaaaaaataattctaattttttaataagacgaatgattaaacagtacaagcaaaatcccttatattagaggatggagggagtattaaggactcttttgacatatttgatgtttagtccgacggtgtgccgtttaccattaccgcatgttagcagggattcagattggatgacatggggtgaatcttggccctccgaaacaaatccaacggctgagattcgtccacgtcatcatgagtaaaagttttactcctagttaaatttttactcctgagtaaatctgcgagtaaaatgtttactcgtgatgacgtggatgaatgtcagccgttggatttatttcatagggctgagattcaccctatgtcaccttgtgacatgcctaccctatgtcacccaatcccaatccaccttagcggtaagcacagttactatggtaactgggtttactgttagggtaggggaatgttaatcgcaaagtaacccttccaaattttgaaagataatttaatttcttgataaaacttgtctatatttttcacggtttgttgtggttatcacagttatgaactattaactgtgcttattgtcaatgtctggcaatctagccatagccatacggttcaaatcaaccgtacggctatggctagatttcgtggaaactgttgataaaactgataaaaacagatgatatccgaacaaatcttgttataaaaaataaaattcaatttgttttttgattgactagagaaaccgagttgtttgtattttcaacccggttttttgtaaacccaaccagtgcctcgtccattgtgagaagaaaacactaacggtgtgacagtgagtgtttatatcattatatatgctgattatatggagaaaattgatatttagccattctcgggttagggtttcgccaaaatgccatcgccgaatgtggcttcgttataatgccatcttcaaacgactccatcttgccacactaccaatctaccatttcaaccgattttgattatttgcaaatgttttccactgttttgcttatttggtttgacccaaatgcccttacctcagccatggggcccacttgccaggagcgtcttccacctctgcccaccaccatccttctctctctggtgaactcatgcaacagtgttctctcttgacctccctcctcggttgttctcgccccaaattgaatgcaaaaatcggttcctcttgtcctcatcaattcccccaacaaatcccactcaaatcagcgtaactccgtggtgtattttgaagtccgacttgaatagcaagctccaccatgaccggcgtcgatctctctccccggcgaggttggagagcctgctcaagcggctggacgctgcgggtggagcaggtcgctgcccacatcgaggagctcatcagagaagggggtgacgccgtggcgcgcggtccggtcgagcacttggtgcgccgtgccgccgagccgaaccgtcatctccgtctgcaccgctgccttcccgtccccagccatgccgccgcgtcgccttccctgttcccggtcgctgtcgccaccgccgacaacctgcgggtgaacctggtgagctatgttgtcgagctggtgaatgcggcgaagggcaaggtgaacatggagtacatgcggttggtggtcgacctcatggtgaagcgcggtcggccgaaacttcacgatggttcgacgtggtgaaggccaggttcggtgacctcaacttcgggtgggggaaggcggcgtatggcgggctggcgaagggcggggtcggcgccatttccggtgtggccagcttcctcatcctgtagcggttcggcaacggtcccgagctgcgccgacgccgcccaccatctgcaacgaagagaggaataggtacagagagatgcaatgggaaccaagggtattttggtcatcttagcaagaaaaaaatcattaaactgagaagagatggatgaaataacattgcaacatgttgcgtctgtttgaggatggtattttagcgaagccacattcggtgatggcattctggcgaaaccccaacccgatgatggtaaaatgtcaattttctcgaatatatgggccgtcaaggaagacctcgaatccacggcccatgacacgatgggccctctcaggtgggtggcaatctgttccatcttctccggctctccagtgtgctctcaacgggaaacaggacacaggcctttctttgggaaacaggaaaaaaaatgctagaaccagctgcaatatcgcttaacaaggtatattggtggatccatttcatcccactttatgaccatgcaaattgtttaagacattttctaatttacaataattgttgggcgatctgccatttatagatcgtcttaaatcattacatggaaaatggaacacctactttcgcagcttcgcttcaacagatcaatgcagccagggcgtcattttgtttaccgatggacaaggtgacatgggttaatcctacgggtagaggtgacaaacggtgaaatcttacacgtgggagaaggagccaccatataaaataacaaggacagtcaaatgaaactggtaaaaaatatacactactatattatatataagggcagtagcaatgcaaagctacgtcaatgagaaacctcatattgccaaataggatgaagcaattcagaaccacactttccatggtgcaagcagcttgctgtgtgacctaagagtagatatttgcatttcagtccctattacctttaaatttacagtagtacaaaattttacactcaacaccctaaaatctacataataatatataatctctccccagtccccacctaccgccgatttctctcctctccccacctaccgccatctgtcctcacactcaccggcgccggcgcaccgggtggggaagcctagaagggcggcggtcgaggagctccttgggcggcacggcgacgagctccctggcggcaccggtcgctgcctctctgtcaacccgtcgacgacgccacctccgctcgagatccgccactggggcgatggccggcggcgtagagatccacgagcggtcgtggcaggcgacggttgcggtcatcgacgggctgacgggagggaggcgcggtcgtggcgggcggcggtggcggtcgtcgacgggctgatgggagggaggtcggcgacggcggcagtggcgcggtcgtggtgggccccggacgacggccacgcttggcgccatggctctttgttcctatagcgagatgcgaaaaaccaatcagagctatgaggtctacttgctttttcctccacgtagacgaggtaacgcgccatatacttgcattgtgaaagacctaaggtaccaatcaggaggcttatgtacaagagtgaaattcatttgaagcaatcaagaggcttccaaaccttcatcaatttttttatttcttctaaaaaaagaggcttccaatatttggttagttaatcgactgatcaaaccaagaagaaaataacaaatgaagcctcaaccttaagttcgtactggattgagtaacctctacaactatctcatcaatgaagtagtttccggcaaaattaatgtgaggtcgtttcttgccctggacagtgcacatactgatgatacgttatagatatattgactggatatctttatctttacctactataaggaaggccctacacgtcgggcgcccgatgcttcgggggaaaaatcgggcgctgacgtcagcgttcgattttacgtgcaaaattactttaaactgatttatctcttaaattacttatccaaatcatgatccaattgcaccattaaattcgttgcaattaaatcttcaaaacaagaccacacatggatatattttgacgaaattttttttagcttattattgaattatttttaaacattgcacgatgttccaccagatatatcggaattgtttcactaagtagatcgaaaatgtttcactcatttaaatcgggtgttatttcaccttatataaaaacaatgtttcagcaaatagcgaaagaatgtttcagttcactacacattagatctatacatagtgaaacattatgactacactagatgaaacatttttcggtggaacaaaaaataaaccaaattccattaatagggggtttccaaaatatgtgggttttttttgcaatggaatgtttcgttcagtgcaacattagatctatacatagtgaaacattgtgagtacactatgtgaaacattttgggtggaacaaaaaataaaccaaattcccttaatagagagtttccaaaatatgtgggtttttttttttacaaaaaagtattttaattcacagcaacattagatctataaataatgaaacattgtaaatatactaggtgaaacatcttttatagaaaaaagaggagcagaaataggtgggcccaagtagtcacgtggagggagggggcgc

SEQ ID NO: 81990 - DNA, 2244 bp, Oryza sativa
  unsure (1)..(2244): unsure at all n locations
atgatgaagatgcagtccttggcaagttacacctcaccaacgataccctgaatttcaataaaatggagaacacaaatggatcaaatagcttgttctaatatgcaagatggaacacataaatattttgtcaaatatcgattgttttaaaactgtagtaggaaaattcattaggacaaattttatatgtctgccactgttcatgcttatgctctaccaactgccatttcgtcgcctccaatgcttacaggctcatggaaatcgaactatgacaatttgaaggatgtaaaaaaaaaaagagaaagaaagaagaattagaatatggctagagtttctccaggctctagtagtagcattatatcagaattcagattcttcatacatgtattttttttcctaagaaaacaacaaactgaaaactatgatgttgtctcatatattctttaaaattaatttatttatttttgtgcatgggtgttggatttgcctccaattttagtaagatcaaactaacaaaaagttcagttatgcctgagaaaggaaaatactaattttagtacgatcaaacgaacaaaaaaagtcagttatgcctgagaagggaaaatactctcgtttaacatagacatcatcagatcagaacaggttatcccccagatctcagtaccttcagtttgttcttagcgcatcatcagatcagcacntacactgtgccaaaaaaatttgagctaatcccagttttctttgaacaaggttaatccctcagatctcagtacctcagttttgttcttagctcatcatcagatcagcacntacactatgccaaaaaaaaaattgagctaatcccagttttctttgctaactttatctgacaaataaaatgatctaaactcatatcacagtaataaaaagacccaacttaatatcaaactttaaatcctaaaggttttaaacctacgacattccaaattttttatcaaggttttgctaccttaataaattttactgattgaacactgaatgtctagatcgtacttcctttcgatgcatagttgaagccaatactactcaatgcaccggtagaaagtgtacattatagttaaaatgccagctcatgatagtgtataaagagatggggatttcggtgcattcacgtttgggagggaaggaaccgggatataaatttgcaatttgcagtgaataaacatgcattaattattggccccggcattaccatcaatctatccagtctgcaaggtgctctaccattgttagactctcgtagtctcgttcccgctgtcctgcacacacgcaaataacaaagaaaaaaaatcagagaatggggattagactcaaggaatggagatcagaaaggaaggaggcggcggtcaatggcggatggcgtgggcggagaaggctgcgaagacggcggcgcggtggaaaaaaaggggacggcggtcaatggcggatgaagaagcgtggttgtcgtcgacggagtgtgaggcggagtcgggcgaagacgaacatggcaagggagtcgcgtatgagatcggggcggcggccagtggcggatcggagaccgcgggatccagaggatctcaccgtggatgtttgcggtgcgacgaatggagggcacgacgaggaggcgagatggatggcgacctgacggtgatgaatcgacgtatgccggtggcctcagcggcagagcggtggctgaacggcgagacgacgatggactaaaatgggggggcggggaggacgctgtgtcggcgacacggtgggggaggacggcgatgggcgacgcggtggaggaggtcggcgatggcggcactggggttgacggcgtggtgggggagcgacggcgatggcggcgctggggtcggcggcgtggtgggggagcgacgcggtgggggagcgacggcaatggcggcgctgtatcggcgacgcggtgggggaggacggggatgggcgacggcggtggatgcgatggatgcggccgcggcggtggatgcgatggatgcgggcgctaccccccgatgcgtgaggatgagccgaggagttgggtggggaacgttgcgccgttggatttagcgatccgatggctcgtactccgcgtatctgccagggttggagtcaccgcccccgatacgaaattttaaaatagtagagatatagtaatatttttgacccaaaacaaaaaatattaaaatatatttaatgttacatttaatgaaaccagtttagcgtaat

SEQ ID NO: 81991 - DNA, 19612 bp, Oryza sativa
gcccgatccagctccccccgcgccgggcgaccagcaaggagcatttctatacctaattaaaaaataagtaaggcttccggttgatttttttgtccgtcattaaagagtgggcccatgtgattatttcgcggctaatctgtgaatccggatgcattacggcgatctctgacgctccgaaaaaaaaaagagaaacgaaaaaaagaaaaacctagcgagcagcccagccaagacggcagcaggccggcccaacataaagcaaacgcggcccagcagccagcccacagaacagagaagcagcagcccagtacagcatagttatgtgtgatactatctatatctataactaatataaatattcgtattttgttttcgtcacatctaattttcgtccgtacacaatccgatttggttagcaatagccatggaaaaaattgcaaaaaaaaaaaaatccgccgcaccctgtcatcgctacaccgtgccggcgagacaagaaggagagagggagagggagcgcggacgtcgtcgacgccgccgttgggagggcgccgtctccgccgcaccccgccgtcaccgcgctgtgccggcgagaagggagagagaagagaagggaagcggtgctggtggggggagagacgacgccggtggcaggggaggcggccggctggggggagggggagaggcgggagagggggagagggagcggcgccgccggaggggaggggaggggaagcggtgccggtggggagatggggagggggagaggcggtgtcgggacgggggagagggaggcggccggcttggctcggctgggggggagggagggggagggggatggttagggttagggttctcatcaatttcaaactgatctgaaccgtccatcaaaacgaacggctgagatcgatcgagggtttgggccgcaccacttgggctgcaccacttgggacgcacacgggccggcggtccaccaagtgagaggaggagtatgggggcattaagtagactttggtcgcttgcgggctgaagaagaaaatgggctgaaaaaggctcatagagaaaaaataatttttatttaaataaatgctgaaatgatatttgtattatcaaaattagcaattaagctatgtaaattccaagaaaatttcaatgaatgtaattaatatagaaaatttaatccaatcataacattttatttctcacacttactctacttataaattaatttaattatatacctactacttaaaaaatacctaaatatgtcagaaattttgtatttcatttaattagaatttaatatgttttaattcaattttatcttttttcttttcgttgcaacgcacgaacacttttgctataatttcaaagagtgtaattaatattgcagaaaatttatatgtcattaaattataattcattttcttcataaaaatagttcaaatcaaagttcagtcaccatattattatccggtgcaacgcacggatattttgttagtccgtataaagattgaagatgtttttgctgtagcttttggtacgtcatccgaattaatctccgtgtcgagttgtttttcgcgttaatcaccgtttccgatttcgcattggatcacaacgcgtgatgcggaggggtgaagatcgcatcagacgtgcttgtctaaccgaaacgggcttgtgcaacatctggtcctgccggtttgatgcagagccggccagcccattaacagcctaaccacggctttctctgtgtaggtcctgtttggtcagtcaaacaaatctatatacctaccggtatttttttgtccattgtttttttccgtatgcatttttttcgcacggtccagctttttttccgtccgaccggttttttttcgcacgtgcacgcggttttttcgcagggcccagtttttattctgtccgattggtttctttgggcccggttttttccggtccgaatggttttttcacgtggttttgttttgccaggtttttccccatccaatttttttcctttttttccatcctatattttttccgataagtttttttggtgtgcacgggattgaatcccaaatctatatatataccaaatttctactattataaaaattaaaaatgtttcgccgatactttggtatgtcgtccgtatttgagtcaccttgcatgctaatttgggacaaaagtcggactcctaattaatttacaattctcgccagaccataagaaacttttgcaaatacataaggagtcgtataagaaatcattttaaaaacctaacatgctaacttgggacaaaagtcggaatcctaattgatttataattttcgtcagaccataagaaagcaacgtacaatatatgatcaatactatcaaaataaaaatccatatacttttaagaaataaagtctaacaataatacgattaaaatagccttcacccgttgcaacgcacgggtattttttctatattataaaaattaaatatgtttttaccggtattttggtatgtcatccgtatttgagtcagtttttaagtttgttcgcttttgaaaaaatatagatccgtgttaaagtcagattttaagttcgtttgtttttaaaaatataaaagaagtcgtacaagaaatttctttaaaagaacttgcatgctaacttgagattaaagtcagactcctaactgcaactcatgattttctaaaaaataaatccaagcgaattcctaaatgtcatcctatctaaaccgtataacaataataatattaaaatagcattcacccgttgtaacgcacgggtatttttttagtcaagtttaaaaatatatctttgtatatatgtgtataggacaccaccacctaaggcttcttataggtaggtctatacctataagactataaggtataagagagtatataaatatttttactttcgcatgtactggagcacacaattaccaaacgtttgggcccgagagcacttaatttcactagaaacacaaaagcccacgtaaaacatcacatggcaaagtatggcacatgctgtccatgcgaagctcccgttccacctcgtttagtcccacctcggaaaactagcttcagacagcgcagcttaaatagcaagagcgtcccaccacctccagccgagctcagcagcgcgagcttgtaacccgagcgggggcattaaggtggtgtggacgttgccgtatggctgcgggcctgggttggcagtgccatagatggcccgcccgttccaagttgcgtagttgggccggcggggcttgagcgaaagctctggcctcacgtttccctagagtggcaggcattgcgtgaggctggcttcacagagcagcgaatactgtccgcttccaacggtggaaggataacgggccgccgcactgctggcccgcttgggtctcgcagcctactccaacggaccaccactttttttattattattttcccatcttgtttgcctgaatttacctctaactgacttgctgccacgcatgtaggccgtctttacggatcatgaacacgggtattcttgagcggtaaaaatccaacttgtatgtatttgtacacttcattatctaaaaaagaatgtatttgtacactttgttgtaaacaattcgatggaacaaaaaaaaactaaagctggtgaatttgtcgttgaatcaagtcctttttagtttttttttagttttgctgattgaagttctctgttaggcataattggagcttatgttgtttttagatttaatatatttcaattgttgcacagactgggatcgcagggaaacataattatttatgctaatatagtaaactgggttaacagcaaactgaaagcagcgggaagaagatctcaaatggaaagcttcaatgtgttcttcctgtagcctccagtctcaatcatttaaatactactccctccgtttcacaatgtaagtcattttagcatttcacacattcatatagatattaatgaatctagacatatatatctatctagattcattaacatcaatctatctagattcattaacatcaatataaatgtgaaaaatgttagaatgacttacattgtgaaacggagggagtaattacaaatttatactcattcttctttcttgatggaaatgccaagtgtaatacaggcagagcagcagtagttcatggagcaggaggcgtcagcttattgcccatttttctcttgttgctgcttgccgtcgacacgctgaagctgttggtgttgtcgtttgactttttttaacagaaagaattttatttaaaatgaaattatacccggcctctacatacatcctaggactcacacaagcgaaaaaaagaagaatatcctgagacaaacattaatgtatcatgtcatcagatcttctagtctctgttgccaaatgttgaagaaatcagacaaaaaaggagaggcatcattgctgaaaaggggatcagcttgcctactgatgtcaaaagaaaccgtgccatcagctcatcatccagcttatgttgttcaccagatctcttataattcttgtcaccagatccttagaccggcgaggagaagaacatcatagtttctgaagtcctgcactggtgctgcgccacaagggacacaagcaaaccttggtggattgcagaaaaggtgtgatttagcgatcagttccgtagttagctctcataggataaaaagtgatagtaattagtaggcaaaattggttatatagcatcgaaagttcacgtttttggttttatagcaccaaaagttaccggttcactttaatagcatccaaagttcaccctgttaccatttttagcacttccgtcaatttttctatccgtcttgatcgttattgatccagtcacacacatgatatgacatttctacctctcattgacatgcattatacttgtacttgtgaggggtagaaacgtcatatcgtgtgtgtggctggatcaagacggacggaatcctccgtttcacaatgtaagtcattctagcatttcccacattcatattgatgttgatgaatctaaatatatatatatatctatctaaattcattaaaatcaatatgaatgtgggaaatgctagaatggcttacattgtgaaacggagggagtacatatttcaaacatagagaagatgcattgctactattataagtgcttaagaaacaatggtcagtaaatattcagactgaagttctctaagtttcagatatgacatacattacttagtaagcttctcttttcgcaaattttctgtcggattgcccgagtaaaattttcttttcttttatatttttccaatgacaagtagtactcgtacttagtgaggttagaagtagactactcttatgttcttacgatgaaaagaacttttaaggtataatttagtgattgtatatacaacatattgtgtctaaaaagttctcaataatcaaaccgttaagaatcggaagtacctccaatcagggggcaagttcatcgtggaacttcatggttggtttaggggaggccaccgccgagagccagagataaaagatggtgtcaccagtactcccttcactccaaaataaattaatctgatacaaaataaaacatcattgaatataatgaatttgaacaattattctattatctaaaagaaatgaatttggacaatgtttagtgggcgcaagaaatctgaaaaattggcttatactataattagctcggaccaaatatcgtgagcttttcttttcctttttttttatagtttactcattctctattgaataaagttggtagcttgcgcattaaaaaatttagacaatgtttcgtcttacggactaaggctatattcttctcccatcttttccaactcacctctttcatgttccttgcacacactcttgaaactgctaaacggtacgtttttttcaaaaggtttctacacgaaagtcatattaatataaaaaaatcatattaatctttttttaaaataataataataaaaacttaattaatcataagaaaatgcgtcgctctattttgcgtacgcgggatgtgagttcccaacctcacctcctaaacacattctaaatttgtttctcctcttccccctctcgtgctgggatggatagaatagtcattaatgaaggttgaaactaagttttctagtttttcctttttgtgtttgtgtatattgttctgtgtgaggctcggagtctaaaaactcgcgcatgtttttggcagtatatcctttgacatatagagaccgaattaatgaaaaattcactattaaaagtttttagattagtttattttaggataggagtggatctatagttagcgtcagctttaggcgacccgacgacttccgacaaaaactatgattatacttattcatatattataatgatatagtctaagtataattagcatgtcatggtatcgatagatctattataataccaatgaattaatttctatatccatcattgttttaggagatagaggagaactgatatgaccgtggcagagaggaatggagctgggttgatgtggatatctccgtgatcgctacaccaacacctccaggttccgtactaccgtccatgtgccaaattgtggcgcaaaaccgtaccactcggccactccggctgtttcccgaacaaaaaattgtggcctagcctagcgtcaccctcaccgtcctagaaaagccttgcgagcgagagagcgacacgaccccgcccggccgcccctactctcctccccgcctcaccgcgctgcagcacgcgcgcgtggacgtgtcaccccgctccgctgcacgtggccatagccctcgctggccacgcgccccccgagccttccaggcgcgccgctctgcgtacgtgtcccctcctggtagagaacggcatcacggcgcgccgcgaattataagccgagcacgagcacgagcacgagctcccctctcaacgccagggcaaatgttacatcgcgcctcgcgtctttacccctcatgtactcgcttcgtttagctagcagcggcagcacgggactcggcttcgcgctcggccggctcggcgggaggagtggcggcggcggcggcggtggtggtttagcgcccgcgtcggcgtcgtcgtcgtcggtggtatccgctcgcacgaggaggaccgtctccgtgacgcccaacgccgcggcgccgactccgggcgagcagggcgtcgcgatggagcagggcaagcagcagcaccagccaccacctccgtcgcagccgcagccgcaacatgaaaaacgcggctcccgcgacgacgacatgcacaagaccacagggtacgtacgcacgaatacactacagttttggcgtgagcggctgcgtgcgccggatttaaccgtggcgtctgcgtgttcgcgtgtgtgcagggacgtgatgacccactctttcggggagggatactcgacgcggtcggacgaggaagggttcggtggcgtgtacggacagaacgacccggtgttcaaccctgggaccgaggtgcaccccagccaccctggtacgtgcactgctgctagataaaattaacgaatttgctatatatttatcgataaatttcctcaaaaaatttgtcaagatgcaattacagtacaatcgtagtgtaattacactgtaacttgcatgtaattacactgtaactataatgtacaacttgtatgtaactttcaacaatctctcggtaatatgttatttcagtaaaatagaggtcatggaaacaaatccttttatatatgtgtgtgctatgattttttttcttcctcaccagaacaaatcttgtaatagatctaacgattcaaaattacgtgaaacttaaatacaagttacagtgtaattacatacaagttacaatgtaattacactacgattgtactataattatatctgtcaaatttttagtagaaaatttgtcgacaaatgtataggtagtccctaaaattaatttgacacatccttaaatatccgtcttgaaaataggtacattaataaacatatccactacgaatcttgaatctggaaggatgtctaatgaaggatgtctaattttgtttcgagtaattttataatcttgagaaggtactgtaacgtatcaaaaattaaaatttagtgtaaaatttgatctctttataattttacaatagaaaagtgatacctccttgaggactaaaattgccttttgttttggtttataccgagtagttgggaacagtggttacaggagggacgtgaacttaattattaatctgaaaatttggattttgatctctgttttgattaataactggggttgctttggttgtactgcgatgtgtgcagagtacgacacgtcgcaggggtcggaggtgaaggagaaggagaaggcgcgccaccataaggacgacaagcacgcgacctaagcctagcagttgggggctggattaggtcctaatcgtagtttagtcgggcatgacggggatcacccccatcatcacctgtgcatccacgttgccctatctttgatgggcactagttgtatcttttgcttctgaactgttttgatgcatttgttttattccttagatgtgatgtaaaatctctacagtacttaattagctatgtactggtactgtgagttctccagcgcttgtgtctcctggtgtgtgtgatcatgtaatgatgagtcgattcatatatatactccctcctcctccgtcatcccttctataggattttcaaaaaacatcccttctataggatttgtataataaatctgtaataaaagagattttaggtggcttggatatattctgattttaggtggattggatatattctagtataattaatttaggcagatagtttttaaatttattgtatttttaaatttattgtattgggacgtgttacgttcataaaaatcccttataagatcgaaacggacataccagatgagctacggcagattcacaaaaatcccttataatttaggcttaagtgcgctccatgtgaggccgccgctctaattcgaccgacgactctttagggctcgaagcttctgtatcgtgagccttttgggaagggactcaaggagtgatgggctactcgctatattcttctcgaaatactacatccatactaaaatgtaataatttttagctaaacgtataacttttagttataaatctgaacacataattatctagattcatagctaaaaatacatattcatagctaaaataattaaatgtcctaaatgtaacaacttttagctatgaaacttttagctatgaatctgaacttagctatgaatctgaacgtgaacttagctttttagctatgaatctgaacttagctatgaatctgaacgtgaacttagctatgaatctgaacgtaaagttgtttatattcatagctaaaaatacttaaattttagattttaggacgggggagtaagtcgttaatgggcctctatgacacctaagaagcattttcttctcgaaataagtggtgtttggataagggactaaacttcagtaccttactctggcaatccatgtttatgtaccgagagaaaaaaatcactgtcacgcatcgaaagtttggacatttggtctattaaatatagactacttataaaattaattatataaataagagctaattcgcacgataaattttttaaacctaattaatctatagtaagcacatgtttagtgtagcatcatataggttaattatggattaattaggctcaatagattcgtctcgcaaattagtctaggttattgtcggtgacatgggaccgggagtatcatgactagagccttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgcggtttggacgagcgcgtcacgccgcatgtaacgcagtgcagtgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctgacactggtcatgtcgtcagcagacagccatgttcccacgtcgcgcttgcttccggcggaagtggaggtaggtatgggccgtcccatcagaaggtcattcggacggcaatcatacaaatctccgtccatttatgaaaagataggataagtccccacaaaaaagagagagatggtgcatgtggtatccccttgaggtataaaaggaggaccttgcccactgagatggggactggacttttccaaattgggaacccagaacaagggagaggctggctcataccttgtagctccttcatacgcagatcacccaaaacacaggagtagggtattacgcttctcagcggcccgaacctgtatacatcgcccgtgtcttgtgtgtttccggtctagcgaaccttccacatacagagagcttagaatctcaccctgagtccccggccgaaccggcaaaggggggcctgcgcagtctcccggtgaggagcctcacgctccgtcatctggcgcgccaggtagggggctctgcgagggattttctgagctctcgcactctttcgtgtgcgccaagcttttcctgttcagcccaatggccgagccagcaaaggcacacgacctctccccgagtatgagcggtgacgacggggagccaaacccacgccgtcgacctcgtactccaccgccccttccacgccaaagtcctaggcgggagaaggcgctcgagagggctcaaggatccgcgacttcgacatccacaggaggtggagaagggcggcgagatggggagcgtcgcctcctcatctacggcgacggcagcacgccccagggcgcgctccaagctgcaggcgcgctcctacatcacccgcccgtcgcccatgacccggagtctccagcccaacgttggctggacgatttggccaaattggtcatgactgcacggcagcgcctagatgctggtgggcggtcctccgccaccaaggcctctggtgctgctaccaccggctccgcgtcgtcaagacggagggcgcggcgagcggcggctgttgctcgccatttggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttccaaggcacatatccgcgcccaggtgagaaagcagacttacatgcagtccagcgaagggatgatgagtcacttcgctcatacattcagcggttctgtcaagtccgcaacaccataccatgcatccctgcacatgcggtgatctacgcgttcagggggggtgtgcggcacaaccgcatgctcgaaaagatcgcctccaaagagccccagactaccgcggagctttttcagctcgcagaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggtgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacctgcgccgtttgaggctgggacctgggcacgagcccttgttcaagccaagacacaaaaggaccgtggcacagaccatcctcgtctcatacacagaacaaatgaaattgacacaaaaatttcctctttatttgattgcagattaaatcagcctataacaagaagaaggcccgaaggcctcggaagaagaaggaaaagaagaaactatttaaagattggcgggggcctgggggctcactccgatgcacccgggtcgccagcctcgtcgccactgtcggttttcccttgctgatgtgcgcgatttgcgaccaccgggattctgcccgaagagagagagagcagggaggagaggcccccgagccgaacggcggcccaaggcccccgacggccggagctggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctttcggatggagagcgccctggagatgtggcccctgacgaagaagatcggccccgccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgcagctgcctcacaccgccctctgggtgatgtagttcgacggcacccgtaggaaccggccctacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgtggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctaacactggtcatgtcgtcagtagacagccatgttcccacgtcgcgcttgcttccggcggaagtggaggtaggtatgggccgtcccatcagaaggtcattcggacggcaatcatacaaatctccgtccatttatgaaaagataggataagtccccacaaaaaagagagagatggtgcatgtggtatccccttgaggtataaaaggaggaccttgcccacttagaagggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgtgaaccttccacatacagagagcttagaatctcaccctgagtccccggccgaaccggcaaaggggggcctgcgcggtctcccggtggggagccccacgctccgtcagttatggaataggttttttcaatagtctacatttaataattctaagatgtgatcggggctaaaaccttttaatcccatctaaacagcccctaagtctggttgccaaccgtaatatcaaaaaattaatttagggtgtaacttacagaatcatattacattcagtcttggataagaaactatctttgttcggtcggccaaaaaccacaatagttccggttgcaataaaaacccagactaaagatggtttttagtcccagtttataagcagaacgggactatatgatctttagtcccggttcacatgttgtcatgggctgtcagggctctccgggatctttagtccctgttgaagttaccaatagtgtatccgagatacactactggagaccggggaggaggggaggcagcggcggctgcgccggccgtgggcatgagaggaggacgggccggcggccggtagcgccggatttttgtcctttcttttttttaagaatttgtgattcattgtattgaaatgaagaatttgtgattcattggatggattgagatgtataatttcttttttgagaatctgtggtctgagatgtataatctctgatgtattgagatattactttgatttggggtttgattcggggatatgtatctcactcgatttgagagaaaatagttagggattaagtagtaagtatcaatagaaacaatgaaaaaaaaagaaactaaccggaactgcctctgccttctttagtcccggttggtaaagatcgatctttaatcccgagtatttgaatcggggctaaatataacgatctttagtcccggattcatagtcccagataaaaaaccgggactacagagaattataaactgggagtaaaaacgatctctccacccgtgatagctggttttgctagtggcatcctaaaatgaaaagaagaaaaataaaaaacaagtagaagatcaagactcaccttcttctactctccaactcttcccctcacccccacccaccccttcgcccactcctccctcttcacgccaacaagttgcacgtagatcgttaccaacggcctccacctggggcacctgttccatcgatcccgcattgccaccattactgcaagctcgagcttggcaatcaccttcccaagtgcccgccgatcctgcatggctgcatcgccaccatcactgcaagctcaagcttggcaatcgccttcccttcacacgatagctacggaacatagctgccgatcctgcatcgccttcaccacagctagctcgagcttggcaatcgccttccctttgcacgatggatgcggaacaaggaaggatggggacggggagctccacccagatgacagtggcgccagagcagaggaggcactgtgggccgctttggcgcatctttgtctttttgtcttattattattattattattagaattggcgcatcttgtatcgacatcccatttctcgcatagtcgcctgccttcccttcttgcggcgggcgcatagagtggtgtatcgtgggtgctcatggtgtccgttgtttgttcgaaggaccattgacgtccggccccagcaccaggcctgcgtctatcccttagcagcctgcgcggtagtgtgccatggctccatgccctgagaggaaaatgaatcattggccagagtaagggactaggaggaaagagaatcctggccagatagctaccacttgcggccttgcaaatttatcacaaagtgtaatggtagtgttaagatttaacgctaaaatatatagttttgctataacttattaaagctataacgttatgatgtttttttaatatgcagttctatgatagatttgctataaaatctgtagatacgccttaaatatgtagtattgcgatagttttggtcaaattatatgtaattttgtaaaattttactttaaatattactttttaatgtataaatttgaatattatttttaatgtataaacttgacaataaattctttggattttggacaataaattctttggattttggcgatgtcaaggggaaaaaaatcccatgtcacaagcttaatggctcttttaaaatgacaaagaaatttataaaatctaaccatatcatttataatagagtaaatttcacaaaactacatgtactttggtcaaattattacaaaacttttgtcaaaaaaattattacaaaactacagatttaagataatgtatcatagaactacagatttaacaataaatttatcacaaattacatgtttaaggctaagtatcacaaaaatatagatttaataataaaattatcacaaaactacatgttttgggatttaaatcgttagcattaatgttatgttggacttataattgttcaagttttgtgattaaattgtaactaaacctgtagttttcatgatattccattttaaacatgtagctttgtgacaaatttagtgttaaatctatacttttatgataatttgatcaaagtacatgtagttttgtgaaatttaatctttacaatattcagaacaaaccttttaaatatatgtattccgaaaggagcaatgctatacgtaaatatctatctaatatatttacggtggcagagccactgacgttttggcggaacttctaaaaagtaaaaaaaaaaattaaacctaagcgataattatattcgacttttaaaataccaacgataataaagagaagatacaatggacggccgtagaagagtataatggtagcgtttgacgggacttaacccaacacgacaatgaactctaaaaactataagatccaatttttaaaagttccaagaaaagtgaatagaaacagtgaaatatcgagcaaagcaagtagggaataataattgggtgacttttaaaaactataaaattagaaacatgataatgataaggtttgatattttaaagtcttaagaaaacgagatatctatttaataaattttaagtaaaacataataaaaaatatataattttatagggttactagcccgcgcaagcaagctagtttttattaaaaaagcaaaaagatgtgagataataactttaagaggtttataaggcctaaaccttcggtaattatccacatcgacggatcctcatcctaatccgttccctttgtcctgttcccccatcttttacactgttgcactctgcaaccgacgcatcaacctccaccgcccttcttccccgccgtcccgagaaaggaaccggaaaaaaaaaatccccaattccccctacgccgagcagcggcgtgccggcaatgtccctccgcaagcgccagcgttcggcgagcagctcccgcctcagcaccctctcctcctcgccggctccccacaccgccgccgccgccgcctccgcctcctcccctccgctctccttccccaacgccgacctcgtcctccgcctccacctcgacccctgccccgacgacgacgcggacctcgacgccggcgaggatcaccgcccctccctcgacctccacgtctcctcggcgtccctgctccgctcccgctacttcgccgctctcctctccgaccgctggagccccgcccccacctccgccgcgggggggcacggccacctctcgctggccgtggccgctccgcgctctgcctcgcaccctttccacgcccacgtcgaggtcgtccgcctcctccacaccctcgacttcgccggcgccatccactcgcccgccgacgccctcgacatcctccccgtcgcgctccagctcctcttcgacgcgtgcgtcgaggcgtgcacgcggttcctcgaggcggtaccctggtcgcccgacgaggaggcccgcgtcctcgagatcgcgcctctcctccccgccgatgaggctgccgacctcctcgctcggatcacgcctcccccagccgcctccgcctccgccgccgggggcgaggccgccaggtcgccctccgaggcgatgctgcacggcttgatccactccgccatccatgggcacccggtccccgccgcaaccaaggcgttcgtcgcgatgctcctcaaggactacccctcccgtgactgcgtccagaaggtgctcgacgaggcgttcctgtcacggctggagactgtcaaggagctcatggggaagtatgccagcccggatttcagggtcgcggtggacagcgatgagcgggacgcgatacagaggctgaacctgcagtccgcggtattgaatgtgagacacttgctctggctcatcgagaggatggtcgaaatgagggtggccggtaatgcggttaagctgtggagtgagcaggctgcactgactgctgatctgcagaagttgctgaatgatgtggatatgtggaagaatattactcctgggcttc

SEQ ID NO: 81992 - DNA, 15804 bp, Oryza sativa
tgtttttgggaacaattttaccacgaggatcataggtgtaacattcctttatatttttagtgcaataaactagtggctttttctggatagtttgggtgcatacatgtgcatttttaagagttccaggttgttgcttgaagtcttgagcattagtttggagttgtttgcaatttgcatccagtaaacaagtgctaaatctaactgaacgaatgtccatatgagcaaatattattttgaaagtagttagtaggctaaattgagcttacccagagttagtacctagatagttatttccaattcccacaggttgtcatacttcttctatgatcattttgttctgcggacagatttttttattgctcctctgtaatgtattccatgtttctttttcttagcgctatgcttgtaatcactcatggttttaccatttttatgtatgatcatttcattccatgttcacagcttgtttgatagtttctttgtattgacctctatactatctacaatggctgtctctggttggttgcaactcacttttaagtgtgcctggaagtttttatgtgtgtatctgtgttggatcaactcgggtgggtctatagtttaataagacagtaaaacttgaaataattgtatcttttcagtgtacaggagcagaaaactagacatgcatcaatctaaattcgattcatgtggaaattactgtgcatatcagtttggtgggttcaataagatttttcattagtaatactttaagaggttgagttgtgagttggataaaggttactttgttgtacttgtgttgttgtttaacttgatgggtctctatgagtaaaaaaagcatatgtccctgcctcctcagatagccaagctctcaactgcgaggcctttgtgtatatgttttttttcttctctctggccaggcagagttggtctaaaagcatttggcagatggtaggccagctcttttatgaataactttggcaagaaaagctagcaggtcatccaaatgagatgggtttttcccgtagatcagtgtattaaagaaatgctcagatctgctattgtgcttgtctaagtaccatgtcaatccactaggtacacaatcaacatctagttgtatgatggcaacaatgacaagcacattttacaaccctgaactttcatgaatatatgcacaagaattaaaaagtaaagctcaactcaaactatactatcaaattatgaactatcagaactgttcaattttcaaccatggtacagatagttttggttgacataacattgatggtgtgtggcctgaggctgagacagttttttttgggactcagctaatcctcttgatctctggcatagctgaacacacaattttatctgatgatatccttgtagctctctgtctagtattgccagattttccatggagagctcatactacattataatacacgcttgtagctttgttcttgtgtttaattgggtctgacatatatgacatttctgcttctcaggtgaggacgaagcttgtcagaagttggcttcctgtcctaaacgtctgcaggaacatggttcagcctatgcagtgtggatacaagtcaccaaattgccaagagctagaggagacatttcttcagatcatctccaccttgcctgtcccagatgctcaggagttgctgcaacagtgcctcgggttctcgactcgcaacgtcgacgactgcccgcacttgatcgcagccttcaagacatggttcaggcgtgctggccgggctcctcaaggtgcagaaaattgagatgagcgctgcagctagtgtctgccaacagtgggtgctgtcttgtgcgaaatctcacatctagttcaatgtagttcctaacgctgtttctgtacattgttgtactacctaccctatctattgccatgtaaggtatatgatatgtacataacaacatttttctgttcgtgtgaaacatgttacccaagtgcagatgaatgatgcactaaactaactattcacgcgtgcaatgttcttcccttcggaatgtgaatataacttgacgacaaatgtatattcagctgatgatttcttctgtttatctgccgcaagaacactgcagtccagtgagtttatcggtttctcttgtctacaactgagaattgcggtcccggtgtatcactcaaataagctcatattttgtgttctgcgagtttcagaattcagaccattctcttcaaaagaattcagatagtactactgaattgctcgtgctattctctcgccaacgtggcaaagcagtatcctctgatctggtttattaattctttctcgtttgctggaacatttagtggagaacatgactaagttcaaaagtcagaattcggtttcttcctcattccattcagaattcttttcatataaaatagctgtggtaaactcctagtctctgcagcaactaaagtctccccttaaaatataggattcaaatctggaaagaggtctacgcacgaaatgtcactatttcagcacaagtctcatgttctacgtaagacccagaatgtttagttctagaagggacagtgattatggaagttgttatgaacctgagttttaatctaaaaggagattaaagatttaagacgctctcatctttcactcgccaaggacacgttttctacattattacagtacattacgttgggaaggttgatacttagcccaacccaaaatacaagtggccaaaagcaagccaaatttgagagattttatctcgtcgtcttccttcacatcgacattacacaaaggaggaggagaaaaaacagaaagaaagaaaaaaatggaagaaaaattggaacgaagaagaggaagacacgagtgacacgccatgaattctagcaccgaattgtacacatgtgcgacgagctgcggcgacgacgagccgacgggacggtgagagccatggcgtgcaacggcgagctagtagaagccctgcaccggccaccggcggtcgggatcggggagccacgacgagcgcttcttcttcttgtccttcttgtccttgctgccgccgccgtcctcgccgtcgacctcggcctccttctcgccgtcggagctcttggagtcgccgtcggaggagctgcacccggcggccacgccgccgccgcctcctccgccgccggacttgttcctggaccgcacgtactcgatgagcctccacgccgccggcttcggctgctgcgaccgcggcggggacgggggctccttggccggcttctgcgccttccgctccgccgcctgcagcttcggcgtccccgtcggcgtcggcgtctgcggctgcggcagcttctccgcgggcggcgccggggcgtcgctcttcatcagcgggtccgcgtcgtcggggagccgcgccgactgcgacagccgctcgtactccggcagcggcaccgtctctccgacgacgccccgccctccttcccgctgccgacgcagtccatgagcagcagctgctggtggctgcccccgcccgccctccgcctctgccgccgcgccctgaacctcgatcccctgccgcttccgccgccgtagcgcttctcctcctccagctgctgctgctgctgctgctcctcctcgtcatcttccgtgtgaaccaggacgtccatatttatctcggctactggcgccacaaaccatgcaccgtctctctctcccgatctcgcgatctcgcgttgggagtataaattttgcgcaagtgatgatgggggtgcaaatggatggcgagagagggagggggaatggggggaaaagctggggaatgccaagtttgacaaggatttttggctcgcgaaatcgcgtttttattcaagcgtgtgggcgtttgacccgcgcgcacggaggtcggggtcgtggtggtggtggtggtgggcgccgtggcgaggtgatccagccacgcgcagacgcgcccgcttggctcgcgtcgcgtgccgtggcgtgcgcgttcgagggcggggcgcgtaggtggatttggacagttttgacggcggagaaacggcaagccatggccttctttacttggtgaaaagaaaattttttagttacatcagacgtgaccggatatcagaaagggtttttaacacgaatgaacaaactaatttcataacagcacatgtggttactgcagcacttatggttaatcatggattaattaggctcaatagattcgtctcgcgatttccatgtaagttgtgtaattagtttttttattttatttatatttaatgcttcacgtatatataaaaaagttgatgtgatgtttttgaaaaaaaaattagaaactacaccaggcccatatcgtgatcatcagagaggccgggtagtacacaaagtgtgcgttaactagtgacacttgcgaatttcgggaggaggcaggaacgaacttggtcaagtcctgaactctgaccgcattatatcccaggtagtacttctgtttgtgttgcaaatttatacaaaagggaatataaaatcacatttcaagtttcaacacatctcactaaacgacatccgcttctccgcttatcagccataaccgaaatttaagttttaaatttcatttgttaattttagagttgattttgaggtttttattattgtagtttatttttagcattgacttttaaccattggcaacacatgcctataaactattctttatttggtttattcattttttccattttgtattcacggtagttcaaacatcagagcgtttagtagagagttaaaaccgtcgttttgtgagacgatatgtgaaaatgaaatgtagatatatagttttgtgaaactaattttcaaaagcgtatttttcttttatttttttttcatttacaacgtagactaatgaaaggggtaaatgactaatatcatggactgcctattttttccacttcacaaatattgcaagtagagtaaataattacgtagaaatatattagtgatggttatgtcaactaggtttaacaaaacgcggtttccgtgaaaattggactttttgaaccggctcgggaaaaagtgctcggttttcacttttcagttgagttaaaaaaatagattgaattttagaacttttttttgaaattttctgacaaatttcaccattagtcaatggttttcgtgaaaaaaagggaaaaatctttggtccctttctttaagtgattcggttcatgaacctgttgtcaattatatatatgtaaatggggagagtacatataccacctccggaattatcgacagtaaaggaccactcgcctttcaccccagttgcaaaatacaaacataacaaatttccagttgagctaatcaaaaaccctattttgtacgatcattggatctagacagaatggatcaaattaagcactcctcgatcgctaactggccactccacatgacggtggtcacgatctctggggacgcctcgtgtcgctaaacaaatgccaaaaccacgagacgattatctctctataggatctggtaatctggtatttctagtcctccaacgctaagccgaaactatattatagttgcatatggcatctgcttggattagaccaagcagattaagaaaacgagaaaggattttacgcggcgagtcggcgtcgatgcaggcagtcgatgccgtgctcgcacgctggcttcgctgcctttacacgccacaaggcccactcttggtcaataatgtactgatcttaagactgaattaatagggaaaaggatctcatatgcttagcatgatcagcctcgttaatcgcgtaggagtactaattaatcacccggcccagttcgtcattgtgtcctgaaaattaaagataactgtagcgaaggcacatctgatcggcatgatgatcctctcctagattggcgtaattaacatgtaataatccccggggaatggtacggttgcaggctgcactccgtgcatgtagcccactgaatcttgggtgaccggtttgataaggagttgttgtcccccgtattcaccggcaggcagattagtttgatgctaaacacgccggagatccgctgttggacggcggcatgttcatcgttgcaagcgatttggttggaccacatcactcgagccagctgccggtagcatgtgcatacagccatgcacacgcagcttaaaccttgcttagttagcgagatgaaagttaactttggagtagtaaccaacttaaccatgagctagctaagctgatgagccgtgtatacatacaattttggacgttggaagcaacaaagcaaaccgatcgaatagattgtaggcagcaatcgacatgatgcaatcacactcgtggtccttgccgctttgcttcgcgtctcaccgcgtgggtggtcgtaggcctagtccacgccggtcgccggaggcgagaccgagaggcatcagttgtctcccgtaaggttgtgatcgagttgatcaattatagatcgagttacctcccacttaagtctcctgcacacaccttggtcagggatcagcttccgtcttccggttgtagtacttgtccagcgtacgtctccctcttcgccggtgcctgtccgaccaattcaccttcaccatccagaccatcgtcccggcgcgtcattcgggctcaacacaaggctgtttggtcgctggttgcgatccgtttcggcccagtaaatatgggcatgcagcacgtaagaaaaagatgatcgagtatgttttagtatgttttaacatattgatcgaatcaatttgtatctcttaactgtcattgatatgtgcctgcaaggatgtataataagagagattcaccaagattggtaaatttccgttcgtcgcacttattttcgtctgccaattgttcgattccttctcccctctcgcacgtgcgtgcgtgacgaaatacatgtcgcatcatagtacagcagaaaaaaaaagagggtttggatagggctttattcctaggtcgataagaagcggatttgctcaaattcttagaaaaacggaaagaggaggaaataaggattgaaacccctcaatcaatctatctattatattattaaaacagctttgaaaggagacaccacgttcgctggggagactagaaaatcccacattaatcgaagaaaaagaaaaaaaaagaaaagtagagtttaagtagaagtacaatattaactaatttttttaaaaaaaataaattctgaaattagaaaaagaaaaataagatttcaattaggaatataatttataactaactaaaatatgtgataaaaataaaaactattgaaagaaaagaccatataaaacacatgacgagataaattaagtaacaggcctataaaagagtagagtggtggcggttgatataacatataaaaattgttaataaaacaccaaatagaatcctaatgacgattaaaaggagggacattaggcaggcggtgaagctaacaaataaggcggttgctgggacttctagaaagacaaaaatacattgataatcatattcgatttttaaaatttcaatgacaataaaaatgagaagcaccgggcagggtgtataagagtatagttgcagagccgccgacggttgacgggacttttagaaaataaaaaatgaattctaacgatagttatgttcgatttttagaatcacaatgacaattaagagtaggcggcggacgggctgtacaggggcatagtggcatcgtttgatgacttctaaaaattataaaaaaataaaattacaagtccaatttttaaaggttcggaacttctaaaaaataaaaaaaacaatgataatcatgttcgattttaaaatctcaatgacaataaagaatggaggcagcggacgaaccgaagaggagtacaatggcaaagccactaacggtttggcgggacttctagaaagtaaaaatgaacacaaacaataattatgttcgatttttaaaatctcaatatcaataaagagaagagacagtggacgggccgtagaggagtataatgacaacgtttgacgggacatctagaaattataaaaacgaaacccaacgtgacaataaactctaaaaactataaaatctaatttttaaaggttctaagaagaataaatagaaatagtgatagatcgaacaagcaaataaagaaaaagatgacataaggagtagcaactggtgtgacttttaaaaactatataattagaaacacgagaatgataaggtttggtcttttaaagtcttaagacaatgagatagctatttaataaattttaagtaaaatcatactaaaacaatatatgattttgtttgggtgctagctgcgcaattgcgcgggtcacccagctagttatctccaaagatacgatcggatttcacagaggaggtggcttcagggaggcatcgggaagatgaggaacctcgacggaggtaggggaagatactgtagcgatgggtccacaacacagttagaggacatggggggattagtagacttttggttgcttgctgggctggatacgtgattgcgggccgaggccgacgggagaggaataagttcacttgagatccctcatgttgacgttgagtttgaaatacatccctaaaccgcaaaaaccgggaagaacgcatccctcatctttcaaaaccggtgcaaatatagtcccaaaggccaaagcagtattgaagatggttttaggtgacgtagcgctgacatgacacaataagcaaaataaaaaaataaaaaccacataggacccacatgtaactatgtaagggtgtgtttagttcacgtcaaaattgaaagtttgattgaaattggaacgatgtgatagaaaaattgaaagtttgtgtgtaggaaagttttgatgtgatgggaaagttggaagtttgaagaaaaagtttgaaactaaactcggcctaagttatattctttttatcccctctcgctcctgtcaggcggcggccattgctgctccgagcaaggagcagcggataagagcgacggcgggcagggcagggcgagcgtcgacacctcgatctgggtcaccgccgtgcttgtcggcaaccacgaggagaggaaggagagggggccaatatgtgtgttgttgaggaaaaaaaattatgcgtagaccggctgcaaaacccgcagcgtgcatacccgacttaaatgggcggcacatggacgagggagcaatccgacggcgcccctgcgcagctccatccgcaccaagagaaggctcagctcgctcatgtcgactcccacaaccaaaagcgcgcatcgagccgagcgtgaggaatggactggctctggcttagcgactcgctcgcatccttttcttccgcttttctttcccccgccgccgtcgcgatctccttccccatctcgcctcatctatctggatcgtctctcctcggcgccgtcggctagccggtaatcccctccgttcaacaaccgatgcggtcacctctctcgcctgctaccgtcgtcgccgcctcccctgtgttcccctccgcgcgcctcccccctggctacgggcgccattggtgacggcggcggcggctgggtcagctaaagcgagcacgaggtgtgttcccctctacctccctcctggccaggggcatcgggcgccttcggtgaaggccataggcccacagcggctgggttggcgaggacgagcagaaggctatggaagaacatgcatcgatctggactgcaaatctgcaatgcaacgcgtcgccggaagtcaagcaacgaagaaagtagtagttgatatgtctgatcatttgcccatgtctctctgtctttcatcaaaatgctggggtgttggtttctgcaatttcgctattgtttaaccaaattagttcctcagacctcagctagtcttgctgaaagtgatgggatgtatgatgtatcgctcgcactgagtggactgtttgcagcaatgacaaaagcttatgaactatacggcatctttggtgttatgtaatctagaatgtgatggattgatgtgtaaaaaagattgtgattgtttgtctggttcctttcaaattaaaatgaaaactgaattatgtaatctgaaatcttgaaggtcaaacctggaatgtgatgtccagaagataaatcattctcaaacaatattgttgatcatgcataagtgtaaccagaaagtattttctatacctggaggccatggcatctaggcgtatgcatgtaatttaatcgctcatctagttatttgatcgatagtcatgtttcttcctattagttgatctgtgactatatatatgctatagattgcacaagctagctttgatcattcctcaagttggatggctttagattttatttccatttacatgttgcactatgttccttaactgtactcttttattatgttacaccataatttattttcttcgcagtgtcttccagaaaatactttcgagtcgagcatacatgtatttgtattttctgctcctcatcggctccacgatcccaggcgactacgtcgttcgcacgcacaggtgagagaaacgggtccactacggcaggcgaatcccggcggctaggtcgaccttctcctgtcttcgatctggcgctggaagacgaagccgaaaaaaggtcgcttttgctgggagctgagtccgcgtcaggcgccgtccttgccgccgcaaagcgaagccggccgatcgctcgagtgggagtcgacgcgagatcgcgagcgagccgagctgagccttctcttggtgctgatggaacacgaagtcgtgagcgagccgagctgagccttctcttgatgcggatggagccgtaagggggcgccgtcagattgctcgctcgtccacgcgtcgcccatctaagtcaggtatgcaccgcgcttcgtttgaagccgatctgcacagcatttttttttccgttgttgctgttgtcgacgtagcaacagagaatacaagagagttcgttggcgctgcatatataggagtaggattcattaaagttgtagtggcacaagaagaagtagcagcagcgtcgtgttccacttccagtgacactgccgcatccctgctgctgtcgactgcatgcacgaaacacgaacattcgtcatctccggcggcatcccttcttgagctccgcctcgcgcacaacgccttctcccgttctcaaggttgtcgaccatctccgggaacgacgaccttgaaggtgtttcgaaagtttgacgtcggcaagttcggcagcaaccaataacctctcctatgtgcagacctccgaccggtagtcgtgcaagcgcgagcagatggaggccagctcgtccaagaggtgcccatggtgttcgccacgctgttcgccttggccgtcgtgatggcgctcgtgcctgccatgcctgtgctgcaaccagacgaagccacgtccgcgacttcgaccgcggcggcgacatggaaggcctcgacaagaggcccgccggtgtacatggtgaagctggcgccgacaacagggaagcggagcacgtacgtcgtcgctcgatgggcaccggcgcgccacatcggccgcagaggtggacgaactggacgtcatcgtgaacaactgcaagccgccggacgctgctcttgctcggagcatggggaaaaagggagattgttgtttcacttacaggtggatcccacatggttttttttttatttttgtttattgtgccacgtcacccaaaaccaccttctatatttacaccggttttgaaatatgagagatgtgttctatccggttttgtggtttagtgatgagatttaaactcgatgtcaagatgagggacaaaaggtgaacttattctgaggggagaagaagagatgaaagcaggtcggctcggtcgtgggctgagggagacaatgggctaaaaatggcccagagtgtaaggagggtttttatttaaataaatactgaaatgatatttgtattattaaaattagcagctctaaaaatttcagagagtgtaactaactttggagagcttaataaaaataaatttagccatattatttttattttccacacttactttacttttaaattaatttaaacatctacctatttaaaaaataccaagtattccagaaaatttgtattttagttaattacataatgtaaatctttcttaccttatcctcaattttctcatcttttcttcccgatgtaacacacatgctcttttctggtaacttttaagttcaatatcttgaacgtataatgtatggtaaagaacggaatgttgggtgtggttgtgaatatatttccgtttgtgtttttatgaacttatataaattaatccttgatcttcttttttctgtatatgcacgaacttgtacaaattctccaatgaatttccttgatcgaatcgagtatttgtttactactagcacgcatcatgtgaggcaatcccttgtcactccatccgtttgtctgtgtcgtgacggtgtaacgctttgagctgatttatcggctctcggccaccgcgccgcgcgccgtgacgttgagctcggccaccctcactttcctcgccgcggcggcgtcgttgtcgtcgtcattcatcagcctgaccaccgctctcgccacagcctccgtggccgccttgctggcagcctcacgtacccgcacaccaacgcggagcacgtcgacgaggaacgtctcgttgaggaactgctcagcacacagcggtcacatcgcgagtggcacactgacggagacggcatccagcatcgagttctagccataatggctgaggaagctgcccaccgtgcggtgcaccaggatgtccgcctgtggcacccaccgctcggccaccaccatgcctcttattttgggagagatgatgcaattgcgcgtgggttaaggtccaggaattcgcggctataggaaggttgtgtttagttcacgctgaaattggaagtttggttgaaattggaatgatgtgacgaaaaagtttaaaatttatgtgtatagaaaagttttgatgtgatggaaaagttggaagtttgaagaaaaactttggatctaaacacggtggaaatgcaggcacgacgactcggcgcataacatgtgtgtgtttttgtgttgctaatctgcacttctgcagacaaccttcatttcagtttcaaacattttcttcagtaagggagttttagaattcttttttctttagcaagtgaagtgaaaccagtgacggagtcaactcctgagcagtttgggcagctattcgaggtggtgaacccataacaaaaaaatacccgaggttagtagcggatccaaaaaatttacttaaacccgagcaaacttaatagtacataataattcataaaaactctacggattataaaccattgaaacggacacataagattaggtttcatgtgagtttgattaactaatttagcaaataattacatagtatcaagtactaatcaacaactatacgcagcgcagcccgtgcacctggccgtggtggccatgccttggctccgtcgctgctcggggttttatacatactaagtatatatactaattaatatgatataaattagttataattagataataaactcggaatcctcgggaagatcaacgtaggaatgcccctagctgttcaggctccatcaatgacgatttcactatcaacctttcgtcaatcatcgaaaaactctaattgtagtttgagctgcacggtgctactagctgtgctactcggaatgacgaactcccggtctttctgttttggtttgagatagatcagatttagaggtgaaaactactgtcatgtaaattccagatgttggtggttcgtgcgttatattgtaaatactaaacctgagcttgggattaatttacatgtgaatgatctaatgaattattagtacggccattgatacttgtgttcttatgaaatattgatcctgatattaggtgcatctatgtgtgctatgtattgtgaacattggtgggcataggtgctggaggtgcagcttcactaatatttgtattttccaaacggcacacacttgtgacggctatctacgtcaggattaattatcctgaagacgactgtttggcaaattgaaatttctccgacaaaccagtcctaacaggatttcctgatggtaccacggcaggatgtatttccctggcgtgataatggttttttcctgacatttgtggctgtcaggtgtaatctggttttttggtagtgttgagttgctaaattgctcattgatttttcggtaatctatcggtgcttgatggtgtttcatcggattgtcaccgtcactgtttcctcccgatcgatgaggcagtcactggcaaattctattcaattttgaggttgtaccgactaccgaccaaccacctgatgaaccttgtacagttatttaatctcgtataccgacgtgctttaatatttcgataatgacttaaggttacattgctcgtttgctagttgcctttcaaaaattcacagctccaaaaaggaagaaaaaaagaagatagagcggacgagctcggaagtagctcggtttttattactccattacagtgtagcttctctcttatggaaagtcagagaaatgtgagtcccactatcatgagcccacatgtaagtggtctacgtcaaaggagcctcctctctccactaccgatgctatgttaatgctggatttcctttagaaatcataagtttcttcacagcaacaggacctatattaattgttgtcaggtgtgacgattcacagttacacaaatccaaaatctcaaggaaaatccacacaaaaagaaaaataaatcgcaagcaaagactaccagtgtgccataaaacataaatcataggatggtttaatacttgcacaagaaaataattcatcaatatttcataacgcgtgacatcatccaccatatatttgtgtcatcatatcaacttccgtttttgacaatgaagtatcacaccttaaattgctgatttgtttccgtggagacacatgagcattagttccttcctagcttgtgtcaaaacagaaaaccggggcttcttccgatatgtttatacaaataaagtgtgtgttcatagaagtgagtgtgtataccttgtgaaccctacgtttgtactgtttctagaaaaactaaaaggaaaaccgttgcttctcatcagctcttatgcacggagtgtccgtaagtccgttccatctctcaattaattagctaatatgtgaggatatatagcggagtggttattacacaaaattgaattccagttaaggttcatcgcaacgaaaccatatggtgtcagcgagcggcacaagtactgcagatgctgcggggatggccgatggcatgcatccgtcgaacgaaatttgtttggcatcgaattatttattggtttggcatcgatgcatcacctcatacagtatatagcccatccaaaattttgctcttgctatctttttcttgtcaccatctcaaactgtatatagcccatgctattgttctatctctatctcagtctctatcttcttattgaacagaaaatggtctgctcataaggttaaaatgatatttttcatgtgagcaaacacagtgcgatggatggaaatatgacgtcggtgatatttcttagacaaaattcgtccatatgatagcattttgtagaaaacttgctctcgttaatggccaaaaagcgtagaattgaacgcttgtcaatgctatttgttaaaatttctccttattttaatgcgatcggttcaacttgctggaaggctggaagcaata

SEQ ID NO: 81993 - DNA, 1847 bp, Oryza sativa
  unsure (1)..(1847): unsure at all n locations
atagtttattactaccatatgacttgcaagcaaattagttcttaacatcaatancagctttctccaaaatgacatacatcttccctcccaaaataaatcacctaatcaagacatagccaggatttgaatctttttgagacggagaggatgcataccaataaagtgcaaacaaagtggagtatatatcaacctgcatccaaacgcttatatttcatacaaacagcccttcattggcaggacatcctattaggtaaataataacatcatataaggatcaggttgcatattttaaagaacctgatgaattgctacaagcctacagcagttttaaattttcaaatgacaacaaaatacatctactggacctagtttgtatgtatgttgtgctctgactgtttcgtgcctactacaatagcacaaaatggtacgctaatgtatacccttaagttctttaagaatcattgtacaaatttcttccgtgttgattggtaggaagagagaaaaaaaggaatgtatccaaggagagctggccaactcataggagaagtgagagctcatttctcctgtatcacaactcagtctcacaagcatatgtaataaccatcagcatgttttgtgcaattgtgcttattacagatttatgcattagcaagctttggaataggtattaccttcttcagaaatctgttcaaaacagcccagcattcagtgctatgaagcttctttagtcgagattgatgatgtctcaacatcttgaggacctcctgctgctcgttccattggggtttcactttgagcttatgattattatatgcaacaacacctgctattgctccagattgcagaaaagatggtgtaagagaaattaatgggctcaaacttgaacaagggtgtaagagaaaataaagttaaaccaataagagaaaaaacagtataatatacctatcaaataaccaattatatttataaaggtaagctgtgtatctgcaaagatagcagctgacagcaacaccacagtccaatccctcacaattccagtaacacgagctgtcagtgcactagttctggaaatgacaaggaagactgagggatttagggtgaaagtgcatatgcagtttaagaacaattttcaagttaattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattttaaattaatagaaacctataacttgatcaaaaaccagagagctcacatacttatttccttcaacatctgtgcaaatgcaacagatatgtaaaggtacgcactgctccctagacagtgtgtcattgaaaacattgctccaattgcaatgaccgaactaacatatctcaaagtccaggtgaactggttgaattagatagaaatattgtagagcacctaaacatgtgctgctgggtagctacaaccaaatattgaaaatcaatcctttccaaaagagtacaagccaaatattgctgtgtgtggagattatgggtaccccatacccacacggcatggttatccgactagttataggggata

SEQ ID NO: 81994 - DNA, 639 bp, Oryza sativa
caacgatgccggtggatgctggtggtgggggtggtgctcggcggtggaggcagtgggggtgtctacctcgggcggcgggggtggtggggcaccctggcggctgggacggcgtcggcgcttggtgacagcgcgcggcagcggggtggtggcgtcgctggtggctggtggcgctctgcgctcaccctggaggagggatcgatcgattcgatccagagagagatttctctctttgaatctgacaggtgggcccaagtaggggtgaaaacggtcaaggaaattcccgatcgaccgggcgccattttcgtttaaggggtaccgtttccgaccgtacctttttggctatttttaaattttggtttttctaatttctttctccatcgtattaatgtcgataccgagtagtttaaatgataaatatggtcaattaccggccgatcgagcatcgtttccaaagagatgctaccgattctgaccgtttccgatagttttcacccctaggcccaagggcaaaaatgtccataaagatatacatatggaattaagaaataagtgatacatgaaaaacagagaaagtggtaccaaataaactaattagcagtcctaatgatatattatagagggcatgcgaattaagtggta

SEQ ID NO: 81995 - DNA, 2488 bp, Oryza sativa
caaatattcaacaaaccttgttaagatggcagttgagcttcactcacaatctgtggattatggtgctccattttgtacatgttcttttcgtatttttattgggatcacaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcgccactacacgtgaaagctacttgaattgggacgtccacgcacgatccgacggccatcattgcatggcgtcttcagccgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccatttccattaccagaaatgagaagtttacaagttcttaaccctccaaaacaagagccaagaacatccacagttcacactgccagcacttgaagaccttacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagcctgaggaaataaagtgtaatacttcctccgtttcacaatgtaagtcattctagtatttcccacattcatattgatgttaatgaatctagacatatataccgtttcacaatgtaagtaattctagcatttcccacatttatattgatgttaatgaatctagacatatatatgattcgacagcaaattaagtcttaacatcaataacagctatatgagggagtagtttattataaacttgcaggtaggtttgaggaaataaagtggaatagtttattactactatatgatttgacagcaaattaagtcttaacatcaataacagcttactccaaaatgacatacaccctccgtcccaaaataaaccaactaaaataaatcaactaattaaaacatagctaggatttgaatctttttgggacggagaaggtacataccaataaagtggaaataaagtgggtatatatcaacctgcatccaaacgctcatacttcatacaaacagcccttcattggcagggcatcctattaggtaaataataacatcgtataagaatcaggttgcatattttgaagaacctgatgaattgctacaagcctacagcagttttaaacttcaaatgactacaaaatacatctactggatctagttggtatgtatgttgtgctctgactgtttcgtgcccacaatagcacaaaatggtacgctaatgtatacccttaagttctttaaggatcattgtacaaatttcttccgtgttgattgatatgaagagaaaaaaaggaatgtatccaaggagagctggccaactccggcccggctaaaaaaaaaaaaagagctggccaactcataggagaagtgagagctcatttctcctgtatcacaactcagtctcaagcgtatgtaataactgttagtataatccttgttctagttagttatttggtttccttagacagtaagctataggctgcagctgttactcggttgtcagactgctgctattagtggtagtagtcaatttttattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaattggtatcagagctcaggttaaagaagtgtgagagagatggagggagtaccagctgctggagccaatgcttccaggtcgccacaacaccgcggccgccatcactcgttatcgccaacaccacggcgaggacgaggtcgaggcgctgctgttcgagaggttgttgtgcaacggactgtcagggaggttggcggcgctgctgctttccccaccctcacgcgaaccaactacacccagtggtcgctgctgatgaaggtgatgctgcaagcccgtggcctttggcaccccctcgagcatggtgaatgcgatgagcaagaagacaggatggcaatggaggccat

SEQ ID NO: 81996 - DNA, 10148 bp, Oryza sativa
cgttcgttagtgtgtgttctatcttctctcgtttttcacgtacacatttttcaaacaactaaacaatatactttttttaaaaaaaattatatgaaagtggctttaaaaaatcatattaaactattttaagttagttttagctaatatttaattaattatgtgctaatgatttgctccgttttttgtgcggaaggagaaggttcccaaccaaaacaaaagaacgccggaatgaggcttcctcttatacatgtagcagccacctccatctatgttcgtgttgatgtggttattaatataatgttctttccaaatcaaccgaaccgtaaaaatgatgattgtgtaaaaccgcaagaatgatgatggtcaacaaaagtacttttacagttgctaccgtccaatactatagtatatttagggatggtttggtttgtggtctaaattgatcttaccaatttttggcaatgccaaattttgataagttttgacatggctaattttggcaaggtaaagttgtgtttggattgaagccaaaatagcctaacttaactattgaaatggcctattttcttaggcatgccaaaatttggctttaagccaaatagacactaaacactattgaaattgccaaatattggtaaggctaatttaggcctcaaaccaaaccagcccttaataactttgtaaatactactgctcaaacttatagttagggtgtgtttagttcacgtcaaaattgaaagtttggttgaaattagaacgatgtgatggaaaagtcgaaagtttgtgtgtaggaaagttttgatgtgatgaaaaagttgaaagtttgaagaaaaagtttggatctaaactcggccttaacattgtctgttcgtcgccatattcccaactttctatcacatcatatcacatcaaaaactttcctacgcacataaatttccaactttttttttccaaactcccaattttcttcatacttccaacttttttcagaaactaaacacacccgaagataggagatccgaacatcctccccaaaatcactgcaccgctcgcctctaactttattcaaataaagacaaaaggatcgtaatcccatatagctggagttggaaaggggataataaattcatccattttacatcactataacaagtctaaatctaaaatacaacaagcatttaataaaaaagttatgcatgaaatctgactaaaatagaagatacaataacgcatataccaattcctattatactcattgttgggttttaaccctaaattattattaggtttaacttttatttttggtgtcgctcataatctataacgaggctaaggataggaatataatggactctattttcatatatgtattatatatgttacttctataccgttagacttttataaatcatatcatcaaccatgatcgtacatttcagttatacgagtttataatataataatatctggcacatatatgttagccacatgcaggagcggatctaacgtgggtgcaggggaacttgagtcccccctacacccacaaaacccatggataccctctaagcccccctttaattttttcatcatagttgataagataggaggtgctaaaggtctcataatagtattttagcatagtttaatactaagattatatgtttatatcggtgtactcagtatgttgagtcctcccaactttttatttttggatccgcccctgcccacatgcccacatatatataagattaattcaaatacaaccgtataactcaacagcttatagcaggtacaataataaaaataataaactataagttagctacaatcttatatggagaagataaaagagaagagagaagataagcggattacagatttgtagccagttgcggcatgaactccaaaacgttatgtgtgcataacatgtgggaccaattattaatgagtagtatatatttgaagttaactattatatgaattggctattagattaactatagatgatttgaagctagtaattgcctatactattaaacttgctcttatagagctgtctctataaacaaacctagctacttcgcatgcacgatttccgggatcaaaacacatgtctcgaatatcaactccttgagttagattgcacatcaatcgtaccctattacgtaatactttcacactttactataattccaacactcgtatgatacgatattacggtatggtgcgtccaccgtgcacaccattagggtcaggatcaggcatgggcaaactagagcttgagtatcatgcctagctccataaaccttatcatgtcacttttggattgaaaattcgtccaaacaagcttgtcattttgggagtatcttttgtaacatcaatcacctctaatttaaaatgttctccatcttatcctcaagtactaaccatatattacttaatagaaggcactatagtgatttttcctaaaccctaatctttgctaaataatctagaacgatgattttgttggaacggaggtagtatatatataatttatgaaatatttaagcttccattagctcagtccactactaggagaacggtttttctatgtggttaaatttaattttcacgtgcggtgggctacccgcacacacccaggggtctgagaaaatcgtgatttttgcgtgtgggtggcacaccgcacggaaaaataaaaatcctaaaaaattaaaaaattaaaaaattgaaaacctagaattgggcggcgccgccgcctcctcctcgtcctcgtcctcgtcggcggcggccgaggacgccgctcccgcacggaaaaaatcaaaaatgagcttatttttccagacgcgaccagttataatccgtgtgtaaactaaatgcctccctatccaagaaaatagtttctttagagcgggtacaataagtgactaatagctaaccttcgcctacgtggaagagagaaagtgttggagagagagaggaaagcagacgcttgcatgagagccggccaagcacaagcgcctaggccaattccccaatctacgaactgctgcatgtcagtattctaatatggcccaaagggagcaatcctggtggtcccacacatacataaaaaatggttctgtcaagatgctttgaatgacgtggatgtaaattggagctgatgcttactccactattaaacctgctcttagcagtctccaatgtttatgatcataagtagcattaaggtgggtcccattattcttatagttattaccacaatgtttaaagcaagagtaacctttaagatgggtcccacaatatactattctagtacttcttttattagccatgtaaatttttcatcctcacattcattttaccctattattttattgcttgtggtcaagccataagcttaaagctttcttttgcatttaatgccttatggctttgtttcacaatatatatggtcactataaaaccttatggcgtcttcttatggccacattgtggctgccctaagggcctgtttagatccatttggaatagcaaatggtaaaagttttggtggcaaaagttttgtcattgcaaaagtactgcatgttaaagttttgtcattctagcactaaagtgagagagagaaagagagagggagtggtcccaaagcactttttggcacaatttgctactatggactagcaaatgccaaatgccaaattgccaacttttactactagtatttagatccaaaatggcaaaaagtgctacaaaatggcaaaacttttcccattttggaggatctaaacagggccttacaccatatcacataatactttcacacttattactataattctaacacttttctcactaaccattccgattttacttcggtttccgttagcacgtttttcaaactactaaatgatgtgttatgtgtgaaaactttatatatagaagttgctttaaaatatcaaatatataaatttgttaagtttataataattaaaaacttaattaatcatatgctaatagctttctcgtttgacatacgttaatttaatattcatcttcatcatcagccacctcacacgatgcagtaggccaaaattttattccattatgttaaaagaatcagccacctcacatgatactattatgatatggtgcgtgcgcactaccgtgggtttgatcgtgacaaactacccaaaaaattgtacagcctgctgctgcgtacgcatccagaagaagcccatccgtcggcttctccgcggccgctcgtcccacggatctggaaatcgcatccgcatggtgtctggtccagtataggcccatgcgacgccacgccaggtcccgctcatctcttcaacagaaattagatggagataaagattttcgtgacacgttttttaaattactaaacagtacatttcatgctcaattaatctaaaatatcatattaatctatttttcaaattcgtaataattaaaactcaattaattatacattaataccaccttattttacgtaaaaaacttaattttcatcttcatcttcgtctttataagaaaaaaacaccacccctctctctctgcggcgcctagaatttcttaatctgagacctagaccctgtttagttaacaccaaactttccataaactttcaacttttcatcacatcacatccaaaacttttctactgagtttattttcaaactatcaactttccccgaacttctcttcaatttcaaaaaaaaaaaaaaaaacactgccctactggatgccccggccacgaaaagagattcgcaatcgcgattgctgctgcagctgcatgctgatcccactgtactctccaggtaggaggacgggggtgcgtggtacagttgacatttgatacttctctcgcctttctttattattctcccgctcccgagacgacaggaggaggtggagggggagagccatttcttcctcttcttctctcgccggcggcaaccctgcgagcctgcagtgacgccgccgccgccgctgcgtcggttctgagtttgcttcgtctccgggctcgctggtatggagactttttcttggtttccctcccttccatttcttgttcttggtgttcggcttgggatgcctgggatcgatggctgctgcgatgcgagagattcgtgcctcgttgattcatcgcctggttaatacgagggttcttgtattgttcttggtccgggaaaatgttaggtctgtttggtaattgtaatcttccatccatagcaccgtagaggtagagctcaatcttcggctaaaatcttgggtattttacggttctgaaaccaaaaatcttgtttttttttttctttttggtgatttgttcttgcggtaattaggcataattcatcttttgaggggcaatatgggtagtctcacaccacaggacgtcacaaaattgcgaaatcttgatgatgaattccgttgtatcatggtatcttgtcagatctatgatttctgaccgtatctgtatttagtggggtatgcggtagatgttagattttgtttttgagcagttgcagatgttagaattaacaggttctaaaaccactattatctttatgctagaattaacaggtcctaaaaccattattatcgttggtgaaatttctcttagtcaaagtccaaaagaggatgctgtcaatgctgcctcggtagtcatatacattgatcggtacattccaccccccttttctttgtccatggagtacatttcattgaaatgtcgaagtcaacaaacagaaaattgcaaaccaagttagggtcacaaatgtaaagcaggatccgtgcttgccatgttgtccttttctttttctgacgagcgaaatgcccgtacattgttacggaattaaaaaaaaatcatatcggcacatgtcaaagaggaaatctattttgaattaacatcaaagtttttgctgttttcactcccgtaaaatgggctccatttattactagcgtacaaggattatcatgattgagagctccaggatctattctattcgtgacttctactgttctaccgttattttggtttagtgggaggatagacaatgatcccgtatgtcagaatttgagttggtggttggttggtagcaaattcaccactcacgatcaccactacttcctttagatggagtatagattcaatctgatttctggcttcagtgaattgcttgcctcttacatgttctagacttgtagtgtgatgtcaattagttaggacttacttcatgtcaagtcgctggcttactgaataaatatgtgatagtcaattgaggagaggcacctgtcacagacaaaaagtatgaagtttgatgcacaaatatgggtccaaatccttttagtattatatattttattttatttattcccatctagttatggtaatgcattaatggttgcatctgtgcatggctgattggctggatgcgcataagtattctgtgaaatatcaatattggtgcacagagaactgaagatgttacaaacatgggcaaacttattgttacactaaaatattacaaacaacaagactataagtatacaggaaaaaagtatgaagtatctcacaataagagcttctaggcaaatttctgctgatgaaaatttttttgttctgttcttcggacttgtgctgtcttgtaagctggtttccccagcaaatgatgccgtgttggctttctataaatgccaggttgtatgacctactttctaaaaaaatcattgaatatccatacaatcttttttattattatttgtctagtataggtttacttctctcaaaagtcttgtaaacttctctagaagttggatttatcaagaaaatgctgttagccactattgggcatagtgatcttgtttgcagtctatatatgtatgttattcagctgttcatttagttgaacacttgcatttcatatttcattattcttcaaatatattataatcacacatgcaatattcaaaatcttatttcaaatgaatgatcaaagtggttttacacaagagcgatgaggttaattactaattatgtttgtgtgatgaagccctatatcctagtattagcgtccttaagttctcctctacatttattgattcaagtagttatttgaccactagcattggtctgtcttacaccatgatatttaccccatttcttccccttttggggtaactttgaagttgatcctcgtttagattactcatctagaaaatagtactctctgatccatgaggatgttgagcaaaggaccacattatatttgaatcaatagcatgtaatttctgtttcaggattgagctttgtcaagagcagaagaagtcatgtttagctttaggaaaaagcatgcctctcgcttcgattcagatgacattgagcaacaagaagcaaaggtactttcaaaagctatcatgtcatcttttataatgtaaaatacatggttctgaattacatcgacacactttttgaatatgttactacaatattgattttaatataaataaaattgtccaccttcaaaagtatttttttagaatgacaaatatgtttactgtggtatgaccatgctcagatgagtttaaattgcattgctcaagctgttaatttttatgggtactgttttgagtcttggcaacggagtgtttcaaatctactatgctgttgccaatttctcatccaaccatcttcaatgagcagatccaagagctcagagctgcacttgggccgttgtcttcctctggtaagaaatattgtactgaagcatgcttgagaagatatctagaggcccgtaactggaatgttgataagtccagaaaaatgttggaagaaagtcttaagtggagaacagcttacaggccagaagacattcgttgggtaaatccactattcctttttcttctcttgctcaattgattatttcccttgaaatcttgttgagtgactagaccatcctattaacagctttcttctgtaattttagcccgagatttctgttgaatcaaaaacaggtaaaatgtacagaacaagttttgtagatagaaaagggaaaactggcgtcattatgaaacccgcaaaacaaggaaaaattctggaccaacgttctttttaaccttttcgccttcaaaaaaaactaatgcttcctattcactgtttcaaacattcaaaacacatcgtcccatgaaaggcaggtacggtttcttgtatatacgttggagaatgcaatcctcagcttgcctgaagatcaagagaaaatggtttggttgatagatttcacaggatggaccttggcaaatgcgacacccataaagactgccagagaatgtgcaaatatcctgcaaaatcattaccctgagaggttggctatcgggatcctgtttaatccccccaaagtatttgaggctttttggaaggtacaggctctgattcgttttcataaatgaaatattgtgctatggatattgttctactcacatattagaaaccaagttatagtgtttgatacgggggaaaggaaatcttgattctttttgtaactcaaatgtttcaattgccttcaggttgtcaaacatttccttgacccaaaatcaatccagaaggtgaattttgtatacctgaagaacgaggagagcatgaagatcctgcacaagtacattgatccagaagtccttcctgtagagtttggaggaaagaacaatgtggtgtacagccatgaggagtactccaagttgatggtgaaagatgacattaaaatggcaagcttttgggcatcggatacaaaaactgaccatgttaacaaagtcattaacgagcactccgtccccgaggttacgcaacagtcgtcgctggtggctgcgaaagcgagctgaggagtatcaatctgccatgatgggggttataaaccaaaacaaattctaaaagacgatgtagaggactattggtatgttcatgataaataaatggaactgcagaataatttacctgggatgttacagctccatgtattactgctaaaaatctttagctaaagaccagtctacaaaaaatctttagctaaccgacctgagctacagattcagagattatagcgagttcattacaaactatcaccagtaaaaggaaataacagactttaatttgcccggtattatgtcttgtctctggatgtttttatcttaactctgccattatttgtctatttggatgttattctcagtgttctactttctttaattattcctattccgaacagcaccatgaaactaggatggacaattcggattctcttcaggcctttagtggaaaaaactttataacaagttgtagggcatcacctgtaaggtgatgcaacttctttcaggcccaatgtctttcaaccattccctacaatcatttacacaagatgctttttaagaaatggtataagaaaatttgacactgttaaatacttcatccgtctcataatatagtaaactagtactagtagtagtagggacacatcggagacacattattgtactacaaatatccacatttataataccatatgtcccacaagatatttaaaacttggcattgtttaaataagatatttgcattaaaaaatgccgcgccaggaagggttcgaaccttcgactttttgtttaggaaacaaacgctctatccactgagctacaggcgctctcaatgatgatatggccaccacttcttcttgggccgggccggcctgccacaaacggccattgcaattttggccttttctgataggccgctgtctcagcttggccttttctgaaccctgaagacagcagctcacctagaattgtactctcaaatgaacaaacaaacagattacacaccatcaaactatttacagagaaccaaagagacgaagattctgaaaagcagcacagaaaccaggcactgccaggcgtgaatggaacgaacatttctgctatgatcaacaatgaaacaatcaattacagtagggaagaagaaaaagaatcagctcgccattctttctttttaatcaagaggggaaagaaaaataacaacattgccaagccatttgtccagatcatgcattgggcaccaaccactaatccactatacgatcgcttcc

SEQ ID NO: 81997 - DNA, 1448 bp, Oryza sativa
attcaggacatgatacgcattcaaaactgcctcaccccaccattccttggaaagccctgcagtgtctaacatagcattcaccccatctcagttagagtacggttatttctttcggccaccccatttgattggggtgaatagggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatacaatgcctcatcctttgttttcaatagatacacatagcaaaatctagtgcaattatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacgcaagtatggcacttggaacctttgaccaaagtgaattttggaattaaactcaggttagctaagcgcgtcatacaaccgaaattcacatgacagagtcgcgaatgccacacattagactaatcattctcgctaatatggttcacagcattatgattattacacatgtcattcaaagaaaagcggaacaagcctccgctatcataacattttccaacaaaagtcccatatttaggtacgacacatttattggacttaaacacaagtctaaaaccttctctacacaatagagagccgctaactagattcttctttattgaagggacatgctgcacgttcttcagctgcacggtctttcccgaagtaaactttagatcgaccataccaacaccatgaacagccgcaagcgacccgtttcccatcaacaaggaggaacctctcccgacctggtaagaagaaaacagagaaatgtcagcacatacatgaatattagcaccagtgtccacccaccaatcaggtgaatgaaaaacagagagaactgtagataatattttaccgtaccccgatgttcctccgccctcgctaatgaccatgttggcagactttctgtctttgcgctcaggacagtccttggcccaatgcccagacttgtcacacacaaagcagtctacctttgcctttcccttgtctttcttcttaaaattggttgtagccttggatttgacatcaggcttaactttcttgttatcgtgggatgcatgagggttcttcttctgtaccatattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggtagtttggcaataaatgccacccgcacaat

SEQ ID NO: 81998 - DNA, 713 bp, Oryza sativa
cggctctggtaagaaagagtgtttgaggctctcttcctgatggaatgggcgaaggcgtgcgtaaaccccctgtcgccacctaccccaggatctgatcggtctgtgactggtcacagcccggataaccaggcgcgttgcatggcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcccgagatgttccatctcgactgccacagccgcatatccacctcatgcaccgcaaacgggcgaatgggattagtggaagcgtgggcgcgagaaacgagggggcaagat

SEQ ID NO: 81999 - DNA, 10438 bp, Oryza sativa
cattcgttgcagcatcatttgatgcactgatacctagccttccagtcaccagctccaacaaaacttttccaaagcaatagacatcatatgaacatgatgcagatggagaacctggttaaattagaggtttgtcaatgcacttgcatccatgaacctaaaacatctatagatacagttatacaacacaatttaacagtgtcatcatcagtttcaaacattaggcagctaacacttgaaagaaatgaaagcaagcatggatgcatggacttaccagaagatccttgatccgcagtcctacatttcccagaaaacaacacaacattagaaaatgagacgaatttcattcagtgcagcaaaaagaaattacataaaataaactggcagcagaacatgagccatatcaggatctgaaatgctaggagaaagtttccaattactttcgctaccaacgggcctactagcactatttttgtcctgtgcatatagaaaccaatttggaatttgcttagctgcaccctcaatacatgggagaggaaggataatatagtataattgactaatatatattcggaactcaaagcacaagtttaattcaaatgttagcaaaatgaataggcatgatgaactgaacagcgaagtgcaatcaagcattttatggatattcgagtcttacacgtagagctaagaaacagagtatgcagtgctaaaagttaaaacttacgatgaaaatctcaacagctttgtgatgacattttggtggccttccccttcttgaggacacacctcgctcaaactcccaaggcgcacatcaaatttatcatcaagaagaatactgctagcttgcacgtccctgtggcagatcatgatctcattagttcaacaaccaagattactcacatggtttactgcatgtttcactttaataccaaaacaatgctttcctagcgaaatgaagccaacaaagaacttctgatgcatttgcatgatatcaggaggggtgctcaaatctttaacattgtctagttggtagtaatatagtgcatagaaacatctcattgaaagtcacataaaaggatatttggaccaactgaattacggacaaggtgatcacacatattcagatttaacttgactataaaatagcatgataataaagaagtgcctatatataagatggaggatctagcaagtatacctgaacatagcatgccaactcatcagaattgcaacgtccaataaaaaacaatgctacataaccgccctccatttcccgcgaggtggataaacaaaaaacagtgctgttcatattctgatttttttcggtttaagtaagctatggatcgtataattagtacacagcagtaattcagcaatatccaaattcattaaatatgtggccagagcattccaactgaaataattttttcattcacataaatacaaagaagtttatacccgaaaagcaaacatccaactgaaataaattttgtattcatgtaaatacaaagaagtttatacctgtgaaccattggtggattacactcgtggtggagatagcatagtgcctctgccactcctgttgcaattttcagcctctttatccagtccaaagattgcaggccttcctcttcctcccctgactttctgtgcagtgcacttgataagtcgccattccggacaaatatatacacgagaaatttctcctcctctttatcaaggcaatgccccatgatcggcaccagcctttcatgcaatcctttggcaaataaatctagctccgccatataagcatctttcttagccatgctggaagttatcctcttcacaaccacagaggtcccatcatggagcgccccaaggtaaagatcacctgagtgaccatgcttgataagcctatcatctccaaagtccgtggtggcttcgacgagctggtcataaccgaatgaatcaccgacctttgccaagtttgcaggcgatgcagaaggttgcgtgccagcagtaactgcacccccaccagttccagacgctcccaactgtgtgttccgcacgccactttcccgctgatcattcctactcccattcctcctactcccagagcacaccaagcaatacaaaatggcagcaatcacagctaccaagaggacaccgccgcaaatggctccaatcagtatatacttcaaattcttgtgcccctttttccttcccggtgaagctggcatcgcaggctgcggtgtgggtgcaggacctgaaacattatacggcaaaccacgtgcagcatagaactgctgacattctgcctggctacgctgtccagtgacatcaacgaagcaattcaactcaaatgagaaattcccaccatcaccattggatacacccagtttgccgtcgaagtaattcccagagatattggccagcttcgtcctaccgaaaagttggccaaaggatcccggcacgccaccatagaagaggttcccggacagatccaccacctgtacattggatggaagcgcgagccctgtatccggcaatgcgccggtgaggttggtccgagacacatcgagaacgctcagctccgggagcgaccagaccgccttgggtagctcgcctgagaaggcattgccagagaggttgagagtcttgagccgagcgagcccggcgagagcactgccagggagctgccccgagagtagattccccgcgaggttgagagtggtgaggttgctgaggccggcgatggccgaggcggggatctcccccgtgacggcgcagccggagatgtcgaggagctggaaggtgggcgcgagccccgcgccgagccacgccggaagggagcctggcaggccgaacccgggcgcgctgaaggcctcgagccgcgtgaggttgcgcagcccgtcgacggcgaaccgcggcgccaggcgccccagccgcgtgcggcgcagcccggcgaggtcgaccgacacgacgcggccgccgctgcagcgcaccccggcccacgccgtgcaggggtcggcgcggcgcggccagtcccgcgcgcgcagcccgagcgagccgcgcagcgcgtagagccccgagagatccgcccgcgacgtgaggttcccctgctgcgccaccaccgccccgggcgccgccaccaccgccacgagcagcagtagccgcgcccagaccccaccaccaccacaacaacaaccaccagcccgcatcatctcctcctcctccatccaccaccaccaccaccaccacctccgccgccgccgccactccccattcctccccactccaaactatggatggaatcgcggagaagccaggcaggcagcggagagacggaattgggagggaaattaaacgcaataaaggagaggggcgcagagcaacgcagggtcgcaggtacagaagccaccaccaccaccaccctcctccttgggggctcaccttctctaccccgccatcaatgcccaaagttacactcccccaactgcctcccaattattaccccctctcctcctcctctctccgccgatccgaacccaaattccactccactccaccgccgccgcggtcacgccaccgggtgcgagcagccgccgccgccggagccggcgaagagagacgacgacgacgaggaggtcaggaggaggaagacgaggagatgggaggagggagagagagagagctgatatcgtggggggtttcggttgtttaaggaagctgttaaatgttttttttgaaatcaaatcttccgggctgaaatggcatgcgatttccccgacgatttccccgatttccctgtgcactggctggctcgctcactcacaacttgccttttctccctggctgcgttgcgttttgacggcgctgcccctggtgcgcggggctcaattgccggcggctgccactgagagggtgagggtgagtgaacccggccgcgcgtggtgggtgggtctcgctctcgcggcgggtttggttcggtgcgtggtggctgcacgtacggccggttgcgaggagggggggtttggtggggtttttcgggcgggtcaacgagggccgtgggcgcgggcgtcgtgcgcgttatctttgggtgggttgaaattcagattttacgtgattttcgttgacatgctttttaaattattaaatagtgtatttcgtaaaaaaaactttctatgtaaaatttattttaaaatattaaatatatttatttatcaagtttataataattaaaacttaattattcaaacaccaatttaatctttatctatgtcagtttcatacaccactaaccatcgtagatgtcgattctgattcatttttgaattttctttttttctttgtgcttcagataagagtgaaagtcggatgtataatctgtgttgtaatccagagcaatgttagatttatgttgtgtgctgtgcacgtagagatatttttctttattttgggaggacattataacgggctaaatagatatgatatgatatgatacgagcatttgatgggcggcagcatttaggaggcgaaaatacgacagttcgtttctacagttgtttacgtgcaggggtagtgtcaattaaccacagccaggcagccagcctcatgctagctagcacgtgagcattgaatgtaggatttctccttttaaacggatggaattgatgtattactggatttgcaccctgcaggtttgccggactgggaatgagatgttgtagaagaattgcaaaatgcattggctgctgctgtacccgcaagcgtttcatagcatccattgatttttccttcttttttttcttcttttcccggctggctttgacacggcagtaatgagtaatgacaggtctagtttgtggtggccactggacaagccactactactactacgcggtggagccatcgcgacgggtggatcccaggtcggacgcgtcaggtaataaaaacgaacagaagagagcgcggcacgtcgcgcgagcccaccaccacaggcggcggccggcgtcgcaaaaccgcacaaggcgaggcgaggcgcagcgcaacgcaatacccttcacgtcacgttcgttcgttcgttcgttcggacgccggcgccgcggcggggtggaggcgtatcccattcccatccaccgaaccgtagtccattctgttagcaatgtttcatgcatggcatgtctgtcaatatgtttccttggattaccaatcctcatgattcctctcggtgctgttccataaaccgattgagcaatcttagaaaggttttcgtgtatatgtactccacatctcaatcaatggatttgtgcgttgagtcaatcactctaacatggtatcagattctctttccgcttccgctccccaaccctagctctcgatgtcgctccctatgccagccgacgccatgtcgtcgcctcctccccccgccgcgcacgacgccgtcttcacccggatcgtccaagccatcgccgactccatccacgccagctacgacgtacccgccggactctccgtcgaccccgacgtcatccgctccgtcgccgacgccgcggctgcccaggccaaaacggcagctcacgacgccctcgccacccaccttcgggctcttcttcaagtgacagaacacgacgcgtcgtcggccctcgtcgacaccacgtcgccggccgccggccccgtcgccacacccacgtccggcgccatgcccacgctggtgatcttgtctacttccgacctggcggtcattgcggccattgagcaatcttaggaaggttttcgtgtatatgtactccgcatctcaatcaatggatttgtgcgttgagtcaatcactctaacacattcgtgcgccgcccgcgcgccgagagaatgtctcggtttggctcacggtcgcctgcctcttccttggatttttgcagagtgcgcgtgcccccgtactttgacggcttctcccgtcccgttgacacaacacatcatggaactatctaaaaaaatgctagtacaattttttaagggaaaaactttcaaatctaactataatataattgtaatataattttactacaactataatataactcgtacataagtattaaaataatacatgcaactttatatctaacttatatagatattacaatgtagttatagtgcagttacaatataactatagtataattatattataattacactacaaatatactatacttatacttacagttacttacatttaaaaaaaattgccaaaaaaatttgcgacagttttttagcaattccttagattaataggtacttctaaattatatgtagtatattatacatataatttttttctagaaaacaatatgggtattatcttataatagtgtctaaatcaaacttatttacatctttaaataattatcacaacccattcagcacaaaataacacaaagaattaagaaacgatcagaagtgttacgtaagcgtagttcaactagtgtttttctctttttttaactaatccacctgagttcaaagtcgtagtgtttaacacggatacttatatttacggttaataatttttattgtatttaaaatatcaaaagtatttttttaaaataaaacttttatacattttttcagtgattatagcacaggactgagaaatagaaaacagtgaaaaaaaaggcacaaaactagttccattcttcgactgcttctgcagtgccgtggaggcgtggcatcgtctcttggatccttctgaaattccatctacttctatcttcttttatcatgagctgtattatatataaacaagaagggacatcgatctgttgtactagtattaaaatttctatgcgtatcaacaactgccactagtaccgatactctacttatgtctgctaaaacaaactgcacttccaacaaccatgctccgattcttcccgtatacatacagctcggatgtgcaactgtgggtgggccccctgcacgcaagtattacaccactagccgtggaggcggcctcgtgttagttagaaaatcttgggtaaataatatggtcaagctgtggatgatactgcactattctaacctaaaaaacaaccaaacctacctatacgtgcaatgaaattattgagctatagcagtagctatagcagtatatgtagcactatctctcagattattccccagttgtaaagtgagcgatcgatcgaactgcgccgtttcagtaggtgcggtctccacacagtccatatacctgatagagtgagctgtccatctctctgtgtaccctagtactgtattactgtaccagtcactagctcgatcctctgacttcgggaagataaggcatgggtgaacaggaggtgcaaaacagaaatagataaaaaaaaccctcaattattatactacatccgcttcaaaatatatcaacctaatattaaatgagatttatacatacttctaaacgggtgttttgtgttaaaaaaaggaatcgctggaaaacttctgcaagtttttacacataaaatttttagatttgtggccatccaatcaccttgagatttgtgaatgaagaaaaaattactagaaagaaattctcacgcatatcacgcgtaagagcatagtgctagccaaccaaatcataggtgaataaaagttttatgtaagttatatctgggttacattgtaattacactccaattttaatatagttttatctgaaaatttttcactcaaaaaacttattgggatactttactagaacaacatatcaactgtgtaggaaagaacaacatatcaactgtgtaggaattatttcactcgtttatgccctcaagtaactataaaaaattagataatccatcaaattcaactatcccaatcaaacggggcagtgggagatttagttaagcttttgaaacgttggccatcaacgattcctcaaatgctaggtaaaagaatgtgcagattagtgtaaaaaaatgcagtatcgtagtactataagatctttttacaaacttattataatataaaatttaaaatcttgatcatattttgactacatatcaaatatgagtattatttacgaccagggtactatttaacaatgtgcacccaataatgattccaaaattaaaacaccgtttcatgggtactgtttacaattgctgtgccgtgttatcttggtcgcccaccatgaatcagacagctactctacatccaaattcatgttatatggtagtgcttctcttgacttgtttctgtgaagttatggaggagtactatacaaatcctcacgcaataggtaaacaaatgattctgctgggatatatatgtgggtgtgaatatcaatattttaaatagcgggctaaggtatttagcggttagcttctcaaacagttatagcggcagctatagcgggttaaatagagttatagcggctaaattgtacacgagagcaaatagctagaacccttctcaaacagctatagcgggatagcgggagatttaaaaccctggtgaatatacgatgatatatatgactgcattattagattaattattactaggcactaattagcatacttatgcttaacctaaaatagatgatactggctattgcaaaatgcaagcaggttgttgacaagattagaagcttgagccaattataggagactctagtcgctggtataatagcatgcacaaagtactactagcccagtggcacagtacagccagtaggttaatttgcttatcaatgcaaccaatagcactagcatcaacggttagaaggaagttgtacagcattacataggcaagctagccaagtagcgagacgttgatctccaactagcaagaaattaactatgttggtactaattaatgaagtctattctaccgatcaatcaacagtgtcaagtaggtaaatgcgttgagaattttgtgaagacgccaattaaacaattgcgtggataaatagtttgtccaatcgaacagtatgcaaccatccgataattgaaaatttactttaatttgcacgtcttctacttgtaagccacagctgcttggtaatctctaaattaaagtataataagatgtgattctatcctagctcatacccggcctccaatgaagttccatagatcttaaagcacttacttaggggtagttaatagtcaacaacaattgaagcaaagcgtgagtgtaaatcacttaggaatactactcagcaaatttgagagttatatttcaaatgacattaaccaacaaaaaaaaattaacctccatgtagaattattcttgacattatatctgttataatttgatttctaatttattttttgaattcgaattctgaaacttgaattgtagagacattagtactgaactactgatgaactttctgatggtgctatcaacgggacaattaatcattcaccatgcttgctgcttcaaagccaaccgttgatccattccaataaaggagggaagaataagaataaacacgtctgatggcatatcgtccttttgaaaaggaatcaagcgctgtacaaaagtcaaaatggctataaagcccactaaaagcaggtacaatagcatgctataagccagctgcaaacatattttaagaagataaatgaggagagaagggcagcggggtacagatttgtagccagttgtagcacggattctatgacacagcgtgtgtatgacgggtgggaccatgtattaatagtgtagcatataactattgtatgaataagctattatattggctatagataaattagagccagtagttggctatactattaaacttgctctaatgatagtatacttttaagatgatttaatttcacacgcatgcgcctgctataattaatttaatttcagcttaggagacaataaaatgcattgccgttctgcaaagaacactagaacgaacatgccagtttttcgaagcatcaaactaaaatacgatacgttatgtagatttttgttaactttaggtggagatttacaaataacttgaataaatgcatgtctcctttagtgttagagcattagtctttatatcgtgagttataggattgcatgtgctctctgttgaacaaattgtgtaataagtggttgtaacttcgttgatgcaaaggccagattttattccattatctaaaaaatctaattaaagataacgtggaggagtcgtgaacaaattatttctctcgtcagggtttgaagccttatgcctatgaatattatgtacatgtggctatttcagtgattagttttggtttaccctttccaagaggaaaattttgagtgcattactatttgtttggtacacatttagccggcacgtcagtttcacaggataggatataattgaaaacgagcatgatataattgacctgatcactctctctctctctgtgtttttcttttgcagcaatagaccatactaggtag

SEQ ID NO: 82000 - DNA, 647 bp, Oryza sativa
taatagatcacagcaagtcatatccctgatcgagttacatgtcatttactcaaagctaggccctgtttagatgggactaaagttttaagtcctatcacatcggatgtttggacattaattataaatattaaacgtagactattaataaaacccatccataatcttggactaattcacgagacgaatctattgagcctaattaatccatgattagcctatgtgatgctacagtaaacattctctaataatggattaattaggcttaaaaagtttatctcgcgaattagcttttatttatataattagttttgtaagtagtttatatttaatagtctaaattagtgtctaaatacaaggaccaaaattaagtcctgaatcccaacaccaccacgacagcaggattgaagaggagttgttttcgtcccagtccgacatcctggtcagcttctcgttacaagtctacggtatgaataaatacagtagtgtactacgaactccttttactgctaccactgcagcactcgctgggtatggccgtatgggtattggtacaccgtactacgcaagaattggtttgagaaacagggtatgcataactgcagcattagcatggaccaggaccaccagcattaactttgtttcctgtg

SEQ ID NO: 82001 - DNA, 669 bp, Oryza sativa
ccattctcgcgaaccttccacacacagactatgagcttagaatttcacccaaggccccgggccgaaccggcaaaggggggcctgcgcggtctcccggtgaggagccccacgctccgtcatctggcgcgccaggtaaggggctctgcgtgtgtttttctaagctctcgcattctttcgtgtgcgccaagcttttcctgttcagcccaatggccgaacaagcaaaggcgcacaacctctctccgagagttagcggtgacgacgggcagccgaacccacgccgtcgagctcgtactccaccgcccccttcacgccaaagtcctaagcgggaggaggcgctcgagaaggtcgaaagatccgcgacttccacatccaccggtgaaggggaaaggcggctagatggggagcgtcgcctcctcgtctacggcgacggcagcacgccccaaggcgcgctccaagctgcgggcgcgctcctacgtcacccggccattgtccctgacccggagtcttcagcccaacgttggctggacgacgtggccaacttggtcatgacggcacggcagcgcctaagtgctggtgggcggtcctccgtcaccaagaacctctgcgctgctaccaccggcttcgtgtcgtcaagcaaaaggcgcggccagcggcggctgttgcttcgca

SEQ ID NO: 82002 - DNA, 3346 bp, Oryza sativa
tggtgcaaattagctagctcactctatcactgcgctgcattagcttagcatgacacgtgtctccgatccaaacctccatgggcccacccaatcaagtcctgatggcgaataaatccttctctatctggtcacccatcacacgtgtacagagcccggctagctgcatgccctttcagcaacttggctttgttaattagccgattaattagcgtcgattaaccacagctccaggttctacgtaatcgtgagattaacctaactacaattttaattacggatttgaaaaaaatgtgcacttgcttacccatgcgtacacagttatatattctcaaaatattgttattatattccctccgctcctaaaatataatggattttggttggatgggacatatcatagtacaataaatctatacaggaagcctgtccaaattcgttgtattatgattcttttttgttagataatgaaatatactttcagtatttgctcaacgagctacaaccaattattacaccaaatcgctcaaaagcgttcacaatctaatgagaccaaaacagaaagcaacacaaactaataagcatcaacacaagattaaatatctacaattattgaaatcttattcgtgaaccttcattcgaagttggcaaaaatgtacatattattcattgtactataatatatcatatcaatcaaaatcttttatattttgatataaagagagtattagttaaagatagatcgatcctggttggacaaatccaaccgcagttcaattccggcataatccagggaaatggtattcatgttctaaaacataggtagcgtgttgctagagctatctatctatctatcttctacctgtcgctaatgatcttttcaactgtgacatttgtgttactcaattaatccaacaactccccagcccaagagtaattaaactaaaccacgtaattagtcatgtaattaaactgcctgcagtccattccggtgtgacacttgcgcaaaacaacgagagaagcttcaatatgtttcttcacacgtgtgcgtacgtagcgccaagtggatcctcaatgattaatggtgatcaatttgcatctaataattgagcatcacggattggtatggttctcatttaattacctttggataaatgtgcatgacaaccgaggcatgtttgatggtggagttgtatgtgtaacttaattaggccttttttttcttctaattgtttaaaatttagagtattattttaatgggtatttagggtttcaataattatgggttctttatcttgtatttggtgcttattcgtttgtgcttgcgttttgttaaatctcggtgtgttcgtgtgaaactatctgtgtgcgattgctttagagcgaatttgtataataatttattgtagttcattaagtaaagactggattttattttattatcttaaaaaaggtatttagggccgggatctagtcttaactgttctactctcggttccaccctgcctttaattacgtttactaactaacggatatggtgtttgatttttacaggctctccgtctcttgaccatgtgtaaggatcagcacacgctttaaatggatatgtgtttggtgacgtgcaatcgaaaaatgatatagttaatagccatatgtcaacaatgttctatacagtaattagcatacaaatggaaacggaactttattagccatgtgccacattggctacctgcaggatggagaggatgcatatgcatgatatgatgttgtacgaaccttatcataacgcgtaaagacaaaccgaccaaaggtcaattacgcaaccggagaattaattccaacacctacaactctccgttttaaatgtacatcacttttaaacatacgttttatcattaaacttatttaaaactttaactttataaaatacttactcagtctcaaaatataaaagatattttggacggatgagagatttacttagtagtataaatctggacagactccatatccaaattcattatactaaaagttttcttatccgtccaaaatttcttatattttaaatccatatccaaattcattatattaaaagtgtcttatccattcaaaattccttatattttaaaacggaggaagtataagttatgcatgcttaaaatactatgaaacaaaagagataataattgtataaattttttcaataaacaaatgattaaatatatatgtcaggaggaaagtactaatacagtacatatatgtatacaagatcacaatacacaccgtatcattggttaggtatatatatgagagagatacatgcactagtataatacacattcacagtttcacaccaagtagcttccaagatcacaacacttcatagcatttgttaggcacgcatgagagagatacattcactactctactcttagattttacatttttacaaagtatatgtatgactttaatcttttctatgaacagaactatatgtacatatttccctatataagcatgattttgatgaacaacaaacataaaagggaaaacatttacatgatcaatgcacgcgtatatatatatcccatatttaattagcatgtgcatgcagatgcagtgcaagaaaaaaaactgcaagctaagacctcacgacgtcgccgatggctggcggcggagcaccggcgggatgacggcggcggcgaaggggccaaaatgaggccgtctggcgccgaacaaagcggcggacgacgacggcggtgagccagcgcccggagacggcacggcggcggcagcggtgatggcggcaggggcgccgccgccggcgaagacgcgcggagagaagctctcagaagctgccgcagcaacgaccttgctatgctcacatgaagggcacacccggaacaccgtgccggcagcagctggtaggtggtggaggccgtacagcggcgggtacgacgacgtggtggttcggagagtgccacgcagctcggccacctccctctgcagccgccggttctcccgcgtcagcctctcgcagcagcgcttcagatgctcgcagtccacctccgtctgcttcagcttcgtcctgagaatgatatatacatatatgttgagatgattgattcatgaatcatgatatagtttggagaatagctagctatagctagcatcattcttaatttggttgagatattggagaacacagcaaattaaagggagattagtagtatatggtatggtttgtttgttacctagctcttctgttttggaaccagacctccacttggcgcggtcgaaggttgagccgattagctaaatcactcttttgtttctgtatacgaaatga

SEQ ID NO: 82003 - DNA, 4647 bp, Oryza sativa
gatggctgcacttacaaacttacagaggcagagttccatggaggccaaccttggtcatggcccctccagctttagaaatattgcattattggagtccccaagtctttgatactctaatacttcacaaaatagcacaataaccgttcaaagaagctatcacactgtctctctccaatttattgttcaagctccgccgctgcaagcggagcaagttgctgcgcggtgtttcttttttttttcacgaacacgcagtgtgtgtcagcattagaagaaaagagttttagttatacaacacaataagcctgaccggcccttgccaagtaacaagggagggatagcaggggttgaacaaagagaagggatacaaactaacaaaattgctgctcctagacagaggaagaaaaaaggaaaaggaaccccctatcctcccaataggtcccaaaacgaagcggcactagctaaagactagagcgctgtttctgttaattatcacaaactaaagtacccatgtaactcgccagagatagaagggaagatgaggtcaaatcgtgatatattgcttagttatgagcatttaacaagagatgcaaggaaggtgggaagtctctctttgttttctatctcgatcgtgtgaatgaatctggacaatatttatgaaagacggcacacgaatccaggcagatgtacaagggattggcgtgacaattttacacaaaccaacggctaaaaagggattgcaccacatgtacatcactggagcaagtgaaatttcaccataaaagcagccagctttacgcgagataatagcgaaaggaggagagatttgctccggtccaacaaaaagtacatcgaggtaccagtacctcacggtaccaagtcgtttctgatcgttggatctaaaaatgcccattctatccagctagattcaatgatcggaaataatttagtaccgtgaggtaccggtacctcgagataaccggaacaaatctcaaaagatgaagccctatcgcgaccatgaaattcaggtgaccaaatccactctagaggggcttcatcctgcgaccttgaaggtgcctgccgcaagatacataataaactggttggttgttgctagcattaaaatcaagagctgcatatatgccaaattaaacatgtccactgaattatgaaagtctaaagcttgtttgagaggaagaattgggtcaggcaacagcttaccaataagatgtatgagagctcctgacgtcttccaagcctaccatacaatagcaagccaaccattgggctggctgaactccatgaaatattcttgtttcatctctcttaacatcaagctaaaaaaacatgttgctgctacttcattttatctactcttttatggaattcagcatgtcaactatctagttagtcatgtcaactatcttgagaaatgctgagcaaaaaacttagtagcaggaggctagtttgtaacaggaaagctcccgatgcctcttaggcctaactattatatatggagcaacaagccactggagtggtctatctcccatcaactcttcaatatttgtttttcagtctggtgtcctttctcttgttatatgtggaacaaaatgatacggtcatgtagaaagtgttatagctttgtgcatctttggatgccaggatgtaattattctattatcttaaaaaaataaaaaatatgatcaagtatgatttaaatgctcatcagttactattagctaccacacactgatgcaatagaaggttgcagaacagacacgatttggtttggtggcaaattaatttaagtggtgtttttttgaggaaacctacatttacgtcgaaaaagttagcccattcgataaaccaggtcatatccaaccatttgataggacagatatcagatagctttgtggaagccatggattgttatttttttcaagaagaaacctccttttgtccatatttctagtcatcaaattggcggctttgtactttgttttttcttgatgaaatacagaatacacatttcgccacttccaaaaaaaaaaaaacagagtgggtgaattatgtttttcagaaattcagcatataccattccaaccacagtcatgaagtgtacaggcaggcaacttcgtcgatgggcttctaggcgacgaccaacataagaggcctgagagatgcagtaactcatttttatagaagtttctaagaaaactttcaaggtaaaatggtgatgacgagaacttatgcgtgtgagctgatcatggtacaaagatcacatataaaatggtgaccagttacatataaaatgcaatatgtttccttgatgattgaggaccctgtagctaatcatgtctagttatccgataaatgttgtggtaaagaagttgaaggaatgggctattttgtagtgggaaagctcccggtacctcctaggcctaactttcaacaacaagccactgtagtggcccatcaactcttcatctctttctcaacctggggtcttggatcctgtcttttataatgtcggaaaaaaggataatctgtactccctccatttcattttaggtgtagttataatttttcatgcccaactttgatcgtccgttttatttgaaaattttttaaaaaaatttaaaaacttaagccatgcataaagtactatttgtgttttatcatctcataacaataaaaatactaattataaaaaaattttaaataagacagacgattaaagttgggcacgaaaacttatggttgcacttaaaataggatgatcgaagggagtaataaccgatcatgactttgtgaatcgatcgtcagatgcaacgattgcgatattattattacactatgtttgaaagattgagtgtcatgtttcatacagtcgatttcaatgcagcaaggcaacattcacgcaaggaagagctgcagacaaaattaacgaggcgaggatttggatgggtgcgtcatggattaatacaatggaatacattagcagcatgagatgatccagcaataatcaagagtgatccaaactaaagagttggaatgcttttctttcgtgtatgaggtcctcttttcagtcgaaatactacctccattttttaatatatgacacatttgactttttgacaaacatctaacagttcgagaattacatcgctaactctagcagagtcaactacaactgttcaaccagatcacccgtgcatcagcggaatcagcagttgaactgttgaagttaattaccagcgtctaagaagatccacgagacaacagaaaaggaagaagctgcagtttgctccctagttgaggatatagaccagattgactggacaataaactgttctgcaaccttgaagaagcctacgagatgcagaaacatgtgtcgcatgccaaaacatgtccactgtgccactgcaccagagttctgaaactctgaaacttgcttgagagcagaagtgaaacaacggttatgcaacagtttaccaccggcgtatctgacagctcctgatgcctcccagacctactatacagtagcaactgggcgatgagctccaagaactacttcttttgttcactgatgacttgttgttgttttttcactaccgctgtcaatatatgatcaatgtttactgatgcccatcacttcccaaactaagaaatgatgtcactgaataaagacggccagaaggtgaaaaatgcatttgattggttagttatttggacaaacagaagcacgctaatgcgacagcaggagatgcatcgacagatgcatggtgacctgttacatgttatcgagtctatatagcatctgattgaagtgatcatttaaatacagctatattccagttcaatgcagcacataacttcttttgtactggtggctaaaatgggtttgcacaagcggggacaaccgcctttgagaaaatgtctgtgaaaatgctatatttccataggccgggaagcaaccagctgaggaaatgcatttccacattttaatttttcaggtgaaagaaaggtaaataaattttgtattttagtatgtgtctatacatggtcaatttttcatagctatgcaaaataaatacgaatggtttggtggttatagagagtaaggtgaaaatgcgtgaaactggtaattatgtgaacgaacagaagttcatgcaatttactctgaacttgtgaggacatttgcaaaaacaaaatgaacagagggactgtgaattttgtttttcagaagttcagcgaagcgctttcaaacaacagtgcaattcatgacaatgctgacttcgtcaatgggcttccagatgattgatgatggacatagcactagaaggactgagcgatgcatcaacccatttgtaactatcaatgtttctataaaggggggaaaaaagatgctagaggaaaaatggtgaggttaagaacttaaatgagcctataatgagagaaagatctatataggcaaggtgactagtcacatgtagaatgtaatatgatttcttgatgcaccattcctgtgtggttggtatcttgaaaattcccaagacagttagcaaagaacacactgggaattgacccattgacaggacatttcccggtgtctcccatacctaagtgtcctagaagagatttgctccg

SEQ ID NO: 82004 - DNA, 1359 bp, Oryza sativa
ccacctacagaccaacctggaagttgcaactaatcataacaacagagcaaatatgtaaagttctccttcgcttaccggtctctgcagaggatacaaacagagggaagctcaagctctcgacaggagcctcgccatgagggcgagtttcatcttcttctccctccatagcttcttctgatgattgtgtgcatgttgtctggtcatcctgttcatctcttctagttgctcttactccaagcacaagctccaggtcttcttcatcgcccatgcatgttggtataagcaccggtgtaggcgcaatggtggccttcactggagctggagagtcccctagactaagctcaagttccatatcaaggagagagaggggtcatggagtgaggaggcaaagaggaagcaataagcaactatcatatatatagtggtgatgggccaatcatcagagattgaccagaataataaaataacagtatccaagatgactaagtaatcagaatatagttttagattactgtttatttaatgctagggaaggtgatcaatctaatcacaaataattggaatcaaaagttcatgtgccattagctcggtgattcttgaattattatatcagtgaaggtttgcttatttccaagaggattttccgcatggacattctatatttgagttgttccttcagtatatattctttctgattaacgaatgtaaataatattggagaaatatgaactctttatgtctcacagtagtttagtatttttcatatgcataaaaggtctttttattaccaaatcattgtacttcgttttaggcaattaaaacataccatttctttttgtagtcatagcttatatatagatgtctcaatatgcagaagttatataggaaatattaaagatttccaatggttgcgatagagccgtgtcaactgaccataatgtttcttgaaacagaaggaaattaggtggggaaaaaggagagattatttcctccagtacaacattttttaactttgaaagaaaaagcatggctgaaagcttccatctattcacagtttttgaattatcacttaattgtacagacagtgatactgagcataacaaaggtagaaattactttgtcataaaaattgcttcagaagttatccctcctcaaagattatttaataaaccagtggtataaaatgaatataaaataaaacaataatgcaataaagtctcattgaattaatcgtatatcaccaggtggtaagtaggaaagctgtggtaaactggtaatgtctagaatctgtatatgtcaaatctgaactggaatcatctatgaactgagttgagtggggcctatatctactgatataga

SEQ ID NO: 82005 - DNA, 3449 bp, Oryza sativa
tcatctccctcaatggccgatgatgggggcggcaaaaaccggcgacgacgaggctcgaaggcggcggggtcggcggggttggcgacggcaaggcgcggggttgccgacagcaaggcgcggggtcggcggcggcaacagcgaggcgtggggtcaacggcggtaacggcgagacggcggggtcggcgcggctcccctcccctccctcctagattcggtcgaaggggggaggggggaggagaggtggcggcggcggcggttcccctccctcccagatccggccggagggaggccggggaaaggcagcggcagtggcgacagttctcctccctcctagatccagccggagggaggctgggggagggcggcggcgacagttcccctccctcccaaatctggctggagggtgccccggggagggcggtggcggcggcagtgcccctgcgcagttcccctaaccctagatcggccggaggtgggtaggggcgcgggtgtggtggcggagaatttttcttgttcgtcgagatgattttcacaagcgggtgactgggccatttgcgaaaggcattgacatacaggcggatcgttccccgcctgaaaaaaatcatttgtgtccgcctgaataaaccattttctagtagtgagataccaaattttgtactaaaaatcttggttcctctcgatacctcttaagaactataaaatttcaaataagaaattaaagcactaaataaacatgtttggatcttctcaaaaaaaaattaaagattattgtattccgttgattgtatcgtgggtgctgaatattgtgccttcaagaggccccagtcactcatatatagagatgatgcggggtaggattagaaggtagaaaacttagccatatatggctttagttttctggtctctattttttatttatttgaataggattccataccctatattttgtagtacaagaaatcatactatggcctgatttagttcctaactttttcttcaaaccttcaacttttctatcacatcaaaactttcctacacacacaaactttcaacttttcagtcacatcgttccaatttcaatcaaacttttaattttgacgtgacctaaacacaccctaggctagtttgagtctaccttctatctcctagatcaggcccactctcccttcatagccattaattatgcctgtcgggtgggtacccagatccatgatcgctacagggtcctgtgacttgcgaaattgcagtacaacctactagcaactggatcggttggttgctgtgttcgtttatcgcggtcattgcttcaaaatatcatataggtgtaggcactatataggtgccgaaagtgctaaaaccaaaacctatagtcatttttccatttttacgggttgaaatctcaaaaaaaaaaaaacctttaaacaattataggtgtcggttaaccgacacatattctataggtatcggtttttttttaaaaaaaagacacctttaatatattaatatattataggtgtcagttaattaaaaatcgacacctataatatacggttttaaaaaaaaagatacccgcagaaatcgagctgggccgacaatcgagccaagccagtttttttttattcttgtgacctcaaaggtgccgggcacctttaaatattcacatcagtgccgcctccgtggtgtcgcttgggaaaaccggcacctatgtggggttcccaaccggcactaatgtggttttatgtggcagtgagttgggaacggtttcctatggcatggaaaacggaacagttcattagtgcgattaattaagtataagtctaaaaatagaaaatagattaatataaatttttaaagtaactatctaccatatataaatacatatatgtatatatatatatatataaatacacatatatatatatatatatggtgtgctacctagttacgtaacacctctcacagagtctccttgcgtgtccctactaggcccagcccacccccgcctgcacccaccaaagtaatttttttactatgattagcaccgtctatttatatgtgtttctatccggcagtaaccatccaaccccttatccccgaaatttttggatcatccactcagccggcgaacgcctcaccctgccgtcaagatggccagaccagctgggatgcggtgaagaaggagcggctagtgcagtcagcacagctaggggtcgccaaactccacatcggagtggcgttagaggacctgccgttgagggggagccgccgtcatccgatcagatctggagccaccgtcgccatggctctccaccgcggaggcctaggcagccaaggacacgaggtgactgccaagctcctccaacgcctgccgcagcgccgtccacccctcccgccatcggcgatgttcatgaaggaaacgggatgtaacccgatccgctgggaccagcgccggtggcaccaggagagccgcgacaggtccggggcatcaggcatggcttcctcctccttgctcatcacggaccagcgctgtatcggtgagacctggcggctggaggctggccgtccctgtgctatgcgtggattccaggcagatttggcgctgatggctgacattgcctgcgcagggccacacctgctgctcgtcaatttcttccctatctacaagctgggtcctcaccaacacctgcgacacttctcatgttggtccctagctctgctctcctttatctcctctctttcaattgaaggggtgggtaccagcaaccttcttcttgccagtaaaacaaatagatttttcctcttcgattgtgcggtcttaatttgcaacagtatttttttattttatttttttttgcatttgctcattgattttgttgtagattgccggcacccaaagacagccgaggacttcctgaagctgagccccggccgcaaggttaatttttctctagacgcatcttgattggtatatgtattagtgttaatcctgagtaacatgaccacagaagaaataatctgcagctgtggttggtattcacactccactatgattgatggaactgatggtttgggtgttgctgatttgggagttggtgacattgaaacaaccactgattgcacaaacacatcaaatatatgtataagttttatgagtctattagtatatgttctttaggttatttttttttgtactagtcttgtatctgacattttgaattgctgacaaatacatgtatgaaattttaggttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatggagcttgagaccgtgtgttctgcatgcagagtactcgagcata

SEQ ID NO: 82006 - DNA, 7166 bp, Oryza sativa
gtcaagcattgacaaagatttgtcatttgtggatgttgatgcatgagcttgtgatcacaaatcacaattagacgccggtggacaacccattttcttgcagtggttgcctggcagctcgtttctgaaccagccaatcatttcacaaagccaataagctttgagccgggcctatataattatgattagattctgcaccaaagattctacatgcatggaccacaatcgcatacatatatgatttgatgtcatatatataccagtactttattatgtagggagatgatttgcaagcttaacattgaccatgttaggtagtagaaacattctatctaaaatggatactagaaggtcaggttaggtagaaatgtttggtaagtttcaacttgcaaaactgaatgttctttttggaagtaattgggctatggcatgtgactttgtgacactagaggtttcagactgttcaagtggcatactggagctgcttctctcacttttgacattgtttggtagtgacatactaatcatacccatgatctaggaactatttttcccccaacccaacagagtacaccctctgtaggctatgtccaatagacaattcatgtataaaagtgaacttaatttgagacagagaatatagtaacttggaaatggcgacatgaattttttttttgttcaaacagcccccctaagtagtactacagtaatgtcaacaaccaaatcccaattgaaaatgattgataactgataagcacaggagtggcatggctaatactttgccagaaaaccatgccttgttacaccctatcgtcttctgcatcagaggtttggttggaccaatacatcaagtgaagtcttcagaaaagggacttctttagcttagaaaagccccctgcaaatcaacaccaactcatgaactgttaattagaatccacgaatatactcaggacgtgtattgtaaggcaaagaaaattcccactgttctacaaagatgtgtatctgtcagtggcctactggtcaagctcaagcaggataacttcagacaagtctatgcatacatctccgtggaacatgtggaatgcaattgtgtaaagcaggttgtaaagttattatcagttgctagtagacttaatttaggtaggaaacgtatctaggactcaaggaagtattttctgcatgcaactacctggacttggtttttctaaaaataaagaggattatggatagcttacagatgcagtatactgaccagtctagcatttaggttggacataagcagatgatgtgatacaagagcttacttgtcatacctcacccaatcttcgaagtgaatacatgtccccagaaatatgaattattgattccacataactatttctttctgattgaatcatatttcgcattcttatcgtttaagtatcagatatttcgtattcacttagggatgacatctgaaacggttatccgcgataaaaaaagacatctgaaatggttaacatttaataataaactagctaaatgcccttgctttgctacggataaaaggaaaagaatatcataatactgcattaaataaataaaacattttttcatgattacgttacccacctttttgctacaaggaatactcacctcaatttaattttatgtggctatctatgtagatctagttgttatgtaatattaagaagttcaagggataatgtataaaaccacaatgggaataggtgatgtaatctgccaccaccattagaatctttttaaaggagtatagaaaaccatatgtgcaacaagtaaacttcatgtaaaattggttagcgcaaaaagatatagatccatatatgctatttatattcataaaggtctgtttactccaaagtaacacagtgaaactaacttgagctgcttgttatgcaattatatttacagagttactaaactatgagcagaactgtatagtgcgacacaaaatttcacatatcccgtaacaaggttatttccgaatcgcctttacattcctcgtctatcttggcatacttgttaaatcaatcttcagaatgacaagtccagtacatcaacccactgcaaggcataaatatcaccaacaccataaaaaccagaaaaataagggtgtgagggaaaatgtaacacaaagaaaggtagagctaataccttataagcacaaacacagactgtaggacgccagcaacaccagtccatgcagatggacctgtatctgtaagtgcgtcttggaccaaaaaaccaacagccccagccaaggaaacaaaagacaccacgtatgaaacaaaaagccagagtttcaacctgcaatttaaatgtaatcattgtcatacagtggataatgaatgacagacagatggaattgtattaatatggaaaagttaccactttacaagggagtaatagtagacagacacaagtacacaacagatcagacaggtttttagatatcatcatgactcgacatactggtttatgcatggccgtcttggcttgtcagaggtttgaataacagaatcatcttttaaaacaccagcatgcagaaaaccaaatcgaacattcgataagttgcgggtagtaataatgaactaacgactaatatgatgtgccattctgttcttagtttgtgtggcacaactgttgtcagtataatgtagatgtatccctcagaagagtaacagatcgaagatgaatgaatgattcactcttattccatggtaatctcgttcactcattgacaacgaaaaatcatgcttcatatatttctctgagaaagtaaatcacagtttacagagccatataccgtttccattgtctcgtatcattgccattctagcatctattcctttatatcccaaaactaaattaaagaaatatggctctcttctccacgcatagaatacaaaatgagcactactgtgttcctaatcacatttcgcaagtgtaaacacgcattcttcagaaagcaccaaaaactaacagctctgagttgcaccaatggatgcatgcgcgtagcactaaatcacaactggcaaggttaagcattattaatcttcccaaatcaagctcccagaccagtaaataatctaaccataagcagcgatagcactgatacccatgaatcagtaaatcatgactgaagtttccaacactcctgcaaaaccagaggcaggattgcagaaaccctcgcaaactaaacacaaaacccacctaaaaaaaggagcgaaaaacaaagaaaaaaaacttaaaattatcccctcacctccactcggagtcgtcgtagggcgagtagtaattgtagttggcgtcttccctcttcacgcagttgaacatgagcgcggcgaacgaagcaaataaccctaaaaaagaaaagaaccaaacccccaacaccctcgatcggttaggttaaaggcttcaatctttcgatctttgggggattagggcgagagaggaagaaggtggtgttaccggggaggtagtgaaggaacgggacggcggcggcgctgcagacgacggcgtcgacccagaaccaccagccgaccccgaatacggcgccggcgacgcccggccccaccaccgcccacaccgccgggaagctggtggtatccatcgccgccgccgggaagaggaacggagaaagttgagagcttttttttcagtgtggtccttgcaaagctgctgcttttagccctcctgctgcgggtgtatacattttcttttaatcgcaaaaagaaaatacattttcttttacgcattggtccttccagtttgtaaaatttgatgtagtggcaccggttagacaatgccatctttacagaaatttcacggtaaatatgtatggagtttctgcaattcaagcacgggcaaagctgctaaattcacatatcaacgcggcgcaatcaagaacccgccaatttgcactgacataagcagcggtaaaccaattggttcgcctgaccagccgctactctcgggagtttgttaagaacacatatataaaaaaagttttacttataaattaatttttattttctaatgaactttttttcttattaaaaatatgagcaaccgatgaggacctgaatgtccggaaggcagtctgagccaaaataattttctgaaagcctttcttccatttgccaaggacagagcacgacggatcgtcattgcttcatctatgtcagacgtcgcaactcgcaatccctgggatcagctcgttgaaagcaaaaacacatgagccattgttgtctcagatcaggacacccactcccattggacgtgaagagtggaaaagtgcagcatctgcgtttatgaacattgttccagtctgtgctggaatccatcctaaaactgaagtagagtcgtcacactagagacattcacaggtttggagcagtactgtacaatgatctccacatacaccaaaatgaatagaaaatccacgtatgaatagaagcattgttgttcctggcatcatttcttgcctcccaaatgtgccaaaaggtcgcagcaagagcagtattctgaatgttggatccacgcatcaggaagtcaaaaatctactgtctcatgtttgtgatgtttctcctgcacaagttggggtcaaacttttgtctaattgcctcccacactgcatcagcaaacgggcagaacaaaaatgcatgtttgatcctatcatctctgttgcaaaagatacgcatctatccatagctggaatatgttgtctgaaatagctggtttagtccaattcacttcatgaatcatacaaattcagtcaagatttcattttccttgtaattttggacccaaaactcaaaattcagggtccagactccagacctgaatgcatactagcaggaaccaagtttgagaattaacaagcaataagcaaatttcacactctattgcaggaaatacagatttttccaggaaatgctagaatataagcagctacacagatactgttgaaattcatgaaagggccaacaaacagctccttcagtctcatgaacactgacaatagttgccctgatctatgtgatcaaatacaagagttaacacgatcacggcactatttgccacttggttttgatttcgatgagtgactatcctcggaggggcgtgagcgctggagttcctcaactattgccgtgaccgcacgatcgcccctcactaagaggcgctccagcaactctaccttctgcagcagctgctcagcatcaatactcgcacagctcaccagcttatctgcggtcttcagagccgtgcacagctggtggtagaaacaatgatgaagcaacatcgtcagcttaaatggctggagtaggcaattacagtgaacggcatacaaaaggagatcaagatacacaccttcagcatcaatgaaggccatgaagggtcattttcttgcagcgctttcatcaaattgtcatagtgctcctgataagatgatgaacaggtgcaaattttagttatgaacagatgatgaacatctgcaaactaatgccgtttataacctgaagatcattcatctgtactatagatttaatttgaattttacagcaaacacggtcaatttgaagcacatctgaaccaaaaaaaattcagttcgtggcctggcaaaataaataaataaattcagttcgtccaacatctgatctgctccacaagattggcaaagtcgccaagcaaaattaagcacaaatatgaatccaagtttccaagaaccactctatctaacccttgcatctatcatcatcaacttaagctcgcctgaaagtagagtagactatttcctcaatctcataaactgtatcaggcccattaattcttcacctacttaaccagaaaataccggcacccaacagatagctcaggaaatcgaaccaattgcaggacggacgcatgattagggaactaaatctcatatggtaggatggatcgatcgattggtgccgaccaaatctaggaacggggaggagaggaaagaagaggaagggagccctaaccccgaatagccggttcagctcggatgggtcggcctcctccgcctgctgccccgccgacgacggcgacgacgggacggacacctccccgccggcgaggtcggcgccgccgtcgacggcgaggtcgctgaggaggtcgccgatggtgagcagcgggcccccgactccccgcatctcgccgcgtctccccctcttcccctgtgggcttagctcagtttctagtcatgagtatttgggcctatttaggcccacattagttcatgggcccacactgcaccagcgaattccgggagcagggttgacgtaaacccacatttacgccttcccgtgttatagacgtaatttgaaccatgcgccgtaaaattcatttttccaaatgtctggagttactctgaactgtggaatcagctaagtttttcttttctttattattattattaagggggaaatgtacaccccgtaggaatggtacaattgtgctgtagcacaaaagatgcagcagtgttaactataagtctataactatagcggcatcctctttgtgctgaacaatttaatgatacactggcctatatagaatgccaatttcttcgttgtagtgagatcgctaatactttgagttcagatcatgacacgcaactcaaccctgtgtggaatcatccctcctgtgatggctcctctgatctgcaatgtgaaacggatagcgccatcaaagcaaagtccaaattaattcatgtttactggttttcattatattttttttagataatggactggttttcattatatggtaaatcatgtaaacacactgttagaaagttagcttttacggtgcaggcggaattatcagctccatcgtttgccactttgccctccagcttgtctgccgcaggcgaaattcaaattcatattactagtttgaattttaaatttacagcattagcttttattatttatgatttcttaaagctgtgtgtttctatcttcacgaatccattaatctagatatacgattacattgataacatttgaataaatcattttattctcattttagattaaattttaaaattttaaccactacaattttataggcaaaatttgttatatagcatcgaaagttcacgtttttggttttat

SEQ ID NO: 82007 - DNA, 7251 bp, Oryza sativa
aattcctgcagcccagaactgaggaagaatgaagatgtgaatggaatgttatgcagacacatgtgaatggcatcttaaaagttgctgctgagtttttagcactaagttgtatggtcgaagaccttagactgttgggctgttgtcggtcggcaaacagttgttttctgttttcttttctcctctgttggttgtgagcacctgggggagttctcctccctgcaggtagtaagactttttttttttgtagtagtagtgccacatttctttaatagaaatggagggtagatgcaactcttgatttgatgctatagcaaccagtttctgcattttgcatggcttcttcagggtagccactagccagagattgcagttgtgagtagatatgatgatccgctggacgcgggatggcggtgatcgaacttcaagtgccaattccattgacgtgaaaatgtgatgcaatagctttcatcatatttgataaacttgttcagacccccaaggtcctaataaataacaaaattaacgaagttaagctacatttgagattaattacatctagatcatcttctcgttataggcttacagcatacaaagagatgagatagtgcatgtgcataaacagcacaaacatatgctgctgagaaaaagaggatgatctaatattaaccatatggtagttaggcatgggaggcattgggagatctctcctgtcaatgggtcacttgctgctgtgtttcttttgcagagcgtattcagaattttcaccacatacaatgaaccaaatgtttcagatgcaccagggagtactcagattacattctgcatgtaactagtctcaatgtatgtgatctatctttctctcattgtcacctcgtgcaagttcttaacctaaccattttgtacttctggattttcatctagttttctcctagaaacattgatacaaatttgttgatgcatcagtctggcctgctatgtccatcgactagaagcccatcgaggaacaaaacacgcgaatgtctaaacatcatgaatattggactgtagttggaatatgcacttagctgaacttctgaaaagacataattattcaatccatctgttcgtttattttttcgaaatgtccttacaagttcagagtagactgtaggagcatgcttctgttcatccaaataattgtcaatttcacgtaaaaagaaaattactaatttcatgcattgtttgcctttctccatgacagccaaaccaaacatctttaattttttttgagaagatccaaatgtcttggtttagagcttttatttcttaattgagaaactttatagtctttaagagttaccgagagggaaagatttttggtgcaaaaattttgtactcataaatcctagtacgtgagatacaaaaaggtattaaattttaaagtaaaaagtgtggtacctcccggtagccttcttaagaaccataaaattaattttcttagtttggtgaagtggcattggtgaacattcattatactattgaaagcaggagatgaaggagaacaattcaatgattcattggtctgtcataatctcatcgatcactaccactttatatatatggagatattgatctatcacaatgttagatagtccactctcaagaaagaattagcattaattacacgtctctagtttttccagagctaagttctgcatttaaatgatggcattagatcatatgatatatagatcaatggacacaaatgctagagagagagagagagagagagagagagagagagagagagagagagagagagagagaggaacattgttcatggaactagaaactaaattttcatgttcgttggcctaggaggtatcaggagttcacatgtcaccttgatacactgccgaacaactgaatgtagcaaacccatataggtggtggctgagatttttactcctcttctgaatccttgccctactattttctccatctcatttaaaaatagtacaaggaagggaataattatccaaagaatcaaggatatgagagggtaaagttgcaaattacactatttgaaggtggcttgttggtggtgaggatgggcagcttggggcggcagctggccggctacgttagtcattgggggtaatgtcgtcgctggcaatgtgtggtgcacatctctctttgttgtttgctaatccactacacggtaaatattgtacagccagacagaattcgactatctctagatgagaaatatgttgtaaatatactttataaaatacttagtcacacccaagaagaatttcctggagatgccactgatttaattcggtggtgtacatgtgatacagttcttttggatgcaggtcgtctgcagtactgcactgcaggggatctcagttgagttctttttgctcgtggtgtgttcgaaattcagctgataatcgtgcttatctgtatggatcggtgtgccatcttacacaatcttgtccatattagagaaaaaaaacagacacagagacttcccatcaatccatcatcctttgatctcttgttaaatgcagagggcaaacattgttataatctgatctcgtcttctgaaatttcggacccccctgcactaatcgatttcgcccgaaaacttcagttttttttttaacttttttagatttggttggcgacgatttgaatcaccagggagcaatagtgaaaatttaatttagaactttttaaagttgattttgcccttttttttcagcttgggttttgaactgctaagaatagtcttagcagtataaaagtcttactagaaaattatttattttcattttttggctttatttttcttggtttataagccagtagctcaaatgctcaatcaatgagacagcttggatcgatgatagcgttccaattctcaggtgagttaaaggatatttcgacttttttaaaagacatatttcgacttcaaagaggggtttcctacgcaaaacaccacttcctgacattattggtgtttatctgataaattagtagtcacaaaataaatttggcaccaattagaactgtcacctcgttaatttggtctcagtttttttttctgtttgcatcagtactgcctagctaatacagagtaataatactagtggtttattatgcattgagctcagctgtactgaacaaaacaatcaattttcagatacggccatgtcctgactcctgtttgctctacatataaaggagtacatgtagatggagattgttcattccaatggctagttggttatcgatatgggagctagctagtaggcttgggagacaccaggagctgctctattacagcgaatttgctgaattctgcatttgatggtaggagctcttgatcatttgatgctagcaaacctgctgctgcatcttgctggcttcttcaggccgcacagctggaagaagacgacgtcaactggacagatgaatccggtgcactgataccatgttaactctagtgaataatagaaatagggaatagatttgttgtgtatatattgagttagcgccaatgacatatattgagtacaatagagatgagaaatacctctaatacccccgacacatctctactccctccatcctatattgatcatctcgtaagatttttgaggtcttcccaaattcatgatcatctaactgtgcctattcgtttatttgtgcaaaattaaatagcattgtagcatgtctggttgtttatatgagcaggagtcaatgtcatcgctgcatgtcaattcatttatctgtacaggagtaaatagcatcgttacatgctcaccttaatcgataagatttaatttaaggaaggatgttttcttgccttggtcttgatgcccatttataaatgagatttgctccagtccagcaaaaagtacctcgagataccggtatctcacggtatcaaatcgtttccgatcgttggatcaagctggacattgttagatctaacgatcgaaaatgatttggtaccgtgaggtattgataccttgagatactttttgttagactggagtaaatctctttataaagacgatgatcaaattgggatggtgggaatatttttttaactggtagtatgacgttgttaatcttgatatcatcttctcgtcgccctccagcgagttacatcggtgctttgtgatcagtagcacgagtgctgttgaagcttgcagcttggctgctgtgctcgtgcagccttcgatcgatcaaaccagtgctatgtatagatgtgatgtgtggtaatgagattatctgataaattgatgccaaatttcttggcagaaaataaaccttggatttaaccatggtaattcggcatgggaggcaccgggagatgtcctgtgaataggtcgcttacctgcagtgctttttggctgagcgttcagtatacccaatgaaccaaatgagagagatgccccaggaatcaatttatatctttctctcacagcattttacatccagattttctttcattgtccctataaaatttgatacaattattaggttgatgcatcattcaggcctgctaggcccatcattaactggaagctcatctgaggaacaacacgcgcgcgaacgtctaaatgccatgaattggactgtagttggaatatgcacttagctgaacttcagaaaagacataattcaatccatctgttcgtttatatttttccaaaatgtccttacaaggtcagagtaaactttaggagcatatgcttctgttcatccaaataattatcaatttcacgaacaaaaaacaattaccaatttcatgcattgttcacctttctccatgacagccaaaccaaacatctttaatttttttgagaacatccaaacgtctttattcagtgcttcatttcttaattgagaaattttatagtccttaagaggtactgagagggaccaagatttttaattagaaaaattggtacatcctaatgcgtgagatactaataggtatcaaattttatatgaaaaagtgttgtacctcctagtaccctccttaagaaccataaaattatttttcttagtttggtgaagtagcattggtgaaaattcattatactattgaaagcaggagatgaagagtacaattcaatgattcattattggtctgccataatctcattgatcactaccaatatatatgtattgggatattgatctatcacaatgttagataatccagtctcagttacgtggacatacatttatgtgctacattgaagtactaaaaaatgagggtgttgagcagctacatcagaccaaatattacttagtattgacacaaaattggtaaattttacagaggtctctactgctagtagaagtgatccatgcccatcatcatcttaaatccaaggggctagacttacttatactgccaaccatggtttgcaagttcgtttcaaaatttccgagacccactggcacgaaaatatttggcccaaaatttcaatttgtttcaatcttttttttttgttgtactctttgttcttgttagtccttcttacttctgtaacatgtactccaagattaaagtctcaacttagtggggatatagtacaaatggtcaggacttttggttttattttccttatttttcccttccctttggatttgttcagaaaactatcagaatcaaagcaggggcatagctgcacattgatctcggctgcatgtcttgagtgattgcatggaatcagacaattaattcctgtatgatagcattctatctcctctgctccataaaacagcagacgaaatgaagtagcagcagcttgtttttcttgattgattatttggtttttatcagagatcgatgatcaagaagagttcatggggttcaggcagcccaggtaggcctggaagacatcaggagccgtcaaatgcgccgatggtaagcaatcttctgctgcttgtctgaccattttgcttctcactcaagtagtcaagtttctgattttagtagttcactgcaattctttcatttgatattagcaacaacccaactgaccagtttctgcatctcgtaggcttattccaagtcgcaagaccaagaggtcatgatcacctcaacatcaaggacacagcacgagtcttctcctccgtccggtttcccgagtaaccgttgagatgcttccaatgatgtacatgtgatgcagtttatttagctggtgatttataacttgctgaactcctcaaattgttcgtgctagcttcctgctttcacctttcacgttgttgttttgtgaaaaagagacatcctctgcttgcgaatgattaatctggtccgcttgatcgtgattggaatggattagagatgttgtagagttgtatgatcgggtaatgattttctgatggattgctaaagaataaataataccaaccatctcatttgttgattgctgtgtcaatgatcaaaatcatcaccttgttaatttggtctcagctttctgtttgtttcagtactgcctagctaatatagtgtacctatttctagtttatatattgagcattgtagtcagctgtacttgttataaaagttagtcgatatagcggaacgacaactaaccttctcgatcgtttcaatcattgaccacccaagacatgccagatgatgacacatgaacacacgatattttttaacgaggttcagccgaagcctacatccccggggctctgattatgggcgctcctccccaaccaacatagcacctagccgctatgagtccatggccacgccgccatcatctccctgcgtgtactacgttgtagtcgcatggttacattgtggtgccccttctctatttaagagaaatgccgggttacagagtccgactctaactctaccccctaacacctattacaactccaagtctaactgtaatcaaataggactagtatattcgacacttattctaatagtactgaaccccccccccctcaattttcatatatgatcatgtcctatttgctcacatataaaagacaagacaaggagcacgggttgaggaagatatgagagaaaagtagtatggagatcgatcactccgagtggcttgtttttttgcggcggtaggcttaggaggaatcaagagctgtcctgttacgatggtgatctgtgaaagaagccacacatttctttggtttaggatcacctgtaggtccatgaaataagccatgcaacttctaaacttcatgagttat

SEQ ID NO: 82008 - DNA, 2827 bp, Oryza sativa
ggagttaacgttacttgtcagcgagaactgggcctgacttcatgcatccaatatacgttcttggttttgatttatgccgagcaagggtagtggcaagcattcctgttatgttgtcacatgaagtgggttattatagatttcaacataaggccaatcggcacgtgaaaaaaaaaatatacccacctaagttcacatgcacatcatcatcaaccttcacataaaagtcagcatcccaaataccaactgctgtagagaagaaaatctttgtcttagctgagagttcatgatacccttctacatggtcctggttgaacaaatgaacacatggtaaaatgtcagtgctggttcaaggaaagcatgttcaaagctttgaaaggcaggaaagcattacttactagtctaagaaagtcacgatgctgagcatcctctgaatctatagctttgtccaatatactgttggatgtagcactgcacagccatcgaagcagttagtatttatacgaaatttaaaaagtatttcaagtttcgatatacacatatatgggaacatatgaaaacacgtgttctgcggtgatttatagaacaaggcagtatattaattctggttttatcattgaagtcagctatgcacaaccaaaagccctttcagattggcacaactgattattacaaaacagaggaagcaaaaatggatttataaagttctacataaacaaattatccactagatttcagtgcattctcaaaaatcttaggaacttggtgtattctgcacacaaactagctcttagcaagcacaaggatggaatccaaatgtccttgatgacaaagatacttaagaactacatatttttgcaacatgaggtatgttataatgttgtccactataccagttcccagttctgacatttcaggaggttatttgcatgctatttttgcaggcatatttttgcatgttatggtaataaaggtatagtggaagaagttgctatctaacataaaagagaaccgaatgtccaaatgtatgattgaaaccacatgcaaagataaaaaggacaagtgattactgattaaactgtaaaacgcactaggagtacaagaaccctctgtttacctatgccctatagtgaagcggataacaattcccttttgatcttctagttgctgcagctttgcacctaagaacaagaagttctagttaaaaaatgacgacaatgatagcttatggaatccaacaatggaagggctaacaattagcatggtgatgatatcataaatatttccaaaattactagcagaactatatgaacagaatgatcatatgcattatacatatttcctagaaagatggaccccagaaggaattttaagtgctgactcctataagagtatgcaagataccaccagcatctatcacattcgacttatgacttatctatggaagatggcgtcaacgtaaatggcaaagactaaggtcaatcttctagactaattgcatgctcgtacagattaagctaagctagtccaagtagaactatgaattgcttcctacttaataaactaattcgtagtaagtcaaaatatgttatttaaatttaaactgtcagataaaatagagagcttagaattcagtgtcatgtgccacatgacgtgcatgtgatgaaaaactagttccaacaaatatcgttatagcagcaaccattgggccactaggaactaaataatcaagctaagagccttggagatgatgatgattaaaaatgaaatgtctaacaataatagaaccgtcttgctagttcatccataaagttataatacaagaaatagcaaccttgaggcatccatgtctctcgcactgaatcacggcgcttgcggctgctgaatgcggtgtttactccaattacaacaaatgccttcttccttggttggctagtttctgaggttactggtgagccaccagcacggagaagttccagcgtgctacgcttagctgcaagttccatctgcagcgtggagatggacttatccaacaatctaacgccacaaaacaaatccaaaggagagaatcctttcagaaacaaatattcaagcaactcgtaaccataaagtgaactccaactagggtcaagtgagctcactgtatggcttcgtgggtcttggttacctcacccattatgtccttgtcttctccatgcttctgcaaatccaattgaagaagcatatggcagattacatgagatcaatggcaaaaagactagaaccatgtgaatctatttaaatttggagcccaccctctttgtattgcaatcctctgatatgagttgcaactccctatcctgcctccggcgttgagacatgatgtggttactggtatcaggtgccgtccaaaaactgtaaaaccacccaaaagaaatcgtcagggagatgaaagagcaaccaagaaaagataatctgatcatcaaaatgcatgaattcaaaaataaaaaggatcaggaaccataataacccgtgtcattgcctttccgttatttgattaatttcactatttcacagcctcgatatttgaaatgagcaactgaacctatgaactatgataccaaatcccagctagttcgtatgccaagttccagtctaaatggaatatactgaactactgaagacaattccatcaagaaaagtataacttgaacttgttgcaaaaatatatttcctccttaaaaaggttgaaaagctaaatccgaccataacactcaatgacaataatgcagttgttccgaatccaaagctatcataaatgaaaataagcccacacacagcattactactg

SEQ ID NO: 82009 - DNA, 4216 bp, Oryza sativa
ttaactcatggtaacggatttcctattcccctctgctcatgctttgctccaatattgcatttcattatagaatttgtttatcacctgctcccctcgtagcttctacacctttaaagatttgattgtttcatcacatgatgacatgacgatgtagagttgtatcactgagtgaattatttaatttgttgattgctcagtcagttatgtggatgagatccatttcaatacattgattgattcatcacaatgctgtgtaactacaccctttcccccctgcttttgatgagcaaacatcagaatcaaaccaactgcgcattgaagaaagctgcaggtcctggaacgactaattcctgtatgatgctatgttatctccattgctcaattaaagcgcaaatgaaatgaagtagcagcaacatgaatgtttttgtagcttgatatttagagactatgaacaaggggagctcatggagttgagcctgtccagtggtaggcctgggaggcattggtggtttttttattcactttaggtccttcaatttaacgtcgagtatgaaattcatctttgaaccgaaataccagacacagttcattccccaactcccaatatcgtgtcaactttggtctcaatgcagtacgacttccggtttcgtccaacgtggcacatcaatcaagcatatgatttgaaggatatatgattaagaagatgatcagctcatgtatttgttttgtgttctccacaacttaaagtaggcaggcagcagggccgtcttcaggattttggggcccggaacaaaatgtaaattggggccctaaattttctaaagctaattaatatgtcactttcagtcaactatacaactttaatttgtgttatttcatacaatatttacaaatacattttcaaatattaattctaaaagagtaaaggtagtattgaataaaaccaagagccatactgtcttaagatcaaagttgatactcaatgtcaattttgaggaacctaaagtgaacttattcctttttattatatatatgggctgctccttcaccgcgtgggccagttaaatcggcccatcactttaagtgggcccacaaaactgacggcaaagtatgggccaaaacatatcgcccggtgaaatatgggcttcttgttgggcggactcaatcatcacttattatgtaaaaaaaaaaaacaagtacagaaaaaatgctttgttttgctcttctgttctgccctcatgttttcatcttgctctgctctttgctcaattgctcttgagtagaaaaaaacaagatggatgaaagtgagatcaccatgtcacacacagatgcaggattccttgcgcaataatggtcgatgtgcgggttatattgaatttagcaccagcaattagtggcatgtggactgaaaaacaaagggaaccctctcccatttttttgtgcgagtacaaaaggaaggaaaattgtgacaaacagggccagataggacttaagatagcgttgtgatgatctcaacagtaaaacacggcaatggtagagtattatacaacaaccctgaatactgatatatggcatcccgactgttgcaaccgtcgtggagcactctcctattcctgacacttataatccatggattttggaagatgggtctttaccaagcagattttgttgagcactgggtttatgacttaatcaggccctgatcgttgtgttcctcgggtgaattgtccatgattcttcttttgagaggacattgtctgcttctctgataaaccaatgtgctcaaatatttcagtcatcgccgcgctatgcagatactgcatgttagcacatagtagccattagttcgataatcttcatagcatgttcgatctctaaatttagtttaagcacgcagagcaaaattttgactggaactgaagccaaatggtgataattaaggcaattttgtaacttactctccccaaagcatgtagcatggtaagtcctgatgcctcctgtgccgaacaatatgcaagaaatgcgatctctctcatcttgagagtttttcttctcgttcgtgtgttcgtgtgtcctcgtaataggacagcatacaactcacgcctcctggtgccgaacaaaagtttatgcatgtctcagatggtgatgcgataattgaacactgtaattccacttcaatatctacagcacctactactgtacagagaactgatggtgctcagctcagttgaagaattggaaggtgatgtcccttactcgtatagtagtagttctctgcttgggagtagttctcctactgctctcatgtcgttctacgaaaatgtcttctgggattctattgacgctttttcatggccaatatgagatcacctaacgatttatggtgtaatcaacagagccgccaaaatcgatagatcaaaaccggctagcggaaccgatttcaagattaatttactttcgtggaatcaaacgactaatttacgagcagattagtaaagaagataaatatcgtacttacatgacgacgaacgactagtttctgagtaaactagcaaatgataaccttctcgcttttgtagagaagcacaaccgttttttagcgcaaaacgataaagattaactaaattctagggtcgctataactcagccataaaaataaaatagaaaagaacgttagattgatatatatatatatatatatatatatatatctccatgtgaacagctaataacaaccaataaactcccatcaggccatgcactatgtgacccccatcactgcttctccatcttggctacatgcccatcaatcacctgcacctaatctctatagaccatagtgtatatacctgcttcgtctagatatttaattggttcccaaatctataactcaacaaatacgatagctattctaaataatttggcatggccaaataaactaactacaagccaaattatgattcaaacagattcaccaataatgttaagtatatatgtgtgagttagtatgctaagggcagtttagtatttaatttcctcctcctattgtacacaatttatatgtgctctttgagcttatccaaggtaacaattcaatcccccattttttttcttctctgaaattaacaaccaaaactgtccgtcagatacaaaatggatgatggatgagtggacacggcaaaatgattagcaaataagacatctatatgagttcatggacatagatcatgccagtgacttgtattgcgaggatatctctacgcttgggaggcaccaggacgcgtgagttgtatgctgtcctatacgaggcatccagtgcatgcatcgtctcatagaaggtcggacctattgtacccatatcgacaaaagggaacggttgtcggcggcattgacagagggtcgttgtaactttgaaacgttgtaatatgctggatcagaaatgagtatccgtaatcagtgtcataggcatgtagacttttgctaaacctcattaacaaatattgtgtctcggtgtcgtcatcttgattggttctcctatgatgttacttttgcgtttggtttctaatggtgattttggactgattttataacagttaaatcaatagtgctgtaatatactacttaaatatgtagttttgtgatagtatgatcaaaatatttatagttttacaaaatttactcaaatatttaatcatgcttttccctattttcttgatggtttagcctggcccatcgcgagaaagatccattttcttagctaggtagttgtgatatcacagggatttggctatggatgttgcagcataaaggtaggtgcgacagtagcaccagctacgggaggtgttcataagtatacgccaaagttaatgtaaatatataaaataattttttgtgatattgtaaggtagacacgcaagagtgcacaagtcaatataggcagaagtacctataagctagtgtgtccctttaacacaagcacaaattaaagcacacaaagagagacattagctgttaatccctaacctcactagctaatttctaaaaaaaaaaacacccggcccgtattgtgagcactaaagatttaaatttattgatatatatatatatattgaaaattatatgctactaccgggagtagctactccctctctatgtgccctcaattcgatcgctactaatgccaatgactgttaccgggtctaatgaatcgaatact

SEQ ID NO: 82010 - DNA, 982 bp, Oryza sativa
tagtctttcattttagtatctacgaggacatcctgcatgcgcttaccggagcgtgtcgtattgctgttgtaggttatcgaattccctcttcttttcttcaatgtacctctccaggattcttatcctttcgttaagggcatcgatttgctgccggaacgattggttttcgtccatgtttcgccacactgtagctggtccgggctggggctgtcgacgtccatcctgcatatatatgccaaattaattaataataatacacacatatataaaagttttacatgctaaatatacttgttactgcacaaaagtgaaagtgttactacatgatagacacacgttaccatatatttatgcagtaacactatataaaaaatacagtaacactacccaagaattacagtaagatgcattgttactataaaatttataatctgtattgcacttttacagtaacgtcgtgatgcgattgtaataacgtaaaacagaaaatagtaacaagaatgctatagtattactacctgtggagagtcaaattccaaaaaatcaatgtttaaagaacaatatctctcacgtgatgtatatttttttaaaaccgtttgcaccatgatgctaaaaaaagtacttatcaagagtagatccgtcatgactatatttcaactatattcgaacttcgttactacacgtaagacatagtgatcgtcgtgttactgcaccgttctgcgagacgagagctgagaagaggtggttggtgggaggagttagtaggcggcttgaccgggatttgatcaatgtgagaatgctttgaccgacttttaactgaggtgggaggtgggttttgaacccttgaaagagaggggaggtgggttgagccgcccttaggagagagggggggtatataatagctatacgccggatgtagaatagttttcacacacacacacacacacacatatatatatatatatatagggctgcaggaatt

SEQ ID NO: 82011 - DNA, 7160 bp, Oryza sativa
catcgtgtccactcaagatgtcaaatttgcttcattgttttctcatggatgaatttcgacacaactctctctcagatgaatggcatcgagggaatcatgataaaaatatacatgtaacagttaatccattaatttgatggcaataatatatattattaaaacttttgatggtatatatttatctacatatctgcatcatactacagaaactctgtcatgcatcagcgatgtgtgccatccctatgacgtgtacaacagaattcttgaaccgtcactcctgtgcccaatgtacaagcttgatctctacatggtggatggcagcgatggcccctgacatccttctggtcatcttggcaaggttctttgtgataccagctactccatttcatcaggtggcatgagagctcctgatgcctcccaggccaacatccatggtgcgtcatctgctccatgaaatgttgctcatatcgaaacattatatactgaaacttgcccaccgtcatgccagttgtaaatcgtcagcaaaaagaataatttctcggaagatagaagtgatcgtcaccaacttagcgatttctttatgggagcaaatgctgtagtacctctaattaatgcactttctgctggtataggctgatagcgaacattaaagagtagccatgttctagaaatgtgtgaaaaatttccaaggcaaatattaatacctgatgtgtattagcaaattaggtgtttgatgttctctaacaattcttcccacaagtaactgaacttttagtgagtttgggatgatgtttctatcagatggaatttaacatagttctgatgggatatccaacaaaatgggaattccatcatagtcgaaatgcctcaaccacgatgaagtaaagatgcaacaatcactcgtttattcgatgtgaacatttcacactttcttgttgccttaggagctgcagtttcccttcatgcacgcgtgatcagatgctccatcaatcttaatccggtgccctcaatgatacaactgacatttcttaactgccataaagaacaaaagaactatcttctaatatcccactagagaaaatgtggctgaaaggtggatggcagcaatggcgccatcacatgcttctggtcgccacaacggggctctcggtgacggtggattgactttttcttgctgtggcataacaactcctgatgtctttcactcccatgcaaacaggcatagcaaaccgactccatgaatgacatctctctctctctctctctcaactagaaaggtagcccgcgcgaatgcgcaggcattcaggaatcattgcttaaatattttttctaagatatttgttagttttataatatgtaatatttaattcatctacataagcacttatctataatcttaatcttcttcatcatttaagaagacataggtctttaaagtctaaattaaaagtaaggtgttgtttttctttcttaattgattgttttaggtcttatttttaacaaaactcaaaaaaggttattgctaataaatgtgttttatttcttcttttaattggttcacatttgacacaatttgttatatgtacttacatatgaatcaataaaaatagagtagatatacatattctagacctcgcttccctataatatatgtgatctatatctttttttaaatatatgtagtcaacctgagtgttaaaacataaatttaatagtaagaaatataatatttaaaactatctactgctaacttagtgtagcttatatataagcaataatatgtacataaactcataatgctatggcatagaatagggggaagtctattaatctgtagtcacttaaaaatgatgcggtggttatgtatagttgtccaattcaaagggaaaattaagaaccacaatggttctaagaaattataagattttctacaattggttcaatttacagcctgttatattttttctattttttattttatacaaatattatttttagttcaaatttacgatatgataaatagtgacaacattacaccctatttgtcaaaaattttatctataagcaagtaagattggtacagattctcattgtttattaatgaatggattgtatgggacatgaggctacgataaattcatgggcttgtatacaccaatatgtttgcattatgtgatagataattcatttgggaacatttcatatgtagtgtgtgaggctctacacaaccattgtggatacgatttgatatggctaataagatataactgtacatgcaacattattttcggaatgtaatgtattatgaatgctcccatcatttacatatttttctataaaatttcctattaaatgttaggaattgcgtgatcgaaaccaatcattatgtattagtttagctagccttcacttggcatgaattaattagatttaaattacataatcctttatgtgaatcccacaatgcatatccgatccaattgccacaaaatattgaaaagagaccctagaaagtctttgcattccaaagtccaaataaattctttcaatttttttcgcattgtagtatagatatggtttggtggctatatggtccatttgttgctcctatttattatgccctatggctaaaaaggtaaggcaaagctaagcttgttgtgctttctcacaccctttgtatatgcattattctccttgagactggtctacgtgctgtttttctgcttcgatttctctcctcacttgtatttgcgcaaaaaattatttgggttccaaagtataaatgaattaattataatttgtgttagaaaaatctaatggttgaaaataattggtcaaatgttttacttttttttcattgagtttgtaaggtgtttttttttattttttttagacgtggtaacttaagactgctctaggacatgtttgttttgtctaaatattattattttggttgacatgtaactatgttcaagtgatgtattttaatttttttaaataaaattatggttaatatggatcttaaattatttatttaattataaataaaacaacagttaaaaaattttaaaaacatatatcaaattattgattgttttgatattatgttgtattttaaaaattgaaaaattagagaggagtaaattggacagaagagaagatacgtgcatgtaagtgcatgcacctacagcaaggggagaggatgagagttttttttttcttgagatagatcccattaatgggttcaccagtacgagttaactatatttaaacacaaatataatcttagtgaacaaagtattgtattttttactacttattattttaatcttattaattaattttgtgtgtttcatattattctaatataagcttaatcaagtgtttaaaaatctctatgatattcccataaaaatgtgtctcgagtgaccaatagctagttaaaagttatatttttttacttgttaaatatagttaatttaggccttaaattaaacgacaaaatctaatatatgtggataaaaaatagctttaagattcagatcagatagttgttaaaatttgttatcatataatatgttttctatctaatactacatcataaaaacaggagagaaaagggacagaaggagtggagggatcggtatatacatgtacgtacgtacgtataggatggaaggggtgggacgtggcccacgtatgtgggcctttcaattttttaataacaaaaataaatttaatgggtccaccatgtttaatgaaaaatgatggttgtgccacgtggcagttcagaagtgtttgtagaaatgccatgtggcggtttaagagtgtttatagaatgtttaatggacttttagtatatgatagatagaagatagatttgtgcaaaattgcgatggctccaagacgaactacaattaatcttagcgacactggctcagtttcaagggaaaatgccaaagagaactctgaatcctgatgccacccaagagccaacaattatgcatgcctataacatataagtagcaaacacgctagctggagagatttggagtttcctctgtctccatgagaccatgacacacatacagtctgtttctctatctcattgtgtgcatgtaacatttccaactcctttatgttctatttgacctacatatatatgacatcacatttggtttgacacgatgattaatttaataccctttggctcatattttttatgagccaaaccaggagagtttgcataattgattttattgattagttcggcacatgcatctggagcactggtgcatcggagccgtataggcatgattattcagtttgtcacttagattctttttggatcgagggctcatcgccctgctttttgtgggttgcaatctttacaaagtacaaatccagacctgcctctaaaataccaccatacacaccgcttcgattgttcatcaattcgcacatctcagtcacccttgtctctgcaccggttcaatgtatgcacatcgtcataattaatatcatctaattaatagatttatccatgatcctctaaacttgtcccaattccttgtttgttttcactagggttgaaaccgatcaaacacaattgtgatggatccaacacgtactagtggaaatcccaatgtggtcgaatattgcttcaatggtaatcgaaggcatcacgatagagtaaacacgcaataatcactatgtgatttgatgtgattatttcacacctattgacttcagagcaagctgcattacccaacaatcatgcacatgcaaccatattctccgacaatcctaacctagtcgcctcaaggatgcatttgaaatttctatgacagagataagaacaaaatcgatcagtgatttctctgctcgagcggccatggccagacagtgtgcagcggctatggcgccgatgcatgcttccagtctccatcgcattgctcttggtgatgccagcatttccgtatcttattgtggcatgagaactcctgatgcatcctatgccaacagccatatcaaccgaaccggaccattgttggatcttgtggcctctgcccatgtccattaggagagaaaaacattaaagcaagagaagtgttccagcccttaataaagtactttggaggtaccaagattttataaaattttgatacctactacctagagatactaaattttacactaaaaaatgttatgcctcccggtgccgccttctcaaagatggtaaaattatgcttaaagcaaggcactcatcattactatttgctaacgtttctattatttgtccttttgtggccaaagggtagtaattcggagtctcagaccaactaaaattaaaagaagagaaagaccaaaggactggctgttaaaccctagaccgctgctgaggtgaaggcgccattaaatcattgggctacctctcaacttgttgcatggtatagcccacccaatttgagttcagcatggtggttacctactgctgtcgtggagttgtagccaccatggcgaaatacatagcaccaaataaaatggcgttgagattttggacctcagcagtcagcatctttggctatggcgctaaggtcagggtcaaattttttgttacggtttatttctaaaataagttttttaaaagggctaaagtaaggaaatttcagttactcatagatggtggttggtcccccgagaattgaaacatgattatcttacaatgcctgtgttgctgagcacattcatcttgtcatgcttgctatgccctaccgctccctgactatcactgccaagttgcctcctcgtcagaatatcacttcatcagacgatgtccagcaaaatcccaccctcatcattcgccattattcgtccgctgtcttgctaaaatcccaccatcctcagtcatcagactcggattacacttttccgatggctgtagttgctaatgattgccgatggagagcccaaaaattgttgcttcttggcaaagttgaagtggaaccaagccaaacaactctgcacgacaaaaccaattagagggaagaagtggcgatggccttggcgacacgagcaagcagtggcgaaggtcttgatgacaccagctcagttttgtggaagagtgaaataagaggtcctgatgcctccgaggccaacagctagaaatttgcaaaatgccgagtagaaattaacctggagtttcctctgcctctaggaaatgggtctcagtgtgtagcattccttacttgatccttagtatatactattgggttgaatatatagtgtttgatgtcatgtgatcatttaatacaagtaacttccagttcaatcgatgacatttgttttttacatatagttcaatgcagcacttgctacctctgaaataacagccatatatatgtgatcacgttcatccttccatgatagtggactccctcaatgtgtactaaggtgtggaagtgatttctatgcacgatttaagcagcataacgattattgaattgttctctattccacatttgctgtcaggaatgcttgttcacctgtacaacttcacaaacttagaaaaaaaaaagaaacacaacaactagaatggccagttttgtggttttatcatatggcgaaaaatggttgaatttgttaatcatttggacgaacagaagaacgctcatgccgcttactctaaatttgtgactgaattttgttactctctgaactggccaatgcattgtcgattggttgttagcagcaaccaatagacagtgcattaaagaagtttctatcccaaatttaagaataaagtcatatggaagttgaatgttctacccatttccaagatctaaataatgtcttaccgaacaaaaatacagtttcatcgaaaggaaaatataaacagagttcgaataaagtactttcctatcaaataacacaaacatcaagaaacaagaaactttttaccttcgtacaagccacaaaaacatgctcaattttttatctctcactaattttacacatttcaggtatcaattttttttgtcgggacatgtcagctaccaattttcagtcacagacaagatcagagagattgaggaaataaagaggaagctcgatccgccagcttcaagcacgagcagacataaaagagaagaggaaaatga

SEQ ID NO: 82012 - DNA, 3049 bp, Oryza sativa
gcttttagtataaatttacaaaatgtgaagtagtttgctagtgtaaatcatcaacatagctcaaattaatatatcgaaacaacccagcacagaattgaaacacgatgtgattgtccatgatacaagacaatacagtagagaaggcacagtgttcaatgaaaaaggacatggtattaaatcaataactataatgtatttactgaattttcctaaaaaaatttctcatgatcacatctgttcaaactgaatttggatattttattttttaaaaaaatgctctgcattgtaaaattagtgtcatactgaaaagcaacaaatagcgttcatgcaaagttgataaaacacaggcagtatacccaggaataatgttgcatgtcaattactatactgatctggtaggctggcagttgacatgtgctagcaaagaatctatcccgtgctatattttcatatggattcatggcatgaggttaggaattccaaagttctcatctgcacttcggcattcccacagaatcattagcaaccttcaaccaaataggatggcatgcttttactataaaaaattggatgtactcccaagtatttgaactgattggctggtgtgagtatttgatagacgacagataaggaagaccatataaaaagttccaagtgacaagcaaatttacaaaataaatgaatgacatcacattaatgataacaggcaaaagtaaccaaagagaactcttccttctaaataggaaaaaagtagtctatataaataaggagttagtgtaaaacattcttgccacatcaccaaaactactaagtgttaggacagatgaagcagagtagttgtgaagttcaaaatttaatatatctaccaacttaagaaaacatctaatggttttgacctgccagtttatagaaccttataactttcatatggaagagcaacataggaagctataggaagttggtgtatcacatagatcggacattaacagcattgtttgttacaagataatcagaattctgtgccttcattcggcattacattgacttttgagacactcagtatatctgtattggaattttggatgtacaactaactgaaagcatattttgaagctattgcatgaaaaagctcattataattggtagagattcccttggctaactaaatctcagaacaaagcacaggaactctaaactagcccttcaattagattgaagataaatatgaagcataattaaattttattaagtaaggggacccaagttccataagtataatttgcacttaatcaatagtagtaccatacaaaacatacacttgaacaattaacttccaaatggattatagtttttagtaggaataaaggcgctatggttcagcattagcacataaagttgattaattagaaaaactgtttagcttagcacatatatccaactgaaactatcgtccagttgtctgtttcatattttctagagttttacttttaaaaaaaaaacgactagagttttactttccatggtcactgggtttacgaaatctttgtagggcacgcaattgctttcttaaaccaaccagctcaccaaaagtcacatctgttcactgcttgttagctcaaattggccaaatcaagaataattgttgacgaaataattaattatcttaaagattctcaccagggcattatttcaactgattcaaaacagcatcaggagctattgccgtttactataatgtgacagtgagccattgcttatgcagctacaaattggtgtataatcccaaacactaataacaaatacaagaaaccgatcccatgtagttgattccttgattcactatgtagcaaattttctttctgtgatgcccctaaaacatattggtctccacagaacgaaaaggaaaaaagcgatcatatccgttgaagaatatgtcaattgcaaatgtacccagtatccatctcacagttgattctaacattaatagtcgcagcatcgcaggctgcaaacttatcttcatgggcgtcaagccatcaacaacttgagtcgctatagacgcaactgtgatagcccaattgcccaaagggataacaaccatcactccaaactcaaaggcttcattcctagaacagctaactgagtctggtttccaagtgaggttttaccactacacttctacctcgaaccctggactagtaagcatcgcgccgccgtccagcctccaggacggcctaggctacagtacgaagttgagaaccctagtgcctcgatggctagtccatggcagcatactcctctcagcctctcagcctctcaccctggccgctacaagtacaaaccccactctacactacaccaacccggtcggcggagagcgggcgccgggagacgctcgactcggagtcaaatttgaacctcatattggcgagcggaagcgtttaccaccgcgaggatgaatgcggaggaggctggccgtggccggccgccacgccggggatggccacggcggcggcggcggcggatcgatcatcggctcccggcgcccgggggaatccccgcacccagccctcaggcgcgccggccgccggccgccgggatgagacggagcaggtgttggtggccgcggcggcgcggcggggggcgaggcgaacggcggccgcgcgctcggtgggcgtgcgagtggggaagggaaggaaaatggaagagaatgttcgctttgcttgtgggagggggtagtgggccgaaagctggaggaggcccggcccaggaaaaattttgcattcgcatttggagagagtagagagatctacatcctatgaagcctttattattttgcatctaatttagctaacttttggtctgagatgcattcaaattctgaaatgtgtgtgtgcctacaagatttgaaggggggactacaaagtatttcgtcctcaccgtcactgcacacaggcaaattgccttgtagagcaattaaaatatattatattttattagggacttgtaatatttaaagtaaattttgtgatccaagttaaatcattggtag

SEQ ID NO: 82013 - DNA, 9396 bp, Oryza sativa
aatggaatatttttagaaaaactattttattatatataaagtatcattgtgaataaaaaaaagttttcataatacttatcgttttttgacaaactgataaaaagagtgggcatgggagtagaaatcatgtgggctctgcccgcgcaggttctcgaatcctgccgaccacgcctttcttataaaaataaattgcataatttatttttagtttttattcaattttgcacaagatttgtatttatataagagaaaattcgattcatagcacaggaaagaaatcggtaccaaaaaatagcacacaaatttttcgctttcggcgagaagcacaggccaccgtttttccttcgtcccgtagcacttccatcgcattcatccatccagtgaagtgttttgctgttagtcaacagatagaaagaccaaattgcccttcttctatctgtatagcaaggcccactcaatttgtcctacgctgatatcactgcttgaggggaagagaaaggggaaaggcgacggcgacggcggcgagcagaggggagacggcgactgctagcagctggcggctatatcgcggctgcatgctcaaggctctctcacggtatgtgcaatgatgaatttgtggttgggtttttgactggggcaacctagatctgaagaaatgttctttgtttgtttgttgtggtttctgaagcaggaatgtgattttgttagactctttttgatagactgtttagatggttgctccagacgacatccctctttggtaagattgttctacaaccaaatcacaaatcacattgttctttgaaataggggttaggaatgtgtgtgctaactataggaatcaatcttgctatggcagggttgatcccttttcggcatatcgggtatgcattactatgcgatcatatactcgaaagggtgatgtcgaagtgatttgtgatgggaaggaatgggacatagttgttgatagagataaattcaacttgattgcgcttactgatgagattaaagaacattttgaatggggaaccaatcaaaaagctagcatgttatatcttgatagtacaggacaataccttccactgactagtgatgctgcactgagaagtctggtagattcaaattttctatttcgcgaaattagtgttttggttagggtggaggatattgttgaggttgctgatgccgatggcaatggcaatgccaattgcaatggtggtgatggccctggtggtgatggcagtggtggtgatgactctggtgttgatgtcaacggtggtgatggcaatgatggtgatggcagtggtgctgatggagatggcaatgtagttgtaggtgagaaagagatgcaacaaaaagcatctagtaaatggcaagctatgttttgggatgatactcctattagtaatcctgaagatcctgaagatgaaccaattggggtgaatgaagaacacttatatggagttgtagatcttgaatctcagaaggaagggactagtggaaagaagacagataaagagaggtcaagtgggaatgaggtagctactcaggatgttccaaatgattttgacccgcagcatgtccctgaagaggaagtacctattgatgagattggcaatgttgtgcccttgtttgtgcacaacagggagaatcctacatttgttgtagatgcaacattcccaaatggagaggcttttaaacttgcaatgagacagtttgcaataaaaggagaatttgaggtcgatgttagccatagtaataagactaggtatattgcaaagtgtgctaaaacaaaagactgcacatggaggatatatgcgaggaaagagaccaaatctagtgtttggaaggttatttgactctttttcttgttattgcatatcattttttatctttttattataatattggcatctcatcctacttttgttatgcattgcagatcagtcgcttaagtgagattcctacttgtgctactacaagcaagctgagtggaagatggcatcctcaggatggattgcagatagggctaaggaaataatgaccacagagcctaacattggccccaaggcacttcaagataggttggagaagaaatataatgtaactcttaggtatggcagaacttgggaaggcctccaaaaggcaaaggatgacatccatggatcatgggaggctagctttcagcttctgtggagttttaaggctgaggtagaaagatcaatgccaggtagcattgttgacatcgatgtgaatgcaatgggggaaaaggttttctttaggaggttatttgttgcattaaaaccctgcattgatggatttctactaggatgcagaccatatctaggttgtgattctagttttttgactaggaaatatacatggcaaatagcagcagcagttggagttgatggtcacaattggctttttccaatggcatatgcaatttttgacaaggaaaactatgaaaattgggaatggttcatgcaaaggttgaaacaagcagtaggtactcgagatggattggtcatacatactgatgcatgcaagggttgcaaacaacaattagtgatgtttttggtcgaacagtggaatatagggaatgctttcgacatctcatgttgaacttcagtaaaaaattcaggggtgaagtatttgattccaatatgtggcctgcagcatgaaccttttcactctacaagtaccaagagtacatggatcagattaaagaagcatgccctgctgcttatgagtacctagaagtccaccatccacgtgcatggacaagaagcaagttttcagaagcatgcaagattgagtatgtgtgtaataatcttgcagaatcattcaatgcatggataagtgatataaaaggcttgcctattattgacctagtaaataagctaagacaaatgataatgaagcagatgtcaaggagaaaaagagttgcagaaggcttaacagataaaattcttcctagtgttgttagagctctaaatgccaagagtagaggactaaactatgaaattgcaagaagtggtcttactgatgcagaggtgacagtttttgatatgaaaaccaaaaaacacaacacttatggtgtttttctagaaaagtgggaatgcacttgtcgacagtggcaaatttctggcaagccatgcaaacatgcaattgctttcatttgttccatcagaggagctagtttggaagattatgttggggaatttttctctgtagataggttcaagtttgcatatgcaagttccattgtacccattgtaggatcgagatgtcgactagagaggaggtgaataggcgatttaaaaattaaataacacctaatcaaatctaacctaagttgctaggcttggtgagggtgaactctaactaagcaactaagttatgttttgcaaacctagggtgatagtggctcaattatatctctaggaaagtaaattgcataaatgtaaatgtgacaatcaaatgagacaatgagacaagagatttttcaccgaggttcggaaactcgccggtttcctactccccgttgaggcgagcccaactccaccgctcaaccacgaagccaccgcacgcccccttcgtcaagggtgggcaaggcgggagccggcccacggagaggactacccaagcctcgatcactcggggtagttcttccttcactctgaaggtggtgaactccaaaccactcacaaaccggcgccgggccgcctccacaatcttctcggagaggtcaccgggcaactcctccataagccgtctaggaggcggcaacctccaagagtaacaagcaatgacccggtgtggagatgatcaagtgccacactagctctacaatggaagcaaatgcacttgactcttagctaaacaaccctctaacacactagatggatgaacacaaagctcaagtgagtgtgagagaggtgcaaggggtgtatgcaattgaattaggtgccaagagagcccccttgctactggtgggggagtatttatactcccacccaccaaaactagccgttggtggcgaaatcccccaactttgtgctctgccggtctgaccgaaggtatgtggctggtcagaccgtgctactctgcaacggctagaaaactagccgttgaagtgctgtcagagggccccatcggcctgaccggtcagaccgacatggggtggccggtcagaccggcctcgactcggtcagaccgccatcagctcggtctgaccgactacggctccgtcggctctgtatcggccatcccgagcagcatcatctcggcctccagggggccggtctgactgggaaagtgccgccggtcagaccgcccgcggggccggtcagaccggctagggcacgccggtcagaccgccactatgtgccagtctgaccgcccctggtcaggccgaacccagtgaatttgcaagtgaatgtgtgtataatgaaaaagagagcacaaatgaaaatgcaatgacctaatgtggcaattaaaatcatctctttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcacatatgacgtggacctaacttaaaatgtatagctcaaagacaacggttagtccacaattagtgcttgtcattaattaccaaaattaacaccgggggcctagatgcttcacccatgtcagacaagacccaatggccaaaagttgacatagggttcaaaatgttgccaccaaagcttggaagatcagcaggaagacctcagaaaaatcgtgtgccaaatagtgctgaagggaaaggaaagggaaagtgcaaaaggtgctcgagatgtcaaggatttgggaatcaagctagaacttgcaaggaacctgagtgcgtagacctatctgatcttgcatctgctccagcacccccccccccaaaaaaaagaaagaaaaggtctagttttcctgcttctccttctgatatcttaatctgcattttttgtactgctaacaattttttggttctctttcaggaagaccaaacctgcagtggtagttgtctcaaagccccagacaaggtctaagtccaaatgtgatgcctcatcttcttcccagctgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcagaacgccgcatgtaacacagtgcagcgcgctcgtttatccggtcagtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatataccaggcttcattctaaccattacaggcaagatattgtatgaagaagggcgaacatgcagattgttaaactgacacgtggtggacaagaatgatcgatttgtgaccggtctgacaatggtcatgtcgtcagcagacagccatgttcccacgtcgcgcctgcttccggtggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaacgaggaccttgcccacgtagaaagggagaggagaaaaacgatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgcgaactttccacagaccaggagcttagaatctcacccagggcccccggccgaaccggcaaaggggggcctgcgcggtctctcggtgaggagccgcaagctccgtcatctggcacgccaggtagggggctctgcgagagatcttctgagctctcgcactctttcgtgtgcgccaagcttttcctgttcagcccaatggccgaacaagcaaaggcgcacaacctctctccgagcattagcggtgacgatggggagccaaacccatgccgtcgagctcgtactccaccgccccctccacgccaaagtcctaggagggaggaggtgctcgagagggtcgaaggatccgcgacttcgacatccacgggcgatggggaagggcggcgagatggggagcgtcgcctcctcgtctacggtgacggcagcacgccccagggcgcgctccaagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctctggcgctactaccaccggctccgtgtcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgtgcccaggtgaagaagcggacctgcacgcagtacagcgaagggatgatgagtcacttcgctcgtacattcagcggttctgtcaagtccgcaacaccataccaagcatccctgcacacgcggtgatctacgcgttcagggggggtgtgcggcacaaccgcatgctcgaaaagatcgcctccaaagagccccagactaccgcggagctttttcagctcgtggaccgagtggctcgcaaggaggaggcctggacttggaacccctccggttccagtgtggcagcttcggccgcccccgggtccgccgctcggtcagggcggcgggacaggaggaggaagaagaggtcggcccattccgacgacgagggtcatgtcctcgccgtcgaaggcgtttcgctggccacccgaaaggggaggcctgcgagcgacaaaaagaaggaagccgacactccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttccgctggccacgggcgatggcacagagctgcctaacccgtggaacatcgaacaccttcgtcgcttctacccctaaaggggatcgggtgtcaggtttcgggctcgggccaaccccgcacccccctcgggcgtgcagggttggccgggggctaccacatatgcatattcttatttctcttacatctgtatctcaataaaagcattttcgatttcctaaaggctgtatctgtgctgttgtcgctgtcgtccgcaccgtcgtcaccgcactcctcgtcggagttgaaggcaaacgcgagccgaggggccgctcattattgtcggtcggttttcccttgctgatgcgcgcgatttgcgaccgccgggattctgcccgaagagagagagagcagggaggagaggcccccgagccgaacggcggcctaaggcccccgacgaccggagctggccctccgcctgcttgtccgacggtgccaggcgcccccgacccccaggatggccccgaggccactgcgggaaggccgcgcctgtcgccctctgaccccgaggtcgtcggcacagaagccgaatgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttatgctatcctgataacttcgaggaagttgcgccattatttccaggcgcatcgggtcacggtggttacgtcttatcccctcggccaaatcttgtataaccgagagggtactggacgggtggtgaaatgggcaatcgaactctctgaattcgatttgcgcttgaaaccaagccacgcgatcaagagccaggccctcgccgactttgtggtggagtggaccccagctcccgagctcgtctccgcccccgaggccagctcaagcccatcgcagctgcctcacaccgccctctaggtgatgtagttcgacggcacctgtaggaaccggccccacctgtcaccaggccttagaagtggcgtcacgcccgaccgcttccctcggggagggcgatcgccctggcataacgcagggggctactgtcggtgacatgggaccgggagtatcatgacttagagacttgaggcagacacgatcacccacgtggcctaaccccctcgggggggtcgggcccaagggtgatacggtcgcccttctctttgtctccctgaggggtcggaccgctcccgtctcggccccgagggccgaggcgccccgaccccttgtgggttttgcgccgcgtatatggggtaggtgagcatagcggggctcac

SEQ ID NO: 82014 - DNA, 14192 bp, Oryza sativa
tatgtttccttcaggtaatcaggtcaacagtaggtgaggaggaaattaattggctattatttgactagtgttctttaattttgtttgattatgtattggccaagttaatgcatatcaaggaaaatgcagtgaagcttgttaaatacgtgatccgaattttgagcccacaatatattcggattaaaagctgatgtttttgtttgcttaaccgccatgaaatgtacatttgtttgtctttttgcccaaactattttttctccatctgctttcaagcaaaacgggtctattaattatttgctcttcttgtaatcggtagaatgtacaacgaagaaaaacatggctaaatcatggcaagcggtgtttatcatcccttggcgtttcttttgataaatcgttcaccttgaagagtactctctccagtaggtaggatgcccagcatcctcaggtacaagaacactcagaagaccaaactgtgcagtctatccaaaattcatccccatttcctagatgaatttgtcgaaaaccgtaccctgtcgaatgtaacatgacaattacaatcaccagggacaggcagaagtagcatgtctgcaaggccagcaataagaatgagctgcagcatgtctagcatttgtttggtcctctaaagtagtaaccgaacaactcccggagcctcccatgcctagcatatagccacccactggcctggtcctcaactctctagtacatcactctttcatttctatctgtcaattagtagcacttgtgcccgttcatatcaccttatatggagcaaaaacagattgctttcaggtcagtagttggtgaggaagaaattaccaggacctgaaaaaaaatatttgttttttttctattctgtaatagcagccaagtttgttgttttcagagtttcagtaatttgttgttcaattggaagagccatatgcagtaatctgcaagggtgtaaataccataaatctgcaggtttcatctctttcgtcatggaccagaagagcgcatatatcttcagtagatttttactgctatatgatcgatgcaattataagtagtccaacaagtaagtatatacggtattgttcaattgggcaccttctaggttaaagttgaaagtgagtcgtattgttgtcaaatctatctatctattatatactaaaagtccattaaacctgctacaaacgctcctaagctgccaagtggcgcttctaaaaacactcttaggttgccacgtggcagtttataatctcacaatcgattttcatttaaattgatgggcccattagattagatctattgcttcgtcttaatattctctgtagatatgggtgaaaccgtttacaccagaaaaacatacgtacgtactatggaaagaaacgatcaaacgaacccttcagcatacgtacgcacgtacgatgcatcgtaccataaatagctattaaaaatgataaaagaaagatactattcacttgaaaaaaaatacttatatatgcacgagtaaaaataataaaagctataagacctaaaaaatatataagactagaaaatatatgtacgtcggtataagaaaataaacgttttttaaaataagactttctatactataaaaaacaaaacttattactccacaaataaggtggtctagcgtttctacaattgccacatgcatggctctctacaattttgctatcaattttcatttaaaatgatggatcattattttagatcattagatttgctcatttcctcttaatttcctcggtatacaaccgaatgttctattgaaaaaaaaaatacaaagacaaatacaaatagacgataataaacctttagatattgttcccttaaaaaagtacgtacggatacacgagtaaaaataaaagccataatactctaaaaatgtatatacgtcggtaggaaaaaatagacggtcttttaaaaatacgattatctatactataaaaataaaatttattactccacaaatattatcatgtggcgtttctgtaagcactcttagaataccacatggcactctataatttcgttgtcaattttcattcaaaatgatggatccattattttatatcattaaattagcctgcttcctattaatcgagagaaaccatttactggatgtttgattgaaaaacaaatataaagaaccatacgtacatacgataagaaagttataaagccaaaaaaatatttatcagagtacgtactacgataaaaaaagctataaaacaaaataaacatttagatatactgttcccttaagataagtatgttataaatggtctttttaaaataggatttgctatactataaaaaatataatttatcactccacaaatatggtcatgtggcgttttagcaagcactcttagaatgccatgtggtactctataattttgttgtcaaatttcattcaaaatagtggacctattattttggattatttgattagcccgcttccttttaatctcatctatacgagcgaaaccatttagtgatgttctattgaaaaaagcaaagaaacatacgaacacatgataataaagctataaagcccaaataatactaatataagttggtagaaccatcgaaaaaatatagacgattttaaaactaggattttctatacgatagaataaaatttattactccaaaaataaaaatgcaagttaaactagatcaatataaaaaaaattaaatgtgtttacacgcaattttttttgattatttttaaattttatagtcaacttataaggtgtattcaaatcttgataacataacatagttatattataactaaatacattggagctgacatataataagtaatatcataatatttttttaaataatttaggcgtcatataatagttaatgtcatgataatcttcgaaataatttcacatcataatttatggtcaaatatcacttaacaattatataacactaactgaaatctacatgcatgaaaaatgaaacaacattatgttttttaattatatctgatttaattttagtttgtgtgagattaagattctcaaagttttttttttatttttcataactattggattggtatgctcaggcaatgatcttgctataatacgaccccttaatctatcacaagaattatggtcatatacgtttttctttgccaaataggtttgataacaaatgaacaatcctataacatgagcatgaaactattcatgatatattttcttatagtagaggaattataatataatggtcataagtgataattgatgaatgtaatgccataaaccacagtgacataactataagtgcacctcaacaaattagttattataaataattttgggaaataaataaaattttagaattagtaaaggtgtctcatgcaattatggacaataggtgatgaaaacaaacaagatgctaaaatatagatctttgtcaaaatataaacaatgaaataatactctgaacattgtcacggtcacgtgtttgtttagctatatatatttttagtgatcaacttcactcatttctaaagatgacattgtatttgtaccataaaaattaagcagctttgattaacaccataaacaaaattgtgtctaaataaaacataaagaaactatattttatgggaataactgaataactatttacatcacatccatcttctctttgtttccctagagggcaccgagcatggataccacaactatagcgtggggcacacatatggttgacttgaggcaggctcagtggaggccaccattgataatagtgctcaacttcctacttactggtgcaatcgtctttaaggatgccgataatgaactaggattaattcaaattgtgctccacactggttgtgagactgtgagaggcacgactatgtcaacccatgcttgaaggaatcttgatggttccccccattagagggacatgtctattttttaacggtgctatcctaataaccaatagaagcattagttttagaatatttatcagtagatttagaaataagtgttggcataaacatttaggtacatagttgaaataatgttttatgtattaatgatgtattagacttattttggtggtttagatggagttccatttattaaaatcatatctatcttttaagaacaatgataataaataatggtgataatagcagagtttacacttacctggacaaaagtgaattttgattaaatctaagagacattcttatcatttatattaaagtctacggtctatttcacaacataattttttgttactacgaggcaaaatctataatttgttatatgtatatggtgagatatgacttaattctcttagcattatttatataaacaataaataagatgcacgcgcatctgcgcgggcttcctttctagttacataaaaaaaatatcatcatcaaacccaaatccttttattttatttttattttgaagactaacccaaatcatgaaaggatttccaaacataccattttcgctcagataattttttcctaaatagtaatatgtcaagtgcaatgcatcagaaaccacattgtgctctaattaatctatcaaaaggatatcacaacgatattgaagtccactccttgcttcggcatcctctccactgtgtacttcttgtgattgtgatgttaaatcgtggtgatggactgacggtcaaattcagtgtcatgctgcatggttggagcggcatcagaatccatgcacggaacaatggtcttcaagatatcacagccctgttttcccacatcaccaggtatctgaacaatgtcattgcagttcaatgcagcaactgctgttgcggtgtttcgccgaagtagaagaactcccgatgtctcctaggcctaccatagcaacccatgatgctcataacaataagcgatcttattcactctctgtcagcttgtagcacttatgcttgttcatcgatatctcattttgtaaggagcaaaaaggggagtgagatatcatatatatgattcgaagttgtattcaatgtgcatctatgaattagtagcacttgtgcagttgtgctcgtgcatatcaccttatatggagaaaaatatattgttttctggtctgtagttggtgaggaagaaatgaccaggacctgaaaaaaaatcttatttctttttctattcttagtaccagccaagtttgttgtcttcagagattctctaattgttgtttaattggaagcgccatatgcagtaatctggaagggtgtttactactgtaattctgcaggttcctttttttttttctcaaacatgaatgttcaattgggcaccttctaggctaagataaaaagtgagtcatattggtttcaaattacataaaaaaccaccatgatcaaacccaaattctttatttatttgaagactaacccaaatcatgaaaagattttcgaacatatcattttcgttcagatattctttttcctaaatagtaatatgtggagtgcagcgcagcagaaacctcgttgtgctcgaatctataaaaaacacatcaccaccatagtgaactccactcctggctgcagtgtctgcaccacttcttgtgtttgtggaaccatgttttcgcaagcacctgctgatatctcagcagtgtctttgcagttcaatgcagcatctaccagtatagaatttgacataagtaacagaactcctgatggctcctaggcctaccatagcaacccacatgatgctcatcacaataagctctttcgctctttaccagcttgtgtagcacttctacttgttctttgttcacctcatcttataaggagcaaaaaatgggagcaagatatcatattatgaatgcataaactgtttccatgcaggtaaaattgtcaaatctgaagaagtaaatgatcacaagaaattttccttaccaaatattaaccactcttattcacaaaaaaataataataattaaccacttgcttagcaacccatgcaagaaatggcatatcatcaacctgaccgtaaacatgcacctggttatataactttacacaatttttgaagaattccttgggccaaaagggagaaaaaaatagttctatattctaagagatttgcttcggtctagcaaaaagtactttggggtactgatacctcacgataccaaatcgtttccgatcgttggatctagctgggtaagatgggcactattagatccaatgatcggaaatgatttggtacctcacagtagctagacatgatggacattgttagatccaacgatcggaaataatttgatatcgtgaggtactagtatctcgaggtactttttattgaaccggagcaaatctcttctaattagaaataagactaaaaacctactccttgcattccaaaatataacaactttagtgccttcaagatttgtcccaaaataaacaacctcttcttcaccaatattcttttaccaaccaatcacaaccctccaccattcaatttttcctaactttacttcttatccaatcacactcttctcccatttaattctaccaactttcttaataactgtgtccgacccctaaatttccttatattctgagacaaagatagtacaagattttacgtgaacacgtgaagctaagtgactggaactggaatttgagtttggaatcgataccatatgcacctgatctcagctgaacaaattaagtgcaaattctgaaaatctgcaacgggtccaagaagagagtgcggaaattgctagcaactcaacagagaccgagactgagacaatccagtatgttgacgctttttcgtgatagtgttgccattgcttatcaaccaaaggaactccagcatggggcacacagtggcagtgaaatgcaggcatccaacttgattgctatgtgagtacatcaagaaatggataacaaccagaaactccgcttaacttttgattgataagtacatgtacatgaagaacttcatcagtacagcatgtcaagaaaaggagtaagtcatgcctttatgcagatgaatatgaggaaggccaaccagaaacaaaaggatgtgacccttcataagttcccgttgtggatggactcacggaattacaactcctgatgcctcctaggccgaccatagctacccattgctttgtcttttgcctccaggaaagggcttatatatttcattctctcttaaacaacatttgttcatttctcagttagggactctgttatccttatatgtgtatctgcgtgtataggtttatgatcctttatctccatgtatatatagtatttgatctgatgcaatcactcaacattattgttccacttcaatgcaaagacaacaatagtgtggagaactgaaggggattcaaattaaatgatcaaatcaacagcttcaggaatagcatgaaggatcagtagataaaggatattacacaaaattgagcataagttcatacattgatataattgaccgtacattaattacaattctttaaaattgtttaacacataaaagtactaactgttcaatagtattgaagcagtgatgcatgatgcaagcgagccatacatgtatgatttagtttagccacttcaattaagttgttgtgaactgaaagcagcgagtcaatccgtatagcctagctaacaatcaatgagagtcatcatgttaaattgtagatctttgatcagattagcttgacaagcaacaattaattgggttagggtacggtggaacacacgccggcaaccacctcgttcgttgaatccatctggcctgctacgtcaggaaatgccctttctcagcttggatgttcctacgaactgcggtattcttgagccagagcagccagctgatggtggaacagaaatggcaccatcacatgctgcgggtctccttgacgaggatcttggtgacaccggcaccgcgtgacatgacaactcctgatgcctcccaaggccagcaaccgacgctatagctgtcttgagtgggcactattccatatatgctccttgaaatgttcctcatcttagaaatgtttctgctagaacttgtttgaagaacttgaagatgacgttcataacatgaagtgagaaagccaagattttctctcctctcgagtaatttaccgtccttgagaaagacggattgtgccattatatcttctcatacatatatatgtttctaattccacatcatcatgtaattaaattaatcatgatatgagctatgattctctcttagtccaaattgccttggcgagggatctcatcgacatgcatgcctgttgtcgttatatttgtaaaacacacctcttccttaataaaactggctagcattcttttttgagggaacaggcaaggagctcctacaatttcagtatagaagaagagagttgatgcaatttataaggaaaaccagacccgaaaaccttaataatggcataggaaaaccggcgaaaaccctgacattgacataccgaacctaagaacaacagtccaacaaggaaaaaaactactaaaacgaagcctgcaagaaggttacgtcgacagaataacgacatcgtccgatccaaacgaatctaaggtttacacttggagaattcccttgaagtacagttgaacgagaactccaatagcaacgccttcaagaaggttaacggtgcccaacggcatcaccgttgctagccccggcaagcagagcaaggttttcaccttagagtccccttctaccatagcaaccacaacagaagccaccaaatgccacctgcacaccgaaggcacttgcactattcaaatcacctgcacaacgaccggactggaccgagcggcgaagcagaactgatggctccaccagacagccacacaggtgacacaaagatgatacaatccaattgtgcccacccctagtctctgcataaaatggacacatccaaaaaagaaccaggtaaaacctcatcccatgcacaaaagtttgacagaaacataaatattagtggctaacaattcgtagactaaaccgtcactcatgctcctgggtaaaagaactcctattccacctggtccaaccatcgtgaagcaccgcaatagtatcccgaagtcctggtgtgagtagataagttgggggctttgatcactagcggttctatcctcgttccatgtggttgtcgttgtcaccgatttgatggatccatctcaatagggattctctcccgctcgttttctgcaattgtgcagccactgtaggttgcaactattgttgtcagtcgcacgacctccatatctgaaccaatttgagcgagaactagtttcaggtgaaatggtgaggcaacaacaacatagctttgaagcaatcagatgatttctcattccgatgcctcctattcctttctttttgttgagctggtcgaaggaggtcaaccaatttcattaagtttagggaaaaacaaggggaagtgatgttggtccccttggggcccaatttgtcggcatccattacaaaaaaataacattttttccaaatgtccaaaacctatttttgcgtgtggttgagccactcgtttgcctgaaagtgtctgcgaaaatttctatttttccatgcaggcgccccgcacgtggaaatccgatttccgcatgcgggtgcttatgtcatatgcatgcaaaaattaaatccaaaaaaaacccaaatatcgaagtcctagctcggtgtggtccgccgccgctggatccgcacggaggagtgccccgtgttcgctcctcgcttcccgctgggctcctcccaccgccgccgccagatccgcgtgggggatagccccgccgctaccaccgtcgcccctggcctcctctgctgggtagtggagggctgtcccccacacgtcgacgggtaaaagaggtccgtctgggaaaatagacttattttcgcatcctttaagaggtctgcttgcgaaaatagattttttgcatgcggggcaaggagacgtatgtgaaaatggaggtcaatttttgctggcgcgaccagttacggtccacctgcaaactataagggtcctcgtacaatatttttttctgtagtaatgatcttattgtagttgtatttgtaaaatgcctcctatatattccaattattctgctggtagcatcatcggaggatggacatggcagacaccacccagttgctggcttgctgctggcctgatgataacaaggaaagaagccaaggggttcggagattaaaacaccggaccgtcgttgtccacagtcagtttacttttggctagcagtggcttccactcctaaaaattggctaggaaatataatgcttccttttttctgatatgtgctggctgaatttatgtgttcaatttatcctaaaatttgaatgagacattggggtgagatggtatcctacaggtcaaattaaagcagtcactggtagtatagcagtcaaattgttgggcatgcagcattcagcatatgatctactagttccaaagacaaactggaaaccaaaacagtaatcatgtctactataactctgaagggaaaattgaatcataagagttctcagggcctcccaggcgtaccatacccacggtaagaactcaattctttccatatatacatggttatactctctgatctttccttgtcaaatgagaaaataaatttgtaagatcgaatcataagaactaagccaaccagaggggggtgaatggttggtatacccaaaaatcaagaacttttagcggaaataaaaattaccctcgaaatcgatggatcgcggtctgaccgaagtagatgcaccggtctgaccgcctaaaaaccaccggtctgaccgcctgatcagctactgtcgcctgaagccgccgccggtctgaccgcccttacgccgccggtcggaccgccgcgatgctgccggtctgaccgccggagagatgccggttagaccgccagaacccggtgaaacacaaatcgaagaactctcaaagtagatgacaactttattgcttttctctgtgtttacaaagtgcaccaacagtactccttacaaaaatctcaactaaaatcgaaaccctaactaaactagcaactcaattgctaagcgataccgggaagcctcacgctccccctctatttatacccgaggtaggcagcctaaaaccacgaaccaaactcatactaagaatcctaaacaccttaggaaaacctctagtacaagaaagaaactttacataaccaatcgtaccaaatttggactccttccaaatccgactccgcatcccatacacacacaatacctccatcgtatgccatatggaatctccatcaaccacgtgcatcaactctaaccttagtatcccgcatgatatctgaccaccacggacatcgtcttaccaccaagccgactcccggtccatcaccacaaatactctcccgaggcatcgagtcacctacacatgaaacaaacaaagaaaccatattacgagaccaagctatctccaacttgactcattagtagcaaacaacagtattacatacatatagtatccatctagaagccataaccatgaaataatcacggatatccaaagaaacaacccgaaaccgaaaccgacacagcgtcagccggtcagaccgcgggccggccggtctgaccgctcacaaagcgccggtctgaccggcaaccaccgcctggtctgaccggtcccgacaaaccagtaaaccctgttcatctcctcaaaattgattatctccaaaaccacttcgacaataatctccaaatatcaaaaccgataatcacagatgccaattgttcatcacataataagaatcaaaacacacgttgatctctcttcaggaattgtacatggcaaacacctgttgctgctgctggtctgacgataagaacgagagaacatgcagcagcagcaggcaaaaggggccgggctttaaaactccgaaccccttgacctcagcaactttgtgacctacatgtgccatcgacctgcagatgattcaacttcaaagggattataatatgcttcatgtctgagatttgaaggtagccactctttaagccagagtttgactgaaactaatccaaattgttgatgcagcagctgacttctgaagaaaccatacgatttttgatgcctcctaggccaaacgttacacccagagaattgatcaaattatatattatagactataagtacagcatactctcctttttatcaattcaggatctgctgatcttgaagaaagttacatctctgaaggtgaagaaactggttgctagcatcataacaagaacaataatatattgtcactgaaacactagaggtaaataaaaaattcctcccggccggcgtatgtaattctccatataactatcccttgcaccaccggagaatacacccgggtgagttttgcaccgtcagataatacttcaacgatccagattgatgtatgcccccacccctgaatgcaggctagtgtccagtgcaaaagctgctcatctctgcccccctgaagcagtgagggggaaaagtattttatggcacctaggtgtatgcttacggttaaaatagttatataaaaattttataaaatttgataagttaggttacaataatataagatactacacaaaacatgcaagtcgaagcagcgtgaaaccagatagcatagtacagcacctgctgcaaccgccttccttgctgcacacagccaccaacagtgattatctcacgcttgtctaaattgatttgcagccactgaagattacaactgttagtgaccatcacacatccaccacggagtgctgcctaagccagattttggctcaaaccaaattgaagtcgctgaggcacaacaacttgaattcaaaacattcgtacatttcccaatgcctcctaggccaagctgctgtgtttgttgtgaagtggcttccctctccttgaggcattgttcatctagatctcactactgttagcatttctttgtgctccatagcttgctcatcagctcatggatagatgcgtatgtagactagaaggatatatatatttatatatgatttgatatttgccacaagaaaaatgtgttagtcctgatgtactcgttgttggggctctagcactctagcacatagagatttctgttgagctctatggactgatagtagtcactaagatccatgtttctgtcaaacttctgtgcttgggagaggtttctagttgtttctatctttttttttaggatgttgcattatatatgtagaggccggggttgggctcagttggcttgtatcattttggtgtaattgactacgtttgaataaagcatccattatctaaaaaaaattaatgttctagcttaattggacaaattcatctgaaaacaattacgatttggttaaggaagttcggtattgttgtataggggctaaatgatgtctgtgaatcggctcagattttcggtttgatgatcatgtttttttcaatataatttgaaaacagtactgttcactttaaattgaacaatgcaacatggagccaggcaactcagtggattaagtttgtcatcagattgtactaaatatctaaattccacacgattatttttttagtagatgcagtcattatcctgttcaattgggcaactagcaggctataactgacaagcaagcatgatgataagaatggaacaaaattgagcaggcagcagtcaagggagtcgaagatcaaaacaccggtcccaattgtccacattcaatttactttttgtctagcagtggcctccactcctaagaattggctaggaaattgatgctttcatttttatgatttgtactggcttaatttatgtgttgatttagtcagaaatctgaatgaatcattggggggtaggatggtattacagtcaactttaaggacttgttcagtagctggtaatagtaggatcagatgtgatttttttcttgggactggcagcaatatagaatagtgtatttggcaaaattctgaaaataaggtacccttagaaaaataaatgaagtgaacatcctgctggtgcatattgtagaagatgcagaaaaaaacatgaatactagtactccctccgtcccaaaaaaaaatccaatcctgggtttg

SEQ ID NO: 82015 - DNA, 27513 bp, Oryza sativa
ctcctggagatggcacgttggttccggtcagatatataccaggcttcattctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaaggtcattcggacggcagccatacaaatctccttccattaatgaagagaagtcaagttggagggaagagaggatgagtccccacacaaaagaaagagagggagagatggtgcatgtggtatccccttgagatataaaaggaagaccttgcccacgtagaaagggagaggagaaaaacgatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgtgaactttccacagaccaggagcttagaatctcacccagggcccccggccgaaccggcaaaggggggcctgcgcggtctcccagtgaggagccccaagctccgtcaccagccactgcctacatccccttcacatcctgctggagtagtttctacatctcagccgcctacaaggacaactcctcccaggctagcaaagacaaaagcaaggacagctagtgttaggacaaaatgaaccaaaatactacctgttaatctatggacctgtatctctctatggatctgttaatctattctgtatctctctatggaccatggaccatggaccatgtaaactctatgtttgtatgcacctgttaatctatcctattatgtgtggacatgtttggtagaacaaatgcgctcaaaatctgatccttaagtattcatgttttattcctgtcacactatgcaagtgcataaacataaaaaagtactatcttgtcacataattatcatcatttcattaagattagaataattatcatcacataatctccattacttcaagtgcataaacatacaaaagtactaacttgtcacatacatcagagatcacaactaacttccagattacagcagagctcacagaaagccctttgccaccactacagcaatcatacctaaaagtacagcaccaaaaacaacaatgccaaatgctgcaatcttcaaatagagagtttgctgcttcacttcggacctcatcatcaatacaacatctataagcttcttctttgaacctaggtcttcaacttcatcctcttcagaactatctcccttgatttcttccctactagcatctccattcagcaatccatgatcgataaggtacttctggtagcattctttccaataccaaaaatcgcatggggcattcctctacaaatttaacccattcatcaccttattaggcacaatacaggtgcaaacaacaaaaataaatcacaacaaatttgtactttacctctgtgcggtttgaacacttgtagtacactcgatttgggttcttcttgctgcgggacacataccgaacaatttgctctccacaatccggataatacaccaatggcaacaatgaggagggagtaaaacgaatctgaccagtggaagaggatgatgcatgacgaggatggcggagcatggatccctcaacatgtgagccacgaacagttgagctacccgaagccgccattgccaacaagaactagggttagggtttgctgagcggaaaatgaagagaatgaacgggaaagagcaaggaaatggggaataagggagaagagacgaagggcaaatgaatccaacaatatttttctccactccgatctaacgccgttacctcgcaatgcgacggaagtgctacgggacgaaggaaaaacggtggcctgtgcttctcgccgaaagtgaaaattttgtgtgctattttttggtaccgatttctttcctgtgctatggatcgaattttctctttatataatactagtactagtatttataagacgcttcgcattcacattttcatttcagtttgcacaatatttttcagttcgtatttaataagacgcttcacatttcatttgaaacctgctcctgaactcctctgacatcggcccaccacaaattaaacagagcccaatttccgcaaacattaattaaccccaacaaaagcaatcgaaaagaagcccattaattatactttaatggctgcttgtgattttggcccgtacctgctggtaattctatcccgtggtagctcgtaaatttttgcccattggcattgaaaatctccgttcgtagttgctgataaatttggcctgtaagagtgataatttcggaccatactagaaaatgggtgcgcctttggcgcaccaactaaaaatagcccgtgaatctttatattttttcatttaggatatataaacattgtagagttatttataattagtttagtgtttattttccgacaaatatattacacctagataaacggaaaccggcaaaaaaaaatctaagctcaaaataacatctcaaaatagatgcgctttgccgcatattggatcaggaagtagaaaatattgatgtgctagcctatagaatgttttaatggtccaaatttgtaaacgtttcgcatgcagtactatttagcaagtcttcgataaaattaagggttaatttgatctgtgtcattgcaaatgtgtttattcagataaatatattacaattcgtctattcgtagccatgcaagtcaaattttacaaaaatggaaccataacttcgccgccacgtttttcatcttcttccacatctgcacggcacgtgagacacacccgttagattcatctttttcctctgtccttccctattttctttttttccccatctctatggaaccatgccatcgtaaattttacgatttaaaaatagagtaaattgcatccacggtgcatcaacttggcaggtgggtgcaatttggtgcaatatcttgaaaaatgagcattctaatacacgaacttggcaggtaggtgcaatttagtataagaactttataagtgatcatataaatgcaacaacttgcatggtaggtacgattttgataaagtaaatttaagagttatgcgacaacttaattatttggagcatttttttatataaattcaatttttaagtatatttatatttttatcctaataactaataactgaaagtcaattaaactggatttagaaattattatttcggttaatatttgagaatgtgaagaaaaaaattcttaaaggtaattggatgtaaattgtattactatgtgcaatatagttcttaaagattaaatgtaatatccataagattactttgtaatggcatattgacatcgtgaaaaaaaaactcacatatcatatgcttagccaagttgatgcaccaaaataataaattgttaagttcttatactagaacgcacttacttgttaagttgttgcactcggacgttcaattctcaagttctttcactatatcgcacccacctgtctgttgtatcgtgtgtgcaatttactctttaaaaatatatcattactattcatctatttgttcggtttacagtttaaaccataaatatataaccatgaattttagcatatttttttaatatatgcattcatgcgtataggttgtgctatggtttactgacggattctttaattagtttttaagtcacattcatggtgatacttaaaagcaaaatcaatttagaaattaaaataaacctcacttccatcctcatataaataattcagagaaattaatttaccatctttggaaattgaataacatatcattttaaattaatataaacataatcatatccattcaaagacatttactgataaattcttatgagacattgtacaattttacatctcacaaatcaacccacaaaactcaaaatattgataaaaaatgagtcgtgaattgaagacttataaacaaatcttgtcagaggttgtaacttctaaaccaccatcccaactaaagcatagttgccactggatagagaaagactcttacgattctactcgcaaattagcaaagctccttgtaaatcatccactcctcactacccaattttggaagtccaaggctaagtcaatgacccattaattgtgacagaaccactcagcataaaatttatgcacttcactgcgcccaaccgaaattagccacccaattgccaacccagtactaacctaggggaggagggatatttccaacataaaaacttcctgactgtatcaaaattcaatgcaaactcactactccctccgtccctaaatataataacttttagctctcaagatttatcccaaaatataataacttctacatcaacattctcttcccaaacaatcacaacctccaccattcacttttcccacctaccttcactactcaaccaatcacaatcctccatcattcacttcaacctactttgttaataaccgtgcccaactctaaaaatacttatattctgggacgaagatagtacttgttactgtaattttattaaacatttgatcaaagaaaaagagaaaacataggctatatttaggcgttggcagtgacaggctggactaagcagcttcactataggctgccgaggaatgcagaacatatgtaacattggttaggctgtgtttagtttctgaaattggaaaaaaatttagggaaagttggtaatttgaaaaaaaaagttaggagtttatgtgagtagaaaagttttggatgtaatgtgatgtgatagaaagttgggagtttggggaagtttggtgtgaactaaacaggtcttagtttcctccgacaaattacaaggcaactacaagatgaatcccagaattaccttatcccaaatcttgccttgattttttcccttcctcttggtaagccccaaatcttgatttgaactttttctaggctctccctcaaaagatacggagctattcacgtctaactataaagtaaaagtagagtaaatgactcgtctcaggaagaatacagcaaagcaacgttcgaaaaaaaaaagcaatagcaattaaagctactatgttctgctcttggtaagatcatgcaaaatcgatgccaaagaacagcacagctcgagtaatttcagccacaattaaagctttattcagagtgaaagcatgatttagtatgttgggccattgggctgaagagggcttggttggcatgggagtaggcgaggtggctgaggtcaccaagctgcacggacaaggcctgctcggcgccaccaggaagcagctgagcgctgaccagctccgacgtcatccgactgccggccgccaacagctccgctgacacctccaaaatcttctcgaactagggtggtgcggatggggcaacccctttctcctcgctggtccaccctggatccaggcatccaaccaccaagcttgcggcggcaagctctggcacctccgagctaggcattgttagatccggtaggagcagttgtcgtctggaagcggcgacgtgcttaagctccaccgagatgtggagggaggcgtgccgaggtggcgcggatggagagaagcagcggcgggggcatggaaaaggaggagtcgacggccggggcaggaaggaggagaaggggagggggtgcgggcggcgtctccgccaccaagcgcgccgtcacgtgagaggcgaaggaggcggacgatgtgctggaagactggaatatgcgcgaaaggttatccagatcgacacttggcagatttttgggtgaggtctaaccaaaattttagggcgccacgtggcccaatcggaaggcagatcctagacccagaaatcggtattagagatttgctggtaacttgggtcggtagttgctacttgctagtgcagaagtctagagttgaggcgttcactttgctgccatttatcggtgaaactatgaatatgacaaatttgggttatcgggcatgactagaaatcatgtgggctctacccgcgcaggttcgaatcctgccgaccacgccctttttggcttttctgtacgaacatccccaagactcctatttgctttttttttttgtgttcattttttttatatttttcagtttcttcttttgcattttttgtgttcattttttgtgttagtattgatgcattttactatttataccacatgcacatcccccattttgctgcattccttttatatatagttttctttattatattttcagtgcattttgcttttctgtgtgtgtaagaataatttttttttctatttataccacatgcacatcccctaggcacatactgtgctgtgctggtcctggtcagctggtgcggtggtgcctggtgtactgtactctttgtccattgagctgggccgctggactggcttgatgggcttgatgggctggcttctccaggcctccagctggtttggctagtttttaggaataagttcactttgactccattaaaagtgatccgaatctaatccatacccctaaactataaaaccagatatcttgacccctaaactgttaaaaccggtgcaacttgactccctcggtagttttgaagagcggttttgctgacgtggcgtctatgtggcaatgttcaccttgtctgccgttgacgtggcgtttgggtggcattaaaaattaaaaacatacatgtgggacccattcgtcattcagaagaaaattttgtgggtcactgacatacgggacccactgatatctgggacccgcacgtcatcccttcttatcctccctctttctcttccttctctctctcccccacgcggccacgccggcgtcatgagtccctgtcgccggcgcctccacctcgccactgccggcacctccacctcgccactgctggcgtcgtcctccccgacttctccatcggggttcatctcctcgccggctccgcatccatcgcctcgagtcagcgtgggcggtgacgctggacgagctcctccgggacgaggccgctgccgccgccggggggtggaggtggacgccccgtgcgcgtcctcgtctacgacgcgttcctcctctgggcgcgcgctgtggcggtggcgttcacgttcttcacgcagtcgtgcgccgtcaacgtggtgtacggccacgcgtggtgcggccgtgtacacgtccccgtggaggccggcgccatcgcgctgatcggcttgccggcgctggagctggagggcttgccgtggttcattaaggtcggccccggcccgtacccggcgtacttcgacttggtgatgaagcagttcgacaggctggagctcgccgacgacgtgctcgtcaattcattctacgagttcgaacccgagctgagctagtaaccccatcaaagctacagtagcaactatctgctggtgataatgaaattgcagacttgcctgcagcttgcttgccggcgtcactgttggcttgcagctggcccgctgctgtctgccgcctcccgtgcacgcccgcgcagtgtcacgccatcgccatctactgtgcgtgtcacgacatcggctcggaacacaagtcaacccaaaagatcggaccgaccatgtacccacagagtgtgtggacccggtagtcagagaccgggccacggtaagagagagagaccttgagcacattgctataaaggtcggcaggattggagagagagggatatgaaaaacattgtacacaacaattcccaattgattcaaatctctcttcctgctatcttgttctgttctttcttcctcctcaagctgctctttcctccctccaattcctcaaatctccacgaactcgctgaagaattagtgtactcatgacaatttggtatcagagcatcgatcctggagaagccacgctatacatctcgccttcagctgcaggtcgaagcgatggagaagcagaatatcgactttggcaaggtcttaatggagattcaggagtcgcttgtctcgctgaatcgggcgcaaggcgagacgcaaccgccgtcaacaagctggaccaaggcgtgaccaactggagaccgcaagtagaagcggcagtgaaggagttgcgtgaggaggtgggtgatatccgccagcaaatggacctgctcggcaaatcgcagtccgcgccgccggcgacgtcttcccctcgagttccgttgacggacgaggaaaggaaggcgccgttgcttcctacgccaccagcttcgcgcgtggctgcggcgggggacagcggagacaagtgggccagtggccgccaacatccacatgaacaccggggaagggcaccaggtgtggttaccaccgtggtcccgacctcggtcaagggtacgttcagttcacctgctccatctttgggaattttggattgggaaaatgattttgattcgggagagcgtaggtttaaccatagagtccctaagttagatttcccaaaatttgatggttcagatccacatgattggagaatgaagtgtgagcattactttgatgtgaataacacttatccagggttgtgggttagagtctctatcatttacttttctgggagggctgcttcgtggctgagatcaactagagctcacttgcggttccctaattgggaggatttttgcgctgcagtatctgataagtttgatagagaccagcatgattcgctaattagacagatggatcaaattaaacagacgggttcggtttgggagtattatgaacgattcgatgaattgatgaatcaattgctagtttatgatcctggggtaaatatgtgttacttgacacatagatttattgatgggttgcgtcgggagattagaaatgctgttttacttcagagacccaagaatctcgagtctgctctggctgttgcttccttgcaggaggaagtgttggaatcatctgactccacaccggtgaaggagggcaagaagtttgagagttctgggcagcacaagactggtggaaattttaagggagcttttcctttaccattgcctcctggtcgtcatttgggggtaattcagagtgcaagagtggatgagaagaaggaaggggaaattaaaagattgtctgcatcttcagagaaagtgtcagctcttaaagcacagcgtcgggcacaaggattatgttacatatgtgctgagaaatggtctcccactcataagtgtgctaacactgtgcaattgcatgcagttcaggagctgttttctgttttgcatgaagcttgtgatgaggcagtttgcaatcctgagaattctgttttatcggacagtcaggtgttgatggcaatctctgtacatgcagttcaaggatctgaagctagtggatgcatgaggatgttgggtcagattcaaggcaaggacgtttttattttggtagattctggtagcactgcaagtttcattagtgctcgagtggcagaagggttatcggaactttctcagattgctactaatttgcaagtgaaggtggctgatggagctactttgcactgtcagtctgaaattccggcctgtgaatggagcactcaaggacagaaattttgcactactctcaagatattaccattgggaaattatgacatgatattaggaatggactggctaatgcagcacagcccaatgactgtgaattgggttactaaatctctcacaattgaaggcaggaatccagttgttactttgcagggaattttgtcaaacactgcacagtgcggacttattccttccaaatagttgaatgggttgaaacatagacaggcagtagcaaatcttgttcaactgtgttgtgttacagacctggaaccttcagaagaatttcctcttgcagtacaacaggtgctaaataaatttgcttcagtatttgaggaacctcagggtctgccacctgtgagatcgtttgatcacaccattcctttaatccctggagcaatgcctgtcaacgtgaggccttaccgttatactccatcccagaaagatgagattgagtctcaagtccaagaaatgctgtctaagggattgattcagcccagctcaagtccattctcttcacctgtgctgttggttaatttcttcctcctcaagctgctctttcctccctccaattcctcaaatatccacgaactcgctgaagaattagtatactcgtgacacgcagtcgagccattcgtcgccgcccgccagctgctcgctatcgtcacccagcgcagcttcggccctcaccgcccgccgccggccgaagggggaagaaccgatgagaaagggagagaaagaaagaaggaagagagggaggaggaagaagggatttatgtgggccccacatgtcagtgggcccacaatttcttttttgaatgacaaatgggccccgcatatatatttttaattctaatgccacttaagcgccatgtcaacgccacataggacgaagacctagtcaatactgccacgtagacgctatgtcagcgaaaccatcatccaaaaccgccgagggagtcaaattataccggttttaatagttgaggggtcaagatatccggtattatggtttagagtcatggattagattctggtcacttttaagggagtcaaagtgaacttattcctagtttttattagctgtatagctggccatctaaggtgaaattttttgcttggagattatcactgaattccatcccaactgagaaggtgcctaagcaacgaaatatgagtacaacttgtatatgtaaagtttgtggtgctgcagaggatacttgggatcatgcacttcttcattgtactatgtcaaaatgtgtgtgggctttgatggataatgatcttgcagaactaattgcaaccacgaatattaaagatcccaaggattggctcttttacatgcttgatgttttaaaacctggagacaggacgaagctacttgtatcatgttgggcaatttggcgagctagacggagagttttgcatgacgaattttatgaaagccctttaacaagaatgcattttattaaatcatatttagctgatatggatttgattaatattcctctatgcctacaggataagaagcacttgacttatcctaaagtaccagtatggatgccacctccagaagattgcgtaaagataaatgtggatgcagcaatatcacgatggggtaacaagggagctgttggggcagtgtgtcatactgtatctggtgaatttgtggcagccagtgctatggtctgggaagggctctctgactcggcaactttggaagcacttggatgcaatgaaggcttggcaatagctatgggctgtaatatgtcagaggtctgtatagcctcagactgccttgaggtcattaggagcatctcaaagaaaccaaggtgccaatatttagcagtcctaaatgatattgaggcaagaaggaagcattttgcaaaagtagagtttcgtcatgaaaatcaggcttgtaattttgatgctcacaacttagctaagtttgcttctactttacaggaggggtgttatctttggttttcaaatcctccttgtaatatgaataggaatgtaaatgtggacagtaataaataaattgtccgctctttctcaaaaaaaaaaaagctgtatagctgaataattttgcgatcagtgttcgagggtacaaatgaatcagctattataaaattgagaactaggtcaaacacagttttttagaaataatttatacatattattttcttataaaaactacactattagaaagctaggaaagcatatcacatttacatacaatctattaacttattaaagtaataaaaaaagagcctttacatttgctccaacggcctagatatccttatattaattggatagaaagaaaaaaaataaagtctatagaaatataatttaagaaaacaaaaaattcagaattaaaaaaataaggaatattgaaaaaggatactagagtccatgtatacaatttaaaactaattgaagttcgaaattaaatgttaataaaattaaagctatatccccgcaaaaaaataaaattaaagttataggttacatagttcatatagaaatacaatataaaagtaaataaaattattttttttaaaaaaatattgggaaatagtttatagtccatatagaatataatttagaaataaatcaaattaaaaattaaaaaataaatattgagaagagtctaaggtccatataaaatacagtttataaatataaattaaaaaataaaaataagaaatattgaaagagaaatatatagtccatataaaaataagataaataaggaatattgaaagaaggggctaaagtccaaataggaatataatttaaaataactaaagtttggaatttaaaaataagaaatatgaaaagaagggtttagagtccatatgggaataaaattataaaaaaatgaaaattcgaaattaaataataaaaaatattggaatggtattctagagtccatatagaacaaaatttaaaattataaaataataaaccactaccacatatatatcacgttagtttggtaagttagtacataatttaaaattatgttatcattttaatatattctaatagtaaaaatgtgaaaatctatatataatttcgtgagaaaaatataacaatctaccgggtgtactgttttaccaatcggagaagaacccacgacgaagccgccgccaccgccgcgcatcgtcttgtccatttcgcaggacagaaaaacaggagttcgcaggtggcacgctgcgttcaccccgcgatcctagtgatctgattcaggcgactagtaactggcaccacatgatcatggttgtcactcgcggctgtcagacagcggagcagatcagcagagcaccatatgcgccatgcgacaagctagcccatactgaactagtgctaattaaattcctaacgggttatcaatagagcggttagctagcataagccttgattatagtggtaaagtgggggagtgaagtgcgctgctgttgacacttgacaggtagctcggccttcttttctctctctctctctctctctctctctctctctgggattctttccgtttgtcttgttgtatctatcttctgtctccgacatgaggtggagagctcgtatttggtggggggccttgggcaaggaagtggacggccgacgtgtcacgatgagccgcaataattgtgctcacaacgtgacaattagcagccagtgttaaagcagtgaacatcacccccacacacagctattagtattggtgtcgcagttgcaggatcctattggttacccatggtttattataaaccgcagcggtttattaataattaaaaaatagtttatagataaaacttttgcatatatattttttaactattcaaaagtaaatgttgaaaaacattaaatttaaatttaaaatttaatttttgacagcggtttataagtcatgggggttgtgtagatgtgaattgtgatcagggtttacaaaatcgtgtggttaaacttcttatttttaaaatcacgatatatctcgtgataaccgcacggtattcacggtaaccacgcggttaccgctagaccgtgggatcacggtaaacccaccccaaaacgctttggggaaacttgcggcctgttatttacacttaaatcatgccacaaatatataaagaaatattagtagtactaattaattaccatcctaatttagaccatctttatattggccatttccgggaacccgggggagaatatcacaggacccaggtgtacacagctccgaccagcttccttcaccaataccgttgtcccacctggctaactggctaactttccttgtcgcgtacgcagtccatgtccaggggccccacctgcagcctcacatcacaaagccatcaaaacccccaccaccccgactccgaaggcgaaggccagccaaaggaaaggagaaagcgcggccatggcggaagacgcgccgccgtcgtcgcttccgctgctgctgccgcggaagtcgttgtcctcgtcctccgcgcagcgcaagcagcagtacgcgcggtgcgtgtcgcacgctggggacgagctccacagcttccgctcctgcctcgcgtggatgtgcgtcgaccactccacccgcgcccgcggcgccgcgtcgtgggcggccttcctcctcctcgccgtcgccgccccgtccgcggccaccctcgcgctcccctccccggtcggcggcggggggtcgccgttcgacgggcaggtccaggtgtcgctcaccctggccgccgcgctcgcctacctcaccctcacggcgctcctccagggccgcggcctccgccgcctgctctacctcgaccgcctccgcgacgactccgaggaggtccggtccggctacatcgaggagctcgcgggctccttccgcgtcctcgcctgcttcctcctcccctgcacgctcgccgaggccgcctacaaggcgtactggtacctcgccgcgccgccgttccgctccccgtggtggtccgccgccgcgtgcgccgtcgaggtcgcctcctgggcctaccgcaccgccgtcttcttcatggtctgcgtcctcttccggaccatctgctacctgcagatcctccggatgaagggcttcgcgcgcgagttctgcaggttcgccgacgtcgccgccgtgctcgagagccaccgccgcatcaggaagcagctccacaggatcagccaccgctaccgccgcttcatactctgctgcctcgtcctcgtcaccaccagccagttcgccgccctgcttgccaccaccaggccgcacgcgcagatcaacctcgccaccgccggcgagctcgcggtaaatcttccttttctgctcctccttttttttttacttccattccgatttatgttaaaaggtaagcagtaattgcttccttcaccgagaaatcaaggtgatgcgattaccgatttggtatgaagatatcagtagcatcatgaacgatctgaatcagaaatatgcattgttcaaagatgcgattcactgcataattagtagtagcatttagcagtaagtaatcactacaaatttatctcttcaagataggaaaatgattcggtggaaatggaaaccgcaattggatacatgtaaaattgggacaggaatgatgagaaggggctgaatcgaagcagtttttagtaactgttaattctgctctatccctgtttctttctacaagctcagaaatatgaattccgctgttggggatagtgaaaatgccagatcaggttgagcaaggtcaagtggctactggctagccacactgtaagtaaagttagtcctagaagaagcttgcacgccctgaaaaggaagcacaaatgttcagataactctagaagtagaacagaacagtgcatgaacctccaccacccaccacatgtccacagcagacaactagatccacattcccatcaccactccatcagtagttgtctgtgtctcaaaagggctatacagctagctagatttgtattgcaaaatgttaaaagagacaaattccctggtagatgcttgaggaaatgcatattcctgaagttgaatatagaatgttatccttcaaaagtaagatcaggaagaacaattaggttgcaaaatggaatgttggaatttctgataaaactgaagtatattttatagtggtcattcagtgggcctttttttttataatggataaaacttggtctttgtttcagccatctgttccttgagaatcattttccatattaaacataactcaatgtgtttgctctgatagttaacccaggaacccagcagtaaatccctgcgttcatcgtgaactctgatttttaccgtgagacttggaagtttttgccgggggacttggaaattttcattctgtcagccactggcttcagtggcctcggtctgagactcgagtacctgacatctgtttgtcgcttcacatgttgtgcagctctgctcgctgagcctcgtggccgggctgctggtgtgcctccagagcgcggcgaagatcacgcacaagacgcaggcgatcacgagcgtggcggcggggtggcacgccgacgccaccatcaacgccttcgacaacgaccaggaggaccccaacccggacctcccccgcatcgtcggctacctggtgcccgtgaacgcctactggatggcctccggcgagtcctcgtcggactcctcctcctcctcctcctccagcgacgacgacgactccggccaccccaagtccaagtacatccctttccagaacaaccactgcttccagcagaggcaggcacttggtaagcgctcacaacaaaacaaaacaaacaaacaaaagaacaaacaaacatatgtgaaagctgcatttcatttcatcagttcgtcctgacctgatcgatgtggtggtggtggtgttttttttgtcagtgacgtacctggagaacaaccgggccggcatcacggtgtacggcttcgtcgtcgaccggacgtggctgcacgcgctgttcatgatcgagttctccctcgtcatgtggctgctggggaagacggtcggcatatcctgaggcctgaaggagcttttgcctcctgttgaagctttcagctctctctctgctctgcagccgtgccgagatttctgatgatcaaagatctctgcatcgtctcatattgcttcctggattgtacaatacaaaatcgagtgcagaaattgcagataatagttcagtttctgtgccatgtccggcacaaaaacgaagcaacagttctgaagtttttagctgtatgtttttctttaaaaatttttatggttctttgtttgaggcagattctgatggagcattagttgtatgaaaaataatgggatgggatagttgtccagcttgatttgatgagattatgagagaacagtgatcgttgtatactgtataggttgatttcatgaaacgattacagtgatgttcaggttgacttttttttttccagatttgttcaggttgatgttgtattcttgttgcgtaggaatctctaacgatgaatcatggttcttacaaagctcaatgacatcccttcctagtgattagatcatttctcatataagggcttgtttagttccaaactttttctttaaacttccaactttttcatcacatcaaaactttcctacacacataaactttcaactttccatcaaatcattccaattttaacaaaattttcaattttagcgtgaactaaacacaccctaaatgtttcgcaaaattcaaaattgccctgtttagtgcacaccaaacttctcccaaacttccaactttccatcacatccaaaacttttctacacacataaactcctaactttttttccaaactactccctccgtcctaaaataagtgcagttttgcattgttcatgttcaacttttgaccattcgtcttatttgaattttttttatgattagtatttttattgttattagatgataaaacatgaatagtactttatgtatgactaatttttttcaaatttttcataaatttttcaaataagacgaacggtcaacgtcggacacggttccccacgactgcacttattttgggacggaagtagtaccaactttccccaaacttcttctcaatagcaacaaactgatatgactgctgtagcgttcctgtcaaatcaacagtaacaggttgcagcatggtaacaacaaacaaaagatatgctcatggatgataataatagctaataagtcgctaggatcaaacgtgcgatccactagaacatggatacaaaacggcagcacatgacaagcaaatatgcccaataagttttcatgatgttcatgttttggaacagcaatcgctgccaaacaaaaaaacccatttgcgtcgatccaatggaaggaaaagaaaagggcattcacaaaatccatgcaaggcagcaccggaaaaaagcagcactgtttttgccctatataggcatgagcagtgccctaacagagatctccgtccaacctgtatcctcggttgctgcctgtctcagcaaagaaaaaggtactggaagaacatgatgatcctctgaaaaccaggcatcaaatgccgcggtatgttattttgcctcccttgcggatggatagaatgaacagaacccgtggtagctccctttcttagatgccatgtgttgaccttacatgagtcaccacaggatggtaccgccgcgaagtcctccctatggcccgaataccactgacacgtccccttcgagtgttagctgaatcatgctggatatcagaggcagcgaccgagctagctgtgacattacgcctaggcctctccctgtaccttctgtaagctctggtgtatgaatcaccactggcaattctcctgccatggccaaataaggatgccaagaagtcaatgctgtcatccaaactactatctgatgactcatagaagtcaagcctctcattcagagtgcgatctaaggatgtgaagaagttgagcctctcctccaagtcatctccatcagaaagtaaattgttgttgctgccaccattaaactcaaccacataatctcccataatgacagcccctggggtcatgcttctgatagtgctaatggcatcctgccgctctctttcacattcaaactttttccactcatctgcatgtgcaggatcaacttcacgaggttttgctgaaggatgcttggaattcacatgcttgcaaagttctttgtatgaaccaatgaatgagcagccatcatgcatacaggctcttttcttgcgattgagatactggcgagctggttcgaccacagtccatcctttgacatccccacgacaaagagggcatgcaagttccattgcacattgttgcttgctggctggctgagaattcaaagataatgaaaggccaggtgaagactcaattaatacactgtgggccaacttctcctttgcgtaagcttctttgaagtgttcgaggcagttagaatgctggtggttggtaccacacatatatggccggcaacccttgtggtgagaagtacagaggaggaggacagcatcatgtggatgctccaggcaaactgggcaagaagctcctttccattcttttttctcagagaccaatgctatatcattttgctcgcatgttcctttcatcttccagcagcaggaaggtaaatcactagaagatgaagatgatccacgtcgacgagctgggaggttccggccccttggagatctacccatctcttcaaaataatataagtagggaactgcaggatggaaggacaattatatgtcaatgctacatattaaaattgcgactcttgcacactattcaggtgctactgaagaatgcatggacataaaattaccacctgcacttaagtttaggacccatttatgttaatgacttaatgctacaaattaaagttgtgactctagcactctattctagtgatactaaagcatgcatggatataaaatcactgcctgcacttaagtttaggacccatttcgaaagtatgattctctcaaagatatcatacgagacaccatatccagttagtaggaatttctgttctatgtaatcccaatgctacaaacagggccttagatattcaattgccaccagaataaatggtaggaaatttacatattttgttagcaatagatatgatattctttgtacagactgctagggcaacttacttttgctgcacagatcctatatacaaaaagctggagattcttatggagggtaacaaataaaggatggtttcggcaaattcccctcccatgcatctgattaacttgacaaacatggtggaaaactgagactgagagacaaggagcatccagcatgaaggcaagctacccagtatgcattcaccactacaaccacacttatcttccatagtccgcattcaccactgcagtaaagccatacttatcttccatggaacatattagacagcctgaacatcacttggggacatgcacaaaatgggggaaatgcaataaagagaacatgaaagaagtttaggtaaatttatttaattcaatctgaagctatgggagttttctttagtgtaaattttgtatcatacctaaatgtctttaggatattaaaaaataattatttccactagatatgtcccaaaaagcgtattgggaccttcatagtttaaactcaactggcctttcacatgaagcttgctaggcatacaacggaaagtagtagagtatgatacaatcaatattgaacacacaaaacacactaaaaaaaaatcaaaaccaatcatcaaagctatgcatatggaaaataggtaaaccttcaaagctctgtaatatatctgaaatgaagcatcaaaatgaagaagaaaagagtacgatatttttcacatacatcagaaacagatttagcacataatgtaacacaaacaattgtacaggcacattcccagtggcggatctaacatgggacatgggggttcggttgaaaccccccaaacctttttgggaaccatcaaactgctactagtattaaggttaaggcaaatttcaagaacggaagctagggttaacgcaaattcgagaaagagtgcgtgggtcgagagagagagagagagagagagatgggaaagaggatctgcgtaccggatgcggcggaagcagcagggcgagcgacggcgaccctcctcgctcgctcgctcgccggatggatggatggggatcggcggaggcggaggcggaggcggcagcggtggggaagggcaaactgacgaggtggaaactcacaggattacagtactcactcactaatggtgagggtaagttagtaatttcgcctagtacttaatccccccggattgtttgcacataccatccccacgaccccaccctacccaaacgtggaaatctgaaaatttgaaataactagaaaatgagctgaccaattataactcaatatttgttatttacggtgtgtttgattcacggtcatgcatggatgggatacggccattcatattttattgaactagaataaatacccgtgtgttgcaacgggtgaagtctattttaattttgttgttgtcatatagttttagttaagatgaaattcgctgtgggagttcgcttggatatatattttattagaaaatcatgagctgcagttagtagtccgatcgtctcaagttagcatgcgagtttttttaaacatatttcttatatgattccttttgtattactaaaaagtgaatgatcttaaaaaagactcagatacggatatgtattttcaaaagtaaataaacttaaaaaccgactaatacacggatgacgtatcaaaataccgacaaaaacatcttcagtttttataatagtagagatatggcgatctaaatttttgtttggtttgtatatatatgatgaccaaatttcttgtttggttggagggatatagtatggatgggaaaagccaaaagtttgtcatatatatttttttatcaaaatataatcatccgatatcttatttaaagatttaattatagtaacaaatataattgtgtaatcaaatcataaattagataaatggtttaggagaaaaaatttttggagctttcttaacaaaaaaaatcaaaccaaccgcgaccaatcagaataggacaaaaacttgatggcttcatccaaccaaatcggtcggatgcactcatccagcacattgagggaatattccttattccgggcagccccgtccaccctacccttcaaccaaaaaaaaaaaggcggccatctcctatccaggctacatagtttctcatcatgtgttggttagcttatcggttgtagccaaaataattaattttttagtggctttagttttcttttcatcatagattattttccatcattttcttttaaacccgctactaacattgatatattatcataaattatttttattgcttagtttatttttatatgcttaccaataatagctcaaacgattaataatatatcctgattagtgggtttattgtgctatatagtcttgttaactttaataaatagctcaagatggtgttagggaaaaggttgagggatgtttttgataaaccttgagttccactttacactcacggctgttgttggcccgatctttcgatgagttgataataactacgatttaggagaaacgttgatgacccgactacaatcgtataagacgttgcattgcgccttatcgatcgatacacctctccgtgggttgttgatcttgccgatacagatcaaccttattccagcaataaaagcaatctgaattacaaataggaattgatgcagatcaaccttattccagcaataaaaagaaagcataatataatctagaatatatatccattttcttcttgtttttattagattaatttcaagtaacgttgtcggagacaaagtttatttcaatatgcagaatgaggataaaccgatctcatgaggatatacgcatttgtgttgcttacctaattggttaaaaggaaaatatttcttcactaaatcaacacttgttaaagagagttaataaattaatctcagctggtagaaacaaaggggtggtaaatatttttgcaacagcaccaggtggttttagcaacgacgacagatctcctcccgctccgtgccagtcccggcggtagcggtggcggccaaggcggaggcgaggaggcacgttgggcggcaggcggtggcgaagaagatggagagttcgtccgggtttgacttgctactgtgcattcggtttgttttactgctgatgtgtgacctacgtgtgggctactgtactgcagaggtgcaagggaaaaacagtcaggtcactatggaaatggatcctctgactttggctacaaagtcacggccgtgcagttgggtgatatcagccgttgagccaatctgacggctcttatttacgtgcctttgctgattgccgaagcaggccaagccggctgtaacatcttcaaattttaaactataatttgattgcatcatgctggcttttgactagattagggtaatttaaaaatttatttgattcttaattggtttaagtgttacttcttagaactctactaatttaccctaactattccctttattttaaaccttagtgaatttgagcaaattctctcaaattccaaacttcaaattattcccttagtttatcctattaatagtgagaatttgctatacttcaaaccctagtgaaacccctccaaactcagagattaaattcattcttttctagggaaatatttaaaaaattctgaaaacactgttcattgcactcaaggtgctcgatgaaatgcctagcccagctagagcagcccaacctctacccaatcttgcacaaagtttagatatggtccttggggaccacaatctactcaaagccgtggttttctttgtctcttcctccccttcacgcatgctgcctagcgtccgacttagccacgcgccgagccgccgcgtgtcggcctcgggaccgcttgcgcgtgcccaaccgccttggcgcaccgccagccgcacgacgctctcagaccgccgccgccacaccaattttggcgacgacaaagccgggactacctccgccgcacgacgccgtgcacgcccgtccaaagccgccgccgagtccgattttgattctacccggggtgaatcgagccaagacttgccgcacggttgaattaaagatagactgtggtttcccctctcacaattcaaaccaatcaccgccgagccggccattttaaccctcgtcgccgccgcgcgtcgcgcctagattggcgccaacacgtcgccagtcgtttctacccgtggtcaagccaatccttcgtcggtaagtattcgaacgtggcctcccgccactcaaattgatcttgcccgccctctcacagcctctgccacctttgccccatccaattcccgagctcatccatggcgatgatggcgtctgagctcatcctttccccctggccctataaataggaccccaatcccttccttgtccatcatcgatcatcaacaaccatagccccacaaccccgaagctttgcttcaccaatccatatcatcaaccattctcgctcgtcggtcgaacaccttgtgcgcgatcgactccacgccctttcaaccatcctccaccctaaataacccttagaacatcttatatcagctatgttctatcatactaagtcctaaccgaagccctgcatcgagctctacctcgccgcaccgagcggagcaccgtcgcccctgctctgctctgtttttcgccgccgagaagtttttccggccgcaatccttcatctcagcttatctcggtgagttctttcgtttaaaccatctatatactccctagattccattttagcaattagtttgcactaccatgccaccctctgggctgccgacgtgagcacgatcgccgccaatggaggcgctcgtcggcaagtattttttgcaccttgccgaaggtcggcaagctacctaaatccctctaggaacttcgtagatgctctaggagccctccccgagccttgtctaactctcactaccccgaacaccttcacagcttaaccatgtcaccgccaccctagccgccagcccaaccacataccaaattaacccctccgctgccgctcaccatcgctggagaaccctagctccctcccctcctcggccgcaaccccttctctcctctatcgccgctgcaatcccaaaccctagcgccgccggccgcatttggggatcggctggaggttgaagaagagaagagagagagagagagagagagagagagactgacaagtgggacccacacacagtgccatttcacatttaattgattttcaaactttagaagccaatatcttttaaaatatagatccaattccagtgaaacttggacaaaaattcttctaaaatcattctctatcttttgagaccccttttgctatttttctattttattctattttctctatttttcttatttttggattttatttgaattccttttgaatttgaattttatatgtctaaccctaggtcttgaggattcttctgacatactagataatatcagtcaatctcaggacattgagcaaggccagttactatacaccttttgatcatttaagcctatattttataaattatttatttatagccttctattcaatactctattttatatacacaatttaaccatagaaacccagataatttagtattgcttattttgcttacaatctggctaaaatatcttatccttagattgggacagtacgttagaattggatgatttccgggtggatagtattgtctcgatcgatatagttattaccaggtacttatgtcgaacaaacgggtacgaccgcagtttctagaatgcggacagacctatttattatgttaattagcaatgtggtacctctgtatagtggttcttatttttaagtcctcgcacaggaggcaactatagccgcgaagagcaaatttaaccattaccatgtataggtaaatggtttgtgatactcaagtataaattatatggtatatttctaaaccctgatcgagatgacgtggtgtcatacgatcagttccctttgaatacctcaggaacgccagaactcctcttgctgctgttaacattacgttcagagcatatgaggatataagttcatggaacagttgccacaattgttaataacctaatactgggccatgactaaagctgatgattatcatcaagtcgtggactgctggtaaatcgtacatctgctgcagtagaatatctttgaaactattcgaatagccgtactcatggaattgagtaccgggactcatatggtaccctggttagaaatttaaagtctacgtatttataaattcttgctataattcttccaaattgtttattactgctttttgcaaagaaccctactatatgctaatgcataacatatttccatgataacttgctgagtattgtgaatactcatccttgctcttataacccctttttcagatttgggtcaagaggaggacccctatgactattactacgatgaccccgataacttagagaatccctagaggttatacctccctagtcagaatgtataaaaacttccgctgtgtattagttctacatatgattaattaggtgagtacctattattgtaaaacccttagtattgtaaaactttaacgtatgcaatgaagaaccagctatattgtatgtatcaatatttactgatctagagattgatacattaattttagtcagatccaagtaattagttctgggacccgacaccggcccatcaactccacgatggtctttcgctgtacgttgttgcctgcaaaataaggggtactagcagatgagtgaacttcaatctaaggacaaaactgaatacataactaaaataaaggcgatgcattgtaacacaagctccataactaaataactagttttcaaaaaataaaaaaaccaaaataactctgtaatattaaggtatcacaaataataagcatgtagtagtcatattttactgctcgatccataatgctctctactagtcttttcttccttacttcaccacacagaaattggtccatggtaaaaattggattttcagttgactgcttcttttacaacgtagaagggaagaaccaagacaggaaaaataagatttggagtgttatattcggtgataccttttattagaaaaaaaaactctggcgacaaaataagaattggcgtggttctacagagctgatgggccggccaagcttgcttcagcgatcagcacaagaagcatataagagccgctggattggttcaatggtggatacaacgcggactgcacggccgtgactttgtggtcgaagtcagaggatccgcttccggtcactattatatagaatgacatgcctaaattctgtatttggtttcttaccataaaaggtggacacacacgatctcatacaatgcatcaaacttatatgttatcgtgaacgtcgagttacacttaacatgtaccagtatgcatatctaaccaattatgatctaccgatccgaagagcctaaccaaaataggtcagcatgagcaacatcaagacaatgaacgtgtgctatgtgaatcttctttatatttgttactaaaaaataatagcatcttactttggaggacaaaaatttattagaaaaaaatccaaataaccccatagactttatttgaaagtccatctagcattctaaagtttgaaaccttacatttagcatcctaaattttataataccggtcatatcggtccctaagg

SEQ ID NO: 82016 - DNA, 1573 bp, Oryza sativa
tatgacaataggtaaacaccccatagtaacattataagacaatgcaatatttgaaggaaaacaatagagcatttgcaatataggatcaacatgttcaagtgacaagcatgacttgccttgctctgctgctggagaacctcggcaactatttcgaagtacaccggagcgtcggaagaaccaaaatctagcgacatacaaggcaaacattgcaaacaggctataagactactgaaacagggaacaaaaccatttttaatggactctacacatttttcttgatttactgagacttgaatgggcttaaacggagttcggatgaattagatatgaattttagaagattcactgtgtttattactataacaaaaagtccttaaatcatttattgcgtaataaatcccagggctagcgtcagcacggggggaggaggcgcggcgccgacatgcggggcccaccggtcagcggctcgggagagggaggaaaggggcgccggcgagcgggcccactcggcagcgactcaagggggggacggttcaccgtggaccgggaccacgcgggtggtccaccgccggtccacgggaccgacggcccagatcgcccccggggttgatcggacgggcggcggcgacccggctcggcttggctcaaggctggcccgccagccaaggcgatggcgacggtgtgcgcgtgcgaacgcgttgccggcgacggcaactggcggcggaggcgacggcgcaaaggcgacgcgaaggcggtggctctaagcgggggctaggaaggagagggaggggaatagatgggggaggaagcctcaccgaaggtgctcggcgcgtacgaagactacggctaactgcgacggcaagccacgggatgacgacggcatccgacggacgggcttcggtgtgccctagggaacggtgagagagagagattatagagagggagatgaacctctgcgaccggcattcatggcggtagaggttgaactcaccggagcgcgagggaatgcgaattccggcgacgaaactcgacggggaaggggcggccggggtggagcttagcctcgcgaacccgacggcagcgacggcgcggtgcggcggcgagcctagcggcggccggagtgacgggaaaggcggcggcgggtggatgcacggtgcgggagtgatggagagctcgggagagttcggcgaaatgggggaaaaagggagagagggggccggacgtggccgggagaggcgggaatcgccggccaacgtggagaagtgggggaggagagagaggcgggattcgaaaatcgaatcccggccatctcgggcgcgggcgcgggcgggagagagaggggagtgggcgcgagggatgcggcgcacgcgcgggcgtggccgacgtggcccggaggaggcggaggcatgggcgtggcgggggttgcgggcgcggcggcgcggcgcgaggtgggagacgggtccgacaggtgggccccacctgtcggtgacctcgggagagaggagggggcacgggctgagctggggcgtggcctccggccggcccagcaaggcgcgaggagagaggaggggaa

SEQ ID NO: 82017 - DNA, 587 bp, Oryza sativa
tccctcccacccatcgactggtgtgcaccgccaaccctttcccgccggcagccgcgcgccgctccccctcgccagaccccgcgcgccgccgctcctctctcgccctaccattggccgccgacccaagcgcaccgccgttcctctccctccctcccgtcggccgacgcgcgtcgccgctcctctcgcgttggaggtgcgcccggcatccttggcgaggttgccgccgccgctccgccgcaaggacgagggagagccgagaggaagaaaaggaagagccaagaatggagagggataggggaggggagctggcgatctcaccttgggggacggcgggtgtcacaccccgaagttctcctcccaagcctaaaatttaatttataaatgaccctaagaaaatgccggtgcaaatcaagagaaaaccctaaggaagtaatacaaataataatcgaatttgacatgtggaatttttcttgagttctacatgtcgaaattcactaacaggatttttagtggaattttcagagccctagaaataattttgaccaattaaaattgagcacaagcaatatttaaatccctggaaattc

SEQ ID NO: 82018 - DNA, 11296 bp, Oryza sativa
cctcacataaaaagagctgatttattttcacctttcaagcaacaaaatctctcacacataaagtagtttacctttagctacatcactgtgttgatactggtaccttttgtgatctaggagtaagtaatataatcatataggctttgactgttcgagctacggttgataagccgtagaaaatgaaaaaaacaataaaaaataatttataaataaaatttttaaatttgtgtcactagcagtttaaaatataatgttacaaaatattaaatttttttaaaatttaaactcttgtgtatgatatgttaataaacagactttttaaagcctaggcttaagtgatgttcaatccaggtaaacagaagggttataaatttggttatttttgtaaaaatgctttgacagttgacaccactaatccattccaaatttccaatacaatgaacactgatgactgaggaggaaccagccaggaaaggagatggtgcagaagaacccacaccaccatgctcacagatgcacagacacagggctcctccccagttttaatgctaggacactctccccatccttggaatctgttgcattcaatacagctctcaaaaaactaaaagaaaaaagaaaacaagatttaatgttgtcctagctagatccatccaaggctccaaaaacactgtttggctcctcccagtagctgaagtgaactgaactcctctcattttcaagagtgcattagtactcactcccccccctcacatgtgttgtgttttgcttgcttgtgtgattagtggagtaatcaagaagaaatagtggggaaagataagtgtgtgtgggtgtggcaataaaggtgaagtcttcaagtttgcaatcttctccctttgctccccacaagattacaaatcttgtgtttgtcttgttgccactgccgctggtgatagactctaccatactagagaaagccatagaaaggagataagaagaaaccaagaaaagggagaaacaaaagttgaagaagactttctgctgatatttttgcacatatatataattttttctcctccatctgcactctctggaaagaagaagaagaagaagcagaagaagcttggagcttgagctttctgaatttgtaagtttattttgctctaattttgggctaccaattgggtttatatttctctagtggtggtgactggtgagtaattttccccttattttattgtgttgatgtgaggccttggggttttctatctctttgcatcgttttcgctttcatttgtttagagatttgttctttgaacaaagcatgcagaaatctctgaggactgaagtgtttctctctgcttgtcactttctccccaattgtggaataactaagaggaatcgacatggggtctagtcttccattccacaagatttgcatcttccccatgaatcttccaagaaaatctgtatctcttacttcctttctttttctctaggtcttgtcttgcaaactaggataaagatacaagttagtagtacaagaaacagtaaaggtgaaagtcttgtgttcttttccctgcgatttcttctgaaaaaggtcgccattaagaaaaagctttgcaatctttggagtgttcttctcacccagtggtttctctgcttgttctcttctgattaataacagtagtagctgctcattaaattgcatctttttttaatttatttaatttctgttgatgtgaaacgcatccaatctcttgcaatcaatgtgaggctttcattggcgtatgagcataaaaaggggggaaagaaaggtgggagtctttaggtttctactcctaaaaattgtttctttcttatgtgcagcagtcggtgtaactaatgggggagatgaaccagccgccgccgccgccggtggccgtgccgccgccgatggtgatgcagccaatcatgcatccgcccgtcggcaccggcgccgtcttcccgccgcacgagcagttccaccatctcgcctactgcgtccactccaacccttcctggggtaaggaaaccccaaccccttcattcctcctcttttttatctttccttgtgtgtttttgtgttggttggtgaatggattggatatgatgaatattccctttcatccctaaaaatttgggagatttgatttttaggagtatctgctggttggggtttttttgactcaagatattttttgcctttggagtgggggagcttctgtgttgtgttgtttttgtatgattcttgaattggggggtgtccagagatatttgatgtgtgttttgatttgaagatttttttttagcataactcctgtttcactcccctgctaatatttgaagagattatggtgtctactggtgcacactattgatgttttccagagagttgtagctactattattttttatagactagtaaaaggaattggtggtggtgatgatttgctttacaccccactacttcatcagatctttagtgaatggatctatgtagacatagctattgtttgtactactacatgcttatgtatgtagatgttgaattctttgtagtacatacgtatatgcagttgctggttgacctagtgtgaatattttaattgtgaaggtaagtataactgtatttgtgtaaccatggaacttttgacatgttcatttgagatcccctgcaatatagaggcaaacacactagttctgtcaaaagaatcttagaagagtagtaggatgttcaggcaaaaacgctatgaagtgctatcttgatttttttaaattatcaaatgtacttctggaaattaaattactcatgtcgattgcagaaatgattaagacatataaagcttgtgctcactaaattactattgttgatattacgttcagttcaggtggccgcacttgcattcctccactatcttgtgatgctgggttctactgtcatgcttgcatcaactattgttcctgcaatgggtggtaccccagtaagtacattgtttattttgttataaagagtttattacgtaccattatagttctcttctaaagaattggtactgaccttttcccgcttgttgctaatagggggataaggctcgtgttattcaatccttcctatttatgagtggcatcaatactctcctccaaacacttgttggaacgcggctccctacagttatgaatgcttcctttgcatttgtcgtcccagtactgtcaatagccaaagactttgaacaaaataactatgcgagcagtcaccaggtagagtaccgttcatatttgttcaatcatagaaaattgtctggatcatgatcaatttatttgcattgattgatcaaattattattgattacttataacctattagggattttgcagagatttactcacacaatgagagcaactcaaggggctctgattgttgcttctatcctcaacatgattcttgggttcagcacaatttggggggcattcgccaggtacatatcttataatatttgttcttagactacaatagtcattttgtgctagattttttcaaggtattgacatttgaattgatttctttccaggaaatttagtcctgtaataatgacccctgttgtttgcgttgttggtcttgggctatttgcacttggctttccccaggtacgatctctatattatttttacaggaaaatctagcagttcgcaaataaaggaagcatgttctctttggtttcccatggtaggttggaaagtgtgtggagatcgggctaccaatgctaatccttgcagttgttgtgcaacaggtaatgaattaatctccttatagggcggtttcttttaataacactctaaccggtgatatactacgaaacttactatttactatgctgtgtatgcagtatgtgccatattacttccatcattaccatgagcgaatcaccttcttgtttgagaggtattcgttgcttctttgtattgggattgtgtgggcctttgcagctatccttactgctgctggtgcatacaaccatgtttcactcaagacccagcagcactgccgcactgacaagtcctatctcatatcatcggcaccatggtatcgttctcaagtatattgattatgaactgattttaaaaggctgtaggttcttcagatagccatttctaatcgaccctttacatacatgctctactaggatcaaaatcccataccccttccaatggggtacaccaatcttcactgcaggtcattcatttggaatgatgggtgctgtacttgtttctgcttttgaggtaagaccaaggcccaaaaatgtaatcagatctcttttgttatgttttatcttttgttgtttctaatgtgtgttatctcatgtagtccactggtgcacactttgcaactgcacgtctagctggtgcgacaccacctccagctagtgtccttagtaggagtgttggtttgcaggtgagttttgttcaatataagattttatattcttacaccacatctcagtctacattaccgacaccaataaaatgtcttgtctgtatctaacttgcatttgaaaacaagtccccagctcattaatctctaacaagtaatagcgagacatcaaatatggttgtttgtacatactatgcatgactttcctttgctactaaaaatattgatttaatcggatggatctgtgggagagctgttagttcaagtccttgatttactaatgctattacctattatttattttgccatccttgcttttacttgtgaaattttcttgtgccatccttgacgactttacaattttactcgtgtgaaatgcagggcattggaatgttcctagaaggtatctttggcgctccagctggttcatctgtatcagtgtaaggggatctcaacttttatgccctttctatgagtttgttattcgagaagactagaacagttccatgcaaatagatgttaaatatatatgcttcaaacaataaatgctcaaaataagatgtagtgttggtgttaacagagtatctagtcctacattctagctatagttgtacatcgttctggttaggtaaagctttttgtggtattcagtttattactctggggtaggagctgattaggaaccatagtacacatgatgaaatgtaaagttcacatatttttatgggtaggccatggtatgaaattattctgttattatgtacagaacatgtaattattctgtacaactaaccataggcaacttgacggtccctgcttacacacttaaaaaagatacggagtacttgctttgcaaacccttttgtggttaggaatagtggaatactatactggtgggctttgatcacattgcatgagagtaagatttagtttctttatatttgtgttcatttgtgaactgaaaggacccttgcctttaatataatgcagtgaaaacattgggcttcttggactaacaaaagttggaagcaggagagtgatccagatatcaactggatttatgattttcttctccatatttggtaatcttttggtctcatcttcagttgccaaaggggaaagatagttttgtctgaaatttgtatacttctattcatgcagggaagtttggtgctttctttgcatctattccattgccaatcttcgcagcaattttctgtatcttatttggtattgttggtgagtccgaattttctttcttaagagtccttgcatcgatgaatatatatggccgcaacatgattgtgttcattttatgttctaatctgttttttttggcatatcagctgcggtgggagtctcgtacatgcaatttgtaaacaaaaattcgatgaggaacatatacatcattggactttcgctgttcctaggcatctcggttcctcaatacttccatgagtatgtgcttctgctagcactggacctgcccgaacaaatgctggatgggtatattccttgcccccctcgcatgctatttacacagcattatgttctgaccatctgtgatctgactgtggtgatacattctggaattatatttttggtctttgctcctgcactctttaaaaaagtttatacctcggtgtatattattttaattagacacctttgggctttaattgtcttaggtctgtgtcttgaactcttggtacatgagttctggtttctaaacaaatcttttttgtttcgtattgcagttcaatgacatcataaacacagtcttcgcctctggcccgacagtgtcactgattgtcgcatcgatcctggacaacacactggagtttagaggctacgaaaacgaccgggggcttccatggttcatgccgttcctgcaccgtcggaaaggttactcagatcctagaaacgacgagttctacagcttcccgatcagggtgcatgacgtcatcccaagccgattcctctgacgggcgagggtagcgcccgttacctgcgcttccgcgcatgtaaatctctttgttcttgttagcccttccttactcctgtgacatgtagcaattggcaccgccaagattaaaaagtctcaacttagtggggatatggtacaaatggttaggacttttggttttcttttctttttcctcccctttgggccaaccatttggttaattacatgatggtgtagagttggttaaatgattttgggatggatctttaaagaatatcagccacctcaatttgttgattgctcagccagtgatgtagatgtgcttccaggacatgcattgatttcgtcataactctgtaatcacaccatcttttcactgcatttgattgagaaaacttcagaatcagacctgatgcacattgaactcaaagagtctggtctttggatgaccgcatataatcaatcaggcagtaaattccagcatgatgccactgccatctccttcaccctataaaaagagcaggtgaagtatcagcagcttgtttttgttttccttgcctgaagttcagagagatgatcaataagagttcattcagctcagttgtagccttgtaggccttggaggcgtcaggaactgagagataactcggagttaagctgttgcctgatgacgcttcttattacgtgctgatatgatgctagaaaccagtttctaatctgtaatctctgatgacactgtcgcacattggcctgaatcctgatcgataccttgtatctgctaaactggagttgaatgcgataaattggtgcctaatctctaatcagttttctgtttgcttcgtacggcccatctaatagtgtactaaatcagctgtactgaaactctgaaagcaaacactcaattttcagatatgataatgtccttgaggaaagtagaaagacactcaatttttcaatttatagtattagatcaaattagagtgaacaaaatgaacacaaaaataaaatatttagagcagagttaaactactgtacttataagtacaaatttctaatggattgcctcattgtaacagattttctttcctctgctcctgctttgctccaatcttgcatttcgtttatagaacttatttattacctgctcaccccgtagcttctactctaaaagattcgattggttcgtcacaacgatgaaatggtggtgtagactgtagagttggtgaattaggctctgtttgttgctgcctgtttgcaactctcccatctcgatttccgtgcgcacgcttttcaaactactatttcggtatgtttttttttcaaaaaagtttccattttgaaaaaaaaattagctaatacttaattaatcacgcgctaatagatcgcttcgttttccgtgctggaggccacagttccgaacatgcagtctcgaacacagccttgttattatttggataatttctctattaatgatatggattttttataacaaaaatgatttaaatctccagcttctacttcaacaaataaaaaagaaacttcgggtgatgggacaaacctctaactctctcttattattaattagcattaaatcacatagattaatgcatcaattctaatggaccacgcaacccataatgaaataagaaaccatttgctatcgattcgaagggtacaatactattgtgcatagtattctgcttcttctgtggtagcatcacaaattaaaagtggagccaatataaagacatgaaaataaattgcagcatgttagacaattgtttaccattaaaatctgtcattgcggtaatgggtctgttcggttcagttggactgtggctgtatagccacagcgctgcaagcctcccggcataaattgtttgctgagtcctgtagatacagcggtgctgctatcacaaccagctattccgaatgcacccaatgctaaattaaccaacataaagaacaagcttcaattactatgttctttttcatggacctaagtacttctctagccaattatcaaaaatatttttggtataggtggagggatattaaaagcaaaaaacacatatatccaaacaactcgagtaatatgactctaaaagaaaagacgctagattgtctcttttgcataatagaaattaacaacaatatttatctcccctaaagctaggttatcctttgttaggactactttgttatgaagaaacgaagtttctaatagaacctttaaatcccatagtatcctctcgcagattccaatattggagttcatatagtctcaatatatatagatctaaccgaaaattagccattccagtacatccattgatccatcgtaactctatgactgcagtactgcacccttcttttacccttcatttgatgagaaatcatcagatcaaagcaattgcacattgaagcaagctgcaagtgaaatgaagtagcagcaacttgtttttgtagcttgatattttgagagatgaacaagaggataagctcatggagttggtaggcctgagaggcgtcaggaactctcatattagctgataggaatcaagttgttccccgtccactgtgcttcagactctctggcttctccacacatgtttggcatacatattgcaactcttggtttggtgctagcaacctgtttcctttttgaggaaaagctagccaaccagtttctgcatcttgcaggctcagggtttcagagttcagaccagcgaaatggcgagtggatatgaatatgatccctcaatgtcgagaatgcgaaatgcagcttctttcttcacagttgtcgactcatgaagctcgcaaaatcatggtgaactccccaaagatcagttcgtaatggctttgtgttatcatcttgtacaatctttgtctggatcagtatggttctgaatcaagacaggaaacacaagtagccctccagtcccttctccgatcttgtctactatttgttaaatgatgtgagaaagctatatatcatgttaattgttagtttgacgtcatcttcccaaccgtctccggcgagtttcatgaatgtgttgtgatcactcatcatgcatgagttcggtctcaatcttcagtcacccaaaacacaatactgaaatacgtacaagataatcaagattgagtaatttggtctcggtcaagaccgaaatacaataattttagagttggaaagaaatcacataaattattaaaaaaaatataataaaaaaatccacaataataataaaaaaaaatcatgtgtcactggtagtgggtgccctccagtcgacctcctccgcctgtcgccgcgccctcctctaggacaccaccaccactagatcttctgaggaggacgggttgctgacccctaggcaccagtgattcagagtggcgggacaatgacatggcggaatggtgtgatgaccaaaatgactgaataaaatacggttagttgaaccctaagaccgaagtgatctgatgatcgaatttgtcggtcttcattttccgatctcagtcacggtcttttcgattcagtctatttttgctatccctagctgtactgaacaaaacactcgattctcatatatatatgatcatgtcctgtttgctctacatttataaaagataagaccaatgagcacaggttgagaagatgaagaagactcgatggatgatcgacctcttgttcttgccatgatagctaggcttgggaggaaccgggagctgtctttttacacataaccatcttcctaccatattctccgcggttcatttgtcaagttagtagatctcattaaccactcttattctcaacggatcatattacattttatatgtaactggtcaccatgcatctactttccttggtaaggctatagattagatcaaagcaaaaaaagaacaaataaacaaaaaacgcttcgagcaaattcaaagtgctctattgcttaccaactggtttagtctatgtcactttaaatgatctcccataaattcttcttgctccgggttcggtctaaagattcgattgcttttttacacgatgttctagagttgtatgattgggtgaaatgattttgggatggacgttaaagaatatcagctactatatttctgattactctgtcagtaatgtgtgaatttacttccagttccagcacaagcattcattcatcccatcaaacatcataatcaaacccagctgcacattgaactcggatacaggtcctgaatgactgaatttttatttagacagtaaattaaattcctgtgtaaaataccatatgatctcctatgctccataaaagagcagacgaaatgaagaagcatcaacttgtttttctttcctgacattcatagagatgaagaagaggagctcatgtagttaggcctgggaggcgtcaggatatatcagataagctaattgtaagatgctgaaaccattcttcctctcaagcatcaaacaagtttcagactccaatggacttgtttggcatgcaaccccttgatcatttgatgctagctagcagccagttttcgcatcttgcagagttcttcagtgttgcaggagatgatttctcagtccggattatctcagtgttgagggtttgtgataacaaagaaacaattcagcatttgttcttcgagtgccccatgacaagattcacttggaatgtgatggcttgtgtctttaacataaaacctgtcaatgacttacatttcactttaggatcctggattaattcaagcatgtgacaaaacaacaaaacagctgctgctagttggaatagctgcagtgatttgggctgtgtggaaagttaggaataaatcctgttttgatcaaattctcccacatgatcctactgatattttatattatgctgcttgctccctaatga

SEQ ID NO: 82019 - DNA, 834 bp, Oryza sativa
cctggagagaggagaggagagagagattaacagaggggagagtcggagagaggaggaagaacaggaggaatgagttggactgacacgtcaggctcacgtgggtcccactatttttttttaatttttttacatgaaactgatatgtgggttccacgagatttattatttttttctatatcaaattgccacgtaagcgccaagtcaatgtcacatcagatgaatatcaagtcaaattagccacgtaggcgccacgtcagccaaaaccgctctaaaaaccgccgaggaacctaatctgcgagattgctattcggcgatcagtcgcgcgccttcctcctcgcgcgactggacacgtgtcgcgcgcggagagggggcggcgatgtgccggagggaggagcgagtttttcggtttttttctccctttttttcgtttatattcggttggttttttcatcggttttttcgtttctgtttggttttttcctccggtttttttgtttctgtttggtttgttattttttcggtttctcttctgttcagcttttttttcctttttttttcaagatgtataaataccaagtttgtattcgtacatacagaaagtttgtatacgcgtatacaaagtttgtatacacatatacaaagtttatttacgcgtatacaaactttctattcatgatgtatttttttattttttatgtgtatataaactttgtgtatgtgtgtatatattttttatgtattgaaatatcttcataaatatatatatatatacgcacgtatatatatagtatatacatatgatgtacatatgagagactagagggaggagggggg

SEQ ID NO: 82020 - DNA, 1375 bp, Oryza sativa
ggggcacttccccgtcgactacttcgtctacaccgccggcggcggcgccgccgcctcgccgccgtcgctcacgcggctgccaccttgcttcatcggcgggcttctccgacccggccgaggacgagtactacaagccgtaccgagtccagcggcagcggatcatgctgggcgagaacatcggcttcctctccggcgacgtcgccggcgagttcacggtggcggacatcagaaactacgacggtaattccctcgagctctgcatcttcaaccaccatgccaccttgccgtcgccgtcgccggagcagtcgccggagcaatggaggatccagcgtgtacccaagattggcgacgacgacgagctccccaaatgggtgaacgacctcgtcctccccctgcacggccactacctctgctgcgtcgacttctacaacggcatactgctcatcgacgccgataacctgcagcaattcagctacatcccgctgccggaggaggccatgaatggtagccgccgcgtcgacgacgacgaggacgaccccgacccagctcgccgcgtctccgtcaccggcgccggcctcgtcacgctcgtctgcgtagacaagatcgccacacgcggcaagatcacgagagatttcaccatcaaatcatgggtcctgaccaacatccaccaccaccacaacaacaagagcagacgacgatggcggcgcagtttcgccatgggatccgacgagttctggcgcatctgagccgagaaccaccgccgcctcccgcgacggggcgcggcggcggcgcctgcctttccggtggtgagcctcgccgatccgcatgccgtctccttcctcctcaaggacgatggcagggactggattgttgagatcgacatggtgaagagggccatgcgttcaccggtcgccctctacatccacgaggaagaggaaggagaaggagaaggagaaggagaagagagggaatgcggcggtggcagttgcatgctctggaaggccttctttggccattacttcatccccagctggttcccctcttatttgcatgaggatcccatccaaaggtttgattatgcatgtcttgtgtttatttgtgcctatatatgcttttgctctagccactgtttaggaactactccctccgtttctaaatatttgacatcattgacttttttaaatatgtttgattgttcgtcttattcaaaaacttttgtgaaatatgtaaaactatatgtatacataaaaagtatatttaacaatgaattaaataggaaaagaattaataattacttaattttttttgaattagacgaacggtcaaacctgtttagaaaagtcaacgacgtcaaatatttaggaacgaaggggac

SEQ ID NO: 82021 - DNA, 686 bp, Oryza sativa
  unsure (1)..(686): unsure at all n locations
ccccgtggnttgtagatcctctgatatacactnnnnnnnnnnnnnnnnnnnnnnnnnnnnnnnnntgcaagcgtacccttaatgttctaacagtaccagcaccctctaatgcgcttgtcatagcttacagcttataaacacgtacttagatggttccagcggcgacaaatgccgctgacagttaaagttgcagaggcaacaaatgcagacgagcagctaggtactatgtcacatgataagtgctccaacgcctacatctaagataaaaatatcagaatcatcagtccctccatctccctgatactcggccaccatctggagatccacagcaaaatctggaacaacggcaaaacaatgatcataacatttctaggtaaaactgtcacaggtgaggattttatgcctttggagtatcactaacatgtggttggaagcaatcctagtgttacttcacctccagataattttgcaaatccagctcataaatcagatcatcatatccatatctttgtgctaaaaactctttgattcctttcgatctaaatttcacacacgaccagaacaaaaatttcactggatgattgcacaccagtttgcattcccctgcactacgagattttttttttttttttgcagtgtgtatgcatttggcggccgtgggaagtagtctcggcccgggaggcacc

SEQ ID NO: 82022 - DNA, 20760 bp, Oryza sativa
cgcaacaggcagtcaggcaccataacctgaattcaagcataattatgaaaactgatgaaatatcgcaaactttccttgaaccgtaacacagcatatctatgtgacatgtttaatcaatcaagatctatagagcaaattatgagcgtgctatgggcatcaccgcgggagggtacgtgaagaggatggcgttcttctccttggtgtaggtaacgatctgcagcgccacgttgagcgccgcgtacagcgcgatgcaggcgaggaggacgtccctgttctcggggaacttgcgggggtagaactgcgcgaggagcgcgacggcgatcaccgccgcgccgaccgccagcctccggttgctcagccgcgcgtcctctgggtaccccttgctcttcgcgacctggcgcaaacccaccacccaccacagcatcatcagaaacaaccgagaaaaatctcaaatctggaggatctcagaagggagggaaggggattgaattagggtttagcgtttgctgccgccgttcacctcggagacggtctcgtcgaggagatgcttgatggagtaggggtcgaggaggttggccttcttcgccgccggtgagggggtggcgccgccgccgtcggtcgccatccgcgtcgtcgccggcgaaacggaggaggatgcggtggggaacagaatatgatgcggatgtttcactgacgggtgggcccgggtatgaggtggacagtgttcgccacgtcggatactgcgttggcttgaaccaatgggagaatacgtgggagtccacgtcagcggaaaacccaaactagtagttttttttcattttaactaccatggtagcattattatattttctctcatataatagcatatatgttttctcaatgtattattcaaatatattaaaatgacaacataattttaaattttgtactaactttacgaaactactaatgtgtaatattcctattgtattttatatatgtgttagttattaattatttttattattgaattttagttatttgtaaattatattcttatataatttctttttttaattccaaattttcattatctgtaaattatatttctatatagactcaaggctcttcttgcaatattatttatttttaattcttaatttttattatttctaattgtatttctacgtggactctaaactcacctttcaatattctttaatttttaattacgaatttcagttacttctaaattgtattcctatattgactttagagttttcttcccatgttttttcttaatctcgaattttagttatttgtaaattgtatttttatacggactctaaactctacttttaattttattctgtttattctgaattttagttagttttaaatttctatatggattctatactcaacttctaatattccttattttttattccgaatttctattatttcttaattgtatttctgtatgaactctatactctacttctaatattccttatttttaatttctaatttctattatttcctaattgtatttctatatggactctatactcttcttctaatattctttattttttttaatttcgaatttcagtaatttataaattgtatttctatacagactctagtctactctttcaatattccttattttttaattctgaattttaactatttctaaattgtatttctatatggactatgtttttctttttctccaattaatatgagaatttctaacccgtgagagcgaacgtggaggctcctttttctattcctttaataagttaactagctgggtggcccgcgcaattgcgcggctagcacccatacaaaatcatatatttttctagtataattttacttaaaagttattaaatagctatctcattgtcttaagactttaaaagaccaaaccttatcatcctcgtgtttctaattatatagtttttaaaagtcacgtcagttgctaccccttatgtcatctacttctttatttgcttgctcgatctactactatttctattcattcttcttagaacctttaaaaattagattttatagtttttagagtttattgtcatgttgggtttcatttttataatttctagatgtcccgtcaaacattgccattatactcctctactgcccgtccactatattttttctttgttgtcattgagattttaaaaatcgaacataattatcgtttggatttattttttactttctaaaagtcccgccaaaccgtcagcggctttgccattgtactcctctacggctcgcccgctgcctcccttctttattgtcattgagattttaaaatcgaacatgattctcattgttttttattactttttagaagatccgaacctttaaaaattggacttgtagttttatttttttatattttttaagaagtcccatcaaacaatgccactatgcccctctacagcccatccgccgcctactatttattgtcattgtgattctaaaaatcgaacataactatcgttggaattcattttttttttattttctagaagacccgccaaccgtcggcggctttgcaattatactcttatacaccccgcctgctgcttctcctttttattgtcactgagattttaaaaatcaaatatgattatcaatgtttttttttactttctagaagtcccggcaaccgccttactcgtttgctttatggcctgcctgacttccctccttttaatcgtcattaggattctatttgatgttctattaataatttttatatgtcgtatcaaccatcaccactctactcctttataggtctataacttaatttatctcgtcatatattttagatggtcttttctttcaataatctttatttttatcacaaattttagttatttataaattgtattccaaattgaaatcatattcttttttttctaatttcagtttttttttaaatttagttaataccgtattgtgttcttttaatgtttttatttttttattttcaatttcagttgtttcaaaattgtattcctacttgaactctcttttaatttttctaattttggatattattttttattctaaattttaattaatctcgtattgggttcttatatggattcttctttcaatattgcttatttttaattccgaactttagctaattttaaattatattcctatttgaactcttcttttattttcttttgctaatttcggatttatttatttttattctgaattttaattaatctcgtattgggttcttatgtggactcttctttcaatattgcttatttttaattctgaatttcagctatttttatattgtattcctacttggactctcatttcctttcctaattttgtattttattttatttttattttgaattttaattaatctcttattgggttcttatgtggaaacttctttcaatattgcttatttttaattccgaatttcagctatttttatattgtatttctacttggactctcatttcctttcctaattttgaattttattttatttttattttgaattttaattaatctcgtattgggttcttatatggaaacttctttcagtattgcttatttttaattctgaattttaactatttttatattgtatttctacttggactctcaatcctttcctaattttggattttattttatttttatttcgaattttgattaatttcgtatcggattcttatatggaaacttctttcaatattgcttattttaattccgaatttcagctatttttatattgtatttctacttggactctcctttcctttttctaattttatattttagattttattttatttttatttcgaattttgattaatcttgtattgggttcttatatggaaacttctttcaatattgcttatttttaattctaaatttcagttatttttagattgtacttctacttggactcttcttttctttttttctttttctccgattaatgtgagaatttctagcccccacagcgaacgtggtgcctcctttcaaagctgttttaacaatataatagatagatagattattttatttttgtttcttaattaaaattgtgatatttatgtctctttgcctccctagagtcgaagagaatgtattcttttaaaattttcaaatatcagttgaatttggatttcaatggaatttctttctattttggtgacattcagaatgaaattccatcttttcttttctttttttcaaactagcttgaagaagaaggaagaaaggatatccgatctccagtatacctagcaattcgtaaaattgaccaaattcatgtaaaatttcactcaaatatttttacatttaagccaaataacgtatatatactccactctccactacactgtcatacattttcatagccgccgccgtctcgcggcgatcgaactccacaactcacgccggcggtggcgcggaagaggaggacgccgccgccgccgcatcctcgctgtcgcggggcttgccccgccggagctggcgagcgagcaacgccagacacgcgccgacgagggccacctgcaatgccgcggcgacggcggcgagcgcgatcccgaccctctcgccgaggttgagcttgagccgccgcttcctctcccctccgtagccccgcgggggcggcggacgaggcgcggcgctggtggtggtggtggggtggaggcggcctcggccgggggacggggagggtgccgccgacggcgcgtgggccggcggaccactgttggcgccgccgctgagccgtctggtggcggcgaagccgacgacggagctgggggaggtcgtaggtggccgcgggaggagcaccagcaggaggaggacggggatgatgacgaggagtgctactgctgctcgcggtcgcggcgccatggccggcggatgagacgacgccgccgctgcgcctgcggaggcggcagcagcatgggccttttccgcgatgctggtgtgggcggggcgatcgatcgagcgtgtggccgcggcgcggcggccggtcaggtcagtgtgccgtgcacgagagggaggggaggggaagcagctagcgagcggcgggtggtgtcgcgtcgtggcgctgcgctgggaagtcgcgagagtcgcggatggcgatggtggatgggggtggggaggtgggggggggggggggaggactgatggtgatttcgcctccttctccgccggctcaggtcgcagggggtggttgcaacttccaactcctaacagctcaagcctacgacgtacgtcaagaattgatagcatatcctaaagggtaaaaccagtgatcccttgtaacaagaaagaagaaactgaatgatcactcggttcgatcaaccgaggggttgttattttgttggtgtctaagtttgccacagctaactttagataaaaatgtggcatggctcgaaaccgtgtctgtgaattagtatgctataagtgtggcttagttcaaaagaaaactaagtaagtaaacaacttatgggcccaaaatataaaaaggagtgataaagtctaacttggggtctagcactctccttcgcctcgtcctctttaggctccagcaaggccggcggctctggtgccgtatccaagctccaagacgccgggagcaagccatgcctgggcatcgcctcggctgactcttccataggtcgtcgctctgagcttcctctaccactgactcctccactggttgcggctctgagctactctagtatggcgtatcctcctatcgttgcctcctccaccggccgcgagcgtggccactggcagttcctcgatgccggctcgctcgctgtctcttcgacgttgttgggccctggatctgttgccgtcccgcgctcttgccgctatttcccggaatagacgatgaggtggagaaaatgaggcaagagaaaaggaagagaggggaagaaagaagacgaggcactgatacgtggacccagtatgttgagtcaaccgtttagaccaagtcaacgtgccatgtcaactaaaaccaccctaaaaaaagttgagcaagtcattttacctggttttaatagttggagaagtcgatatgcccagttttatggttgagagataaaaatcttatccgttctatttgagggggtctaattggactttttcctttttttagcccagctcactaaggaaaaagtacaccgaaagtccctcaacttgtcatcgggataaaaaacgtcctcgaacagcaaaaccagatacgcgaggtcccttaactatataaaaccgatcacttgaggtccttaggcgattttgaccctggttttgtcctacgttactgctgagtcagcgtgggaaccacataggccccacatgtcaggatgccaactcatcaccttccttccttttcctcctctctctttctgggcggcttctcggcgaggctaagcggcgatgcagaggtcagcaggcgaggtgggagagaggagggcggcggcacgacggcggccggcgcccggcgggagaagggtagggcggctgcggcggtagccagggggaagcgcgaagaggacagggcgatgtcgcgccgtcgcctacacccgccgctcctcatgctcgttgagctcccacaccggcacgctgcgcttcacgtcgcgacgccgtcgtaatcgccgcaccccacgtgcgccaccaccccgccgccgcccggccgccacggtgagacgcatcggcgcttggcctcctcggcctcgaccatgcggtgggatgcctcggcgagtcggtcgagcgcctgttgcacggcgtcgcggccgccgataaggagccgcgtccccgaaggatgtcccgatacagcccgagcgcctcccgccgcgagctcgtcagccggcggcacacctcggcctccgccgcgtctctgtcgagcgccctggaggaggaggatgagggggacttcttggcgacggggagagcggcgcctccgtcgcccccatcgtcaatggggaggcgcgggtgtgtgcgggcgtcgacgggcggccggaaggcgcgggcgtcgacggggcgaggcgggagaggaggaggacgacgccgcggcttcctccaccgcgcgcagctggggggaggggagaggaagaggtccggcggccgtcgtccccgcagaacgacgacgacgaggaacgggccgctgctggcctccccgcctcctccctcttcacgtgctcgctgtgggagttgtggggaaaggcggcgctctagctgcaagtcgactccatccttgtcgccgtcgcacaaagttgccgctgccattgtgtagctcgtcaccggcgaccagacctcttccgctcccgccgaccggctcgccaaaacgaggaagagagagaggaagaagggagagaagagggggggacccgccaaaacgaggcactgcctccctcctttgcgcccccggccaaagcagtcgccacagcgccgcccatcgccggctgccccgccagcctcctccgcagtccgcacctgccggtcagcctgagaaaagtgagagactgagagagaaggggagaggaggggaaataagagagaggtgatgagttggcattctgagatgtgaggcccaccgtgggtcccatgctgactcagcagccacgtaggataaaactgggtcaaaaccacctaagaacctcgggtgactggttttatatagttaagggacctcgcatatctggttttgcggttcgaggacgttttttattccgatgacaagttgagggaccttcggtgtactttttccgctcacatccaaatacttctgtcactgaggcccatctagcaaacaatattccggcccatgaaaactcccgtgcggcaacgcacacagcttcgcaatctccccaccttatcgtcgtcgtcgccactgtcccccgtgcccgatggccgcgcccgcgcccacagcttcgccgccgccgccgcccgccatgtccggcctcctctccttcgcctcgtcccgcccctaccctcccctccccgcgcccagacccgccgccgccgcccccaggccgcgcctccgcatagcgggttccgccgccgcggcccccaacgccgtgtcccaccgggcatcctcctccttctcctccggagaccgcctccgctcgctcgtccgccgcggggagctcgacgaggcgctccgcctcgtcgggtccgcgcggaggcccgacgcgggcacctgcgccgcgctcatcaagaagctcagcgcgtcggggcgcaccgcggaggcccgccgcgtgctggccgcgtgcggccccgacgtcatggcgtacaacgccatggtggccgggtactgcggcgcggggcagctcgacgccgcgcggcggctcgtcgcggagatgcccgtggagcccgacgcctacacctacaacacgctcatccgaggcctctgcggacgcggccggaccgcgaacgcgctggcggtgctcgacgaaatgctccgccggcgatgtgtgccggacgtggtcacctacaccatcctcctcgaggccacgtgcaagaggagcgggtacaagcaggccatgaagcttctcgacgagatgcgagataaggggtgcaccccggacattgtcacctacaacgtcgttgtcaatggaatctgccaagaaggacgggttgacgatgccattgagttcttgaagaacctcccgtcatatggctgtgaaccaaacacagttagctataacattgtgttgaagggcctgtgtaccgcggagcgatgggaggatgccgaggagctcatgggcgagatgggccagaagggttgccctccaaatgtggtaacttttaacatgctcatcagtttcttatgccggaaaggattggttgagccagcactggaagtccttgagcagatccccaagtacggttgcacacctaattcgttgagttacaacccgcttctccacgcattctgcaagcaaaaaaagatggataaagcgatggcgtttttggatttgatggtgtccagaggctgttatccagacatcgtttcatacaacactctacttactgcactctgccgcagtggtgaggttgacgtcgctgttgaattgcttcatcaactcaaggacaagggctgcgctcctgtcttgataagttataacacggtcattgatgggcttacgaaggctgggaagacaaaggaagcactagagctgctcaatgagatggtcagcaaagggctccaaccagatattatcacatactcgacaatagctgctggtctttgtagagaagatagaattgaagatgcaattagggcatttggtaaagtgcaagatatgggcataaggcccaacactgtgttgtacaatgcgataattcttgggctttgcaaaaggcgtgaaacacacagtgccattgatcttttcgcttacatgatagggaatggctgcatgccgaatgaatcaacttacaccatattgattgaaggcttggcttatgagggattgatcaaggaggcacgggatttgctggatgaattatgttcgagaggtgttgtaaggaagagcttgataaataagggagccattagactgcttgattgaactatgaatacatataagaggatcaactgagtatcgagggtctgagaatgagattttgtgcatcttcgctcttcagcaggagaggagattttactggatgttcacctaattgatgttgctttcttgacaacatgtgagtcctttcatccacttcccaccttacaggcttacagcccacttcagtcttcgagttgcttggaatttctgcataactcttgtcttatttaacatactttaccttattgttgaacatggtctcatgtttcacattcttgtccttacatgatatatcatactagtgtgagatacatattagacctgttttgattgggcatttcttgcttcaatatgctttagcacttcatatgaactagcggaatgaagggatatgctaagtgatgagcattaggctacctgttctctctactcctgtactgtaagccagagttgacttatcttagtcattgacacggtaatgacaccctaattggtttcaaactaaacatgccgctttctcagctgcagttctacagaattgacttgggataaatctaagactgtgagctacagaatttgccaattcaagtagaaaacatgaaaaatgaccagttgattactatctgaaactccctatttacatctaaattgaatgacaacataaaatttgaactaaattttagaaaaggctggaagtccagatttccctttggattgtgggtaccatcagaaattggtcagtgcccagtgatgtgattcaaaacttctttctcaatgagttattttccatgcttgtgatgggaaaatgatgaaattattggattcagtccttcaccactaagacattgatggcacctggccactttatgtcaaatgtcagaccagaaacatgattttcacttatgcagttaccatccttaggcgtaacctttccaatgtgtcatattatactaaagtcgctgatttagtttatattttaattaatttgctctgtttttattgcagtcttgccgtgctcaaatgctaatggaggtccttttctcagattgccaccagaaggtacttgaacaaacagtgaatctgagcctcactgtccatcaaaactgatctgtttatatatatgcaaggcactgataaccttgtaagttgtgaacctttgcatataaatttgtaatgattcaggctcaccagtatatgatgccctcctgtagctaatagtttttcccgtgtcaaatcaaatgaattttggtttaggcataaccatttagcttattattgtgtgtcttcccaattatgcaatgtaccaaaaaaaatgcatcttaggtgtacatctatgcaatgtgcaccatttaatctccatcctggccaaaacctgaattcaggaacaggattttagccccagctttgtagttccaacagaaaaaaagaagaagaaaaactactattaattccaaagttctatacaaatataagaaaaagaggcagccatggaagttcttgggaatgcatcatgcaatccttggttctatgcaagcttttgaaggaccttaaaattacaccatgacacgacaaagaataacttaattcattacaccagttagcaaaataccccctctatatgtaatataccctgtggtaccaatggatcagtgttttacaaaaaatcatgccgaattggtgctcctccaagttgcatggcttcttaaaacatacactgcctgatgtgaaaacacaggaaaccatgcaaagtttgtgtggttttttttcccctgtctgcctagagcagaactcccatacaatctgatcaggcaggtggtggctctgcaggcccagctggttttgtattcagaagaggctggattgccttcacgacgatcgtcatgttcggtcggaagtcggcttcgtactgaacgcacaatgctgcaactgctgctagctgaaaaaaaatcatgaaagaaaaaacaatggcactcactgctgctttctgaattttgtcagatttgctacagtatagctacctttgcgacagccttcggagggtaatcattgttgagctttggatcgacgcactgcttaactttatcttcgctcaatcttggagtagcctgcctcacaaagatcatggtatatgtaagatcattggaaatggaaagattgaaataggatatattgtaataagttatcttttgttgaaggataaaacttctccttacccaagtgacaagactttgttgcccttttggcatggtgtgatcaactggtttccttccggttagtagctccaatagaatcacgccaaagctgtaaacatcgctcttctgatttatttgccctgtcatggcatatctgaacatcaccataatcagaccaacaaatcgtcagcaagtaaatcctgcaaaaggcaaagcatgctgtacagtctgatacgcgagaaatcaatcattctctcccttactctggagcatggtatccaaatgttcctagcaccctagtcgaatgcaaccgggcagcggtgtcggtgccctggttcgtcaggttgaaatcggcgatcttcgagctgaactcgtcgaatataagaacattgctagaccgaacatctcgatgaacgatcgatggctgcactttctcatggaggtactccagccctctcgccgccccataagctatcttgacccgttgcgcccagttcagaaccgggccgggctccgcgccctggactcccttcttacctgcatcacatccaaaaccattaattagcttagccctacgtgtggagattttttggctccgccccctgatcacatgggcgtaaacttgtcgggattttactgttgctctttatctcgtgtttgctttaaatttgggagtgtttttttaagtttactttgaagtacacttgcttcgagtgatttggtgtaataatcggctgtagttcgttgagtaatgactgggatggttttctattccattatgtaagaaaaacataaggtagtagtgaaatggaaaagacttattaccgtgaagaatgttgtgtaaagaacccatggttgcaaactggtaggccagcatgcggttgccgtcttccaagcagtagcccaagagctccaggaagtactcgttcttgagcttggacaccatcgctatctatggcgacgagatgaagatgagcaaaaagctaagatggctcatgtcgcgaggaggaggaagaagaagaagtggggtgttttggggcacacctgggcggagaactcggagtcggtctcctgggaggcgccggggtcgagcttcttgatgacggcggcgcggccgtcgctgagcgtgccgttgtagacgcggccgtaggagccctcgccgatgagggcgcggtcgctgaagttgctggtgatcttcttcagctcctcgaacggtatcgccggcacgtcgatgttcaccggcttcggcggcccgcccggccgcgccgcccccggccctctcggcccgcctctattccctgcttccatccgccgtcgccggagaagaagaccaagagacggtcacgaaatcggtcagcaaaggaggagaggaatgtaggaggccgccgccgccggagaagaggaatgtggagacgcaccgggagcattgacgttgggcggcggagcggcctggttcgccggcgggccgtagctgtcctcctcggcgcctccgcagcaagacatcttcttcttcctcctcctcctctcgccggagttggatgcgcgggctgatctggtggccgccccccgctcagcggatcatcgcgcacgacctgcaaaccattttcgattaattcctcgcgtgcacaccaacagattaaatccctgaagaatcaattcacgaaacggatcaatctctttccgaggaacagaaaattaactgaaaagaaattaaaatcaacgcacaatttccagatgatcaagcaatcatcggaagcaatgaggggatcgtggatcaagaaaacagaggatgcatgcatgctccatatgcgatctggatcggcatgcagaaaacggtagaaattcttacctcccccaaagattcccgcacgagatcgatcgcttcccgcacgagatcgatcgatggcgatcgatcgagggggggcaaagggaagaacagcggtgttttgttccccgggagaagaggttaatggtggggaatggcgggagctccccctctttccgcgccaaaggagccacacccccctggccccctctcccacccgttttaaccgccacacgcacacacgcacgcacggacgcgtcaattaattggagtaattaactaacctctgtgcttgagcaccttccccattattattgactattgttagcacgatcacatgatatgaaactatggaggtgtgccataatctttagagttaattggatccatatcattataaatttactcgttttgaaatacacagttaatattcattataaatttactcattttaaaatacacagttactattcatgaaactaaaagcatgccatcatgattttacaggtattccaaatataccactgtttacctctttgaagtattatcaatttttttgaccaaaatgcatgtccctttcttcttcctttcccttttcctctcttccttccactggcaccgcagcaatgagcttgggcgcggagggcatccatcttagcgattgccgcggccttctatcctcgaggcgtcgttagcggatgcagagccgccacttcatttcatactggagctagagggattgaggaaaacgattcaaatagtaggtaatggttgcgtagaggctgacatgtcttctggtagggaagaggaaggttaactccattgccaccaaagcccctcccatggctcccatcctcggtggtcggtgtggtggagtagcatggacgcgggaagggtagatctaacgcggcggcgggaagaggcccgacgaggaaaggaggtggagctcaccaccatctcgccgtcctctgacgtcactggagaagagatgtggtgcttgagctcgagcattgtctacacgacggctatggtgtgcgccaatccgtgcttcatgggcattgcctcctctttcagggtaaccacgagctcgcatgcactgtcatcgcgttagcttcgctcgtttcgctaccgatggcacttgtactctcgctgattggttcgccttgcgctcactcctagacattgctatggcactggtggaaaggaagagaggaggaaggggaaagaaggaagaaggaagaaggaaggggcattttggtcaataaatttctgacaatgcttcaaagaggtagtaatagcacatctggaatgcctataaatttgtaatggtatggttccaatttcacaaatagtaatggtatatttcgaaacaggcaaaattataatggcatgaatccaattaaccctctttacttaggagctcattaaatgatgactatatgtttgataatacaggaaatacaagcatatacaaactcttctagtatgattcgaactcatatgcaggtagtatcgagtattcactttaattttctctctcccgtatcctttccacgagtctaatatctaacgttttgaatttgcatgaggatactaacgcactagaatagataccatcatcttaatcggacggtaagccccatctcaatcgggcacggcgttcgtcacatgctagaagtaacagatatgaacagttatctcaatcgggcaaacggccgtcacggatgaacctatctcaatcgggccctaattaaagcccgtcaccaatagctttgacccagattaccagtcaaactatagcccgtcacggatgatctatctcaattgggccacaaatagcacccgtcacagatgactactaacctcaatcgggtctaagctagagcacgtcagggatgatactcatctcaatcgggcctaaactatagcccgtcacagatgaccatcatctcaatcgggcattaactatagcccgtcacagatgacccttatctcaatcaggcactaagttatggcccgtcacagatgagtataatccacaaaaaaataaattttgttttttggctaacctcaggcctttgctagccatgcccgttgcaaaaatgacagaaacacatgcatatacaatatccccagcatcacccattcatatacatgcactcacatacacagctatcaatatatttcacacaaccatattcacagaacatctattttaatctcatatttcacatccattcacatattttacgtcgattcacatatttaacatatttcacctgcaaaaccgagttaattggatgaaatatttatttagcaagtattaacatagacataagaaatatatacataaatataaacatcatagttacataatcaaggtcttaatcaatgttcatcattgcctaaatataaaagttcaacaatattcattattttagtttaagcctaaacattcctttggggttaattatttcgcggaggatgaagccggctatctcctcacgaatctcctcaaagttggtaggcagagacttggtaattttgccctacattgtcataattcaagattagttgatcgatcatatatatgtacatcgatgtagttagtatatcacaattaagaccaccgacctcaaattcagccaaagtcttcaccttttctctgtatatatagaaggcgcatgttgtggcacacatggaatccgtgctggtcacctatttgttacttcaccgggaagtcttttttgtggatgagggtgtcatgtcctatcttcctgaggcctcctctttacacgtattggccccacacttcatctatcgttagttgaataggggtccaatcatatgcctgcttatcaattctggagttcaggtagtggcatgtactccacttaggtgttatgaccagaaggattcaatgggcactgcagcattaatatagtgaaagttaaatactaaagctatatgtgtcacgctgttgtgtatatttagggaacacacttactattgattataggcgcacataatgtactccttgtctcagcgggaccacaaggtgtcgtagatgtagttgaacattccttgacggttattctcgagatttgtgacagtgaccacttatggatcaaggaaggcgacttctggtgcatttttctgacaccattgccaacttaacctacacgcaagatacacgggtacccacttttctatcccgtatcctttttctcgagcctcatgtctaatgggctgactagccgttttcacaccctaagattaattgtttctaagttctaacaaacagtaattcaactgatgtaacagaaacctttttaccattgtttctgacctgacaagcatccaatttttttgtatcattgcaacgatcagaaattccactggggtgacagacaaaatacatgaccttgattttttttctcccactacaattagtcatctcctatgctctatcaatacatatgaggtaaagcttatgctctcttattttcttaagaaaaaaaagccatctcatatcctttcttcagttttgggcctccactgtgacgcttgaaacgattggggaccaacaggtccacaccttctgtgggccgcatgggccgggccgtaggcaacgtcagcgcgcgcgatgcagcacgcgtgcgcgcgtcaacgtcgccgcgcacgcgcgtatccaaaacctgcaagttgcgcttattgctgactcgggccatatatctatccaacttatgcgttggttgaatatatgtgtgcttgtataccaaaagggaattgatgtgtctccatcctattctcacttttggaagctatatgtttgatttggagaacaagttgtgtagtagggctcgtttttttttccatggtttagaattaattttgaagatagttccaccgcttgctcttaagcttaacaaccacatctaaaatttaaaatttagaaaatccaaatttggttgtagcttatagtcgtccattaatgataacactgaagaaaatcatcggaaaaaaatatctacttgattttaaaattaagtactaaaatccgaatttggttgtaccttataattctatatattgctctaggtgtggttgttttcgaaatgtaagctgtattagttcaacttgtgtcacaaggatgaagaaaataaatcaaatgacttagttgcctttaatttatagtacaacattgaaaaatatgagtcatgtacttttttttaataataacatttatttagcaagtacgtacaagaagaaaaacaatagtgactaaaaattccaaaactacttacatttacattttgagttgagaaggataaaacaacttaattaagtacaaattcaatgtagcttttagtttttttttatttacaggattaatctagattctttttatgctttaatttgttaggttatagtttactgtttcatatttagcaagatccacgctaaaaatataataacattctaaaaaataagttataatttcatttgtataaattaaagaaaaaagttaatatattaattgtttgagcgtggatctagtagttaaaaagtgttgaagaaataaggaaaaaaaatctttcaacaaaaagatggccggtgaaaacggtacggaaatttccgagatttccagctgccatctccagtttgcatcgatcgtttcagtcggtattggtaaccgattatggtggaaatggaaacagtaatatcttctggaaatgatagtgaaaatgggatggaggtttttccaccgttttggtcggtaaccgtagttgtacggtattttttgtcaaaattccgaaaagatttcaaaagttccccagcgactcagccagctcaacccatcggaagcccataaataaaagaaggctggtaagcttgcagcccgaaaaaagaggaagtgacaagggaaatgttgttaaccctatgacatggctgacatggcatgtggattttggtgaactttggtctcctcaacttatcaatgttaaagtattgttgaattttatttatagggaaaatttgaaccatgccacatcaattttgcaaaatttttgatatgccaccctgacccacatgtcattgactcatgtgggtcctacatgtcattgagatacgggtggcatatctcaaattttgcaaaattagggtggcatggttccaacaaaccatttatattgcttgtcaaacttattatcatatcattaatcatcatataacagtgttatgtggagtgtgacgatgcaataataaagttaaaaagtcatctacgtgcatagttaaatgtgtgctatgccatactccgttgattccgacatgaattttcgatttctgaccaatagtatattccgttctgatggtattgtttccgatataccgatattattgatatcgttaccgttttcgggtctaccattctaattccatttttgagaaaaaaaaataaaaataaaaatggtacatagtttttctaaccatttccctccttagatggccccatatttttcagccgtcggaaatactgtgtgtccatattacgtcgtccccagtatcatccggccggaacccgtaaatgcaaaagttaacgaatgcgacaaaacaatggcaactccattctcaaatcgtgcgattttacttgtttttaagcatcacacatatcgcaccattcttttacacattaatttacacacgtacgcttgaaaattaccgaagtcaaacaaaaacatatcacttaattaattactatacacatgttttcccatcaaatgcgcacgtcaatctctgattaattattctacctaaccttaggtcacattttgagccattaggtaattagacatttagaccccaaactgtaatatttaattaagaacccgacacgtatgtgtcatttggttagctaattaatatttgacagaattaaccatgcgacagcagacatttttttttttgtgtgtgtgtcaattgtatcaatcgatctgttgctgtcttgccagcataaattgtctttccatgataatcatcatcgttggaaaatttataaggcgtgtcaagggtttattcctgttggtgattaattagtacacgtacgtgcgctgacgcgcgcgtgctgcatgtgcgctattagcagtttcatcttttctgctagctactcctactatgcatcaataatcgttggcctattgctggtatacaggggtggagccaaaaaaatttctacgcctagaactcgagtagggcttaacttataggatatttgctctctcaaaaaatacatagtgatttaaaaggatttaggcatgtttatagagacactgcccctgcttgtaaaaacgtgcaacactctgtgttcgtttctccaacaagacatggattaaattttagatactcgtggcatatttttcaaactactaaactgtgcgtttcgtgcaagaactttatatatgaaagttgctctaaaatatcagtttaatctatttttcaagtttgtaataattaaaactcaattaatcacatattattaccacctcgttttacgtgaaacaatctttatcttcatcttcatcttcaggagattcaaacaccacaatatatgtatttatgccactaattaccctgcaaatatttttggatgagcaaaaatgctaatcacagtatcggtttttttaaccaatagagaaaacttctatcaatattttttaatgaaccggcaaaaaaccgagtcaagccgagccgcatgtggggtgaaatatcatataagtcgtgtctctccctctccctctcttccttctcttaattcttctctacagatctaaccacttcattcggaggtgtctacatttctaaccgtggctcgactttggcttgctcttggtaggcaactacatttcagcatctcgatgctgaagggtcatgttgtagtggcagcgggcgcagataatatgaattgcctagagaatttatgtggcgagctggcgactagggattaacggagcaggcaacatggttgtcccttcaacaggcataccgctatactgagaccgttagatctggtcaccatgagctcaagggtaaacagatttgtaaccaacacccattataaacgtaggcgaatatcaagattaagtacgagcat

SEQ ID NO: 82023 - DNA, 3617 bp, Oryza sativa
ctgcagcccgtttttaggtgaatgtgacacattctagtacaacaaatttggatataaagcatatccaaattcgttatactaggatgtgtcacatccacccaaaatcccttatattttgggacggagggagtagatatctataaccgggggtgtagttcaaaggtttcgagcttcttggatcatgtgccatgttactctatctgatcataaatatttcacaaatatttgacgtttatgacagattttgtcaaatttggaagtttcttaaaagtttgatcaaatcttggtctaaacgtcaaatatctataaccggaggggagtagttcaaaaattttgatcttttcgaagcatgtgtcatgtcgtcaatgggggggatgtggtgaaacataccttgagatacatgtcgatggcgcggtatagcccgtcgtgcacgggccgagttgcgaggggaaccatctcagtgagggcgatgaacttcgagagtgggaggttggggtccttcgcaatctcagccagatacccatcaaccagcttcgcgatcgcgagcttcgagctgcgggagacaccattcaggttgtcatcatcaccatccatggcttcctgatcatcatcctcttgtagcttggcgccatcatcgtcctcgcggtgctgcgccatgaactcctccagcatcgccgagatcatgtccacattgtacatggcggcctcgtcggagttagcggggataaggaggtccgagaccgaagcctcatccagcttcgcgccgatcctcttcgtaagattgtcgcggcacgcctcatctgatcccaacaagcatgaggctctgagaagcttaaggaggaaagagcatgggactgaaccttcctcagatggaagcagggagatgatggtctcaagagctgcagagtgccttgtgcagtcaagcccattgctgacagcactttccagtgagctgaacagcctcctgtgagcataagccctcagtgcctcaccaatcacctcactgctgattctccccttggccttgatggccatgatgaccttcttgtacaggcacatctcaaggtcacagagatcctctacccaccagtctctgggcaccatctgctgcttccttacgccgttccagtgcgagtcgaggccgttctccgacggtagcttcctcctgttgtaggtgtatgaccactcaacctctgacggatcgatggaggccttcgtcgcgatcgaatcgacgcagtggttgatcaccttgaggttctccgaccatggcagcagtgacttggttgtctgaagaacgatgatggagtccttccaggttctgaatatgcttgaggacaggaacacatcgatcttgtagatgaggttccccttgtcgatcgtctcgaacatctcaagatactcggctgcgcagcgggctgcgaggacgttgtacgcgttgagggtgacgatcatgccatagcagaacttggcacagatctcgaatgctgcaggtccccccgggatgtcggagatgtctatttcgtcgttgctctcttcgtttgtcgatgccaccaatgtttgcaatcgcgaactcttcgacaaaagagggaactgcatttgatttcagcaagagtatgagtaatcattatattagtcacaagaaaactgctgataagctaaattaaatatatttaatcatgggaagaactgcactgaatatggatcagctatcactaactccattaaccatatgccaatagaggactgaaacaaaatattttattttaaatagaatgttatggcatcaagaggagtacatgataaaagaaaatagtatcagagatacagaagttttgaatcagttccaaaattcaagtggaattgtatttgtgttcaagaggttaaaatagtggaggggagagctcaaagaagtaacaaaaacgttcagtcaaagggacttgagttcagataaatgaaaaatcatgtatgctcaacagttcaaggctgtacttggccatttgctaaaacacagagtgttaagacttaaagacagtaaacttgtaagatagtagagttggtgtgtaccttgtgaagataaaacttcacttcccctacaatgattacgatgtccgttgccaactcagttgcgacaaacctgaaaaatacattttcatcaaggacacattcaacattagcatcacagagatgcattacaagcagagttaggacaaaataaataggtgtaaagcaccaaagataagcaaataagtatcatttttttttctttttgaaaaaaagaagtgatcagtagttaaagcaccgattttctgaagattgttttgttatgttttttaggggcatgtttgcggtctcacagctgcttaattgctatatatgaatatcttgaagatcatttttgagagagaaatggctgttgattattttgtggagtaattgagagactaataatcatgttgcacaatgaggactcccacaaaactacattagaaatggcaatggaggaaataatagtgaatagctgataaattgtgtgcttttatttatatgactgactacaatgattgcaggggcaaatggtcacacaacagtggatggtgaaaaggttgtcttggaaaaaaaagaacattgaaacaaaaggtccctggaatctaaacaatctaataatgcatcttcatgataaagatgaaatgacatatgaaatcaaatctccagccccactgaaaccgctaagtgtaacaaaaggagagacagagtgttagcctagaaaaagtgccatgggcaaaatgataaagcaaagaaagcagcaaattcatagaaattaactctatgcatgacagatataactaatcaaactgctcagtggtccaaggaaaatgatgacaacaaattcattgtacaaaaggttagggaattgtagaagtttcattttcaaaatggaccacagctccacctaccaaaccctatgtctgctagatgaacattaaacaggctagtggaaaagatgcaatgaaaatggcacatgctccgaagcacacaaatcgctcaagaagagatgccattggcaaagaatcaacgatgatgcatcctataaagatgatcaattgtatagatagccttttgcaagctatcatgagaaccactgctaacaccacaagtgctcactttcacaaaggtcttttgggtgccaatcattgtcaaatgaaaaaataatgtgaacttcactacaattttcctttttagattcagcctagttactagatataccatcaccagaaactacaaaagagggtgttatagtctagcttttaattaaggtcacattcattcaaatttctctgatataaatagtgtgaaaaccctcccaaacaaaaaccagaaccatagtttcttgggagacaaatacaacagtctatctttcagtggatcatttaaaaaagctcacaagcatttccctactcaagattacagggaaacaacatgaattcagtaccttcacttatttaactacactaacataactgcacagttaggcatcactttgcgcccacatagctaaaggccatgcttccatgtgaccagctaacgatacggttggcccctcctactgactacattaa

SEQ ID NO: 82024 - DNA, 22038 bp, Oryza sativa
gtgaatttttattccattatctgaaacttaagagcacttcaattcatggactactgatccacaaaataaaagctagagctcaagtgtatcaattcaaaagtcaaaagttactaattgtgaagtgaaaaaaaaatcatctttataacctgaaaaaattatggacagaactagttaaggactatctcacctgatattgtttccctctgtctgaaacacatctggctttgatccaagcttcatatacttcatcttgacacactaagaacaacctcaatctgtcacctttttttcttcttatttcccttctttttttcaccctttactttactcctccaagtctccaacaatcaccagaaaatcagaaccacaagaccaagatgaagcaagagaccactggcacacaactatttactcctcagtccagagggcaagagcaactattaactacaaagatctatgccctggtgtcccccttgccaagaaaccaagtattctctctctctctctagattggcaaactattgacccaatcttgtcaagctctgggtccaagaaagcacaatgccaggaaaccaagaactcctccaagttggaaattggatcacacaaacacagaggaggaggcagcacctgcaaagcacaagagcagcatcttggggtgaggagacagtgagaataattgggtgagacaatgggggatgggttgtagggagaccatgggtacaagcactagtgaggctggaatcttatcaggttgcagtggggaggaaaaaccacatgaaggggtgcaaataaaaatccaatcttgagctctttttttaaggaatttgcacatgtaaggcagtcaaacagtgagtaaacaaagaactgcatgctgcagaccacaggtttgagcaaacagttgctttccttggaccaagatgagattggagtgtactgaaaaaaaaggaggtggttctgattaactgatttccaaccagattttttagtggagaaaaaaagggagattttttttaccctcaagactaacctaattcaagaaaaggaacagaactaggaaattaatgttcatagagatgaacttggaataaagtgtgtatacaaaaactggaaatggctgcactgcagaaccatcaatccaagaaaaaaaatccagtagactggtaagattttttttcctctcaagataagtagtgaaccaaccaaacaaaaatgtacagactgatgaatccctaaacaccaatcccacacactgctccaaagctagataacaccatctctctgaattgagtcacatttccaatggaagaacaacttcatgagatgaggtctgaacaacttcaacacaacctaacagagaaaacataaaggaaagatgaacttacaagaaactgaagctcaggcaagatccttttctctccctttgaagatcaaaagatccttagccacaggcaagaactgatgctgatgcaggagagctagggagaaaaatacaagaagattgcagagaggagagggagaaggaagagaagcagtgaagtgaagcaggaggcaatcaagcagacatcttgcacctcagctcctgtgtgtttttcccgggagggacagcttgttcagcttgctttgctgctactccaatgcaagaagggagggaggtggtaatggagttagtttggcttaaaagatagtgcccgtagggtggggggcaagtggatggacttctctgtcctcacaaataaaatctctcattttttcccctctttaccttaatttttttaaaagaaaatggcaataatattttccgttggatggaagacgcatacatcgtacgtacatatttcctccgtctcataaaagacaaacctagtaaataatacgtctgttcagattcataatattatgatgtatcaaatctcgtattagttctgtttttcatgggacagaagaagcaaacaactatgcatgcatttcctatacatacacaaccatggatacacccctaacatatgctaaagagacccacaccttaagcatactcgcaatttcgtaaatgcagagtctcctaacatatgttcaagttgtcgaaatctctagcctttttaaatttatgttgaaaacccataaatatcgcacacatatagataggatataattatgtacccacgacgtaatacgacaccatattactggtgctttctagatgataaattattatcctcttaagaaaggaagaaaaagaagaataaatgtcctataatgtctcagacaatggaatggagaggggaaaaaaatgtagcaaaatatacacgcacatatcgcatcagttcctttcagacaaaatcaaggcccatgctgtgacctctgaggttccatgtcggggatgagcagcatctctcaccttcaattgacagtgaaggttaggagccgtgacactgcatccataattgcgtattttgcatgagagatgtgagattatattccacagtgtcatataatgaaagccgtccattctctgtcaggagttaatgcccaagagtgacagcattgtatacatggtccctctaattatcaattttgggaccccaaattaggccaatttggtacacgcgttgctgatcaatcatcaacttgtgcaattatggagataagcagagagcaaatggagagctttcattgatgacgatcttgatatgaaatccaaacacctcgcctcttaaaatatggctatttccagtgtttaaattttatgctgaaatataactactttgaagtactaagtactaattaaggggtcttcatagggatgaaatgtccaaaatacccaccatcccacacctatctggctacctccatcaactgacatttagtgaagggcaatctaatctttttacctccctttttattttgggaaaatttataatggcatggttccaatttacctttttatttttcatgagaaacttcaaaagtagctactatatttttatatggatggagtatttgatttcagagagagggaagctgtgaagggaggattaacagtggaaatgaagtatagaatatcagtcaaagtacctgatgtaatgttcaagaattttctttcaaaagatcatgttgggtcagttctgttctctcttttgaccaaacttcatttgtttacatcttcagtacgttgctttggtcttctccatggccatctgaagcaccggcctttccttcttttgacccaaatttgtgtcagtgtgcaggtttgactacaaacttcactaacttaaacttctgaagtaaaagtattaagcaaaatctaatgtaaacagagtgcatacaaatatatagataacttgaatgtatatacttatattaacatcctagcatcatggatgatccttaattgtgatgtcaggtaggatcacactacttgacctcagaaaaatagatgaaaaataacccccaactgtgcttaagaaggtctcatcatatccatcgtctccttaaacgtttcccaatgatggcgctccccttttcaaagtatattaacaacacttgtggtctactcttgcctgaaggcaagctaatctcacttcatctttcttggccccctccccaaaatctaatatacttttctctcttgctttctttgcatgattaattttcaagtcatatgcattgttgcacctgaagttttacaatatcatggtagcatacaaatgagaggtgacatacatgatacattggaaatcagcacttacaatcttattttagtccatgtttataatgtaggattttttttctttaacaatattaggagcttctcctacattagaaaattgtttactacctctttagtttttttttacttgatgatttgggcattgaaacggtttagaaattttggttgtgtacgtccgatttggatgcagaggccgagttttaatccactttctaacaattgtttttaaggaaattctactgcattggaaaactgtttatatttggatatttccgacaaattatactccacatcaccttgaaaatgtactagcaaatatgcacactgaggcctgcagctacatggtgcagtgccaaatagaaatagtgaaaacgtgaggtggctatggtgaaatggaacaaaacacaaagtacaagctttgctctttctctttatactatttatgttaggcttcaaactttttatctgtcacactggtgagccttgacacatggtgctgactccccacattgtgatcaggaatctgctcattgttatgagggcatgcctgtactacccttcttttctcctacacatctgcccctatctctctctctctctctcctttcattaaattttttgttgcaagatttgggggatcaattgtgcaggtattaatagttaagtacttaagtccattgcattggtgtaatagtgctgtgatctaggatcctggcatgggatttggattggctcacaagtcccaatggccaatattttgtctgccctacatatcagctcatagatctgaagatccatcagcatattttttgcaggttagctggcctgcattgcatcccctaccgaccaaagcaagggattcacatcccctgtcattactccaaacatttgctcccttttagacactgttactattaatcattccagtacaacatctcaattacataactgtttgctcgtgcacataatttgtatgatgagggaaaaaaattaataatgaaaacggtttacatcttcagcttttgacataagacacttaaccacaagttttgttcaagagagcaaaacgaaacatgagaaaaaaaagtttactaccttttttgttttgtccttgaaagatatcatgagttacaacagcaaaattgttccatgacaaatgtggcttgataacttatgtggcaacaaaatttagtgataagagaaattgtttagcttggcaaagctagcttcaaaataaacaagtaaacaaaccatatgaccaagagtgacatcttcagagagtatatgtatacatttcagtcagcttcaagaatctccatcctctgcctcatcagttgtaatcttcttctagaggacatgaatctccagcaaaagagggtgtcctatgatcctatgagggagaaagcataagctatggcctacactatcactgactactgatgtgagctgatttaccaccctaattcatcatagtgctgcacagaggatgtgtccatgttcagcatggcaaccattccctacccactttcttgtgtccatccaaccatggctccatcagattaatttgtcctccaaaagaaagactgatatcatctaagcaaaagctggttaacacaaaaaccatccttttgtcaattaatgactccatcagagagagattgagatgatggcaagaaagagactggagaactgatgatcatagtagtagtagtacagtacatacagtgtgtggttaggtgacaggacattggcatgcatggattggcagctttttaagtcaaagtgagatttggatccctctgtgtgtcattgtgtttcattgggaccctgtgttaggcaactaataaagctgtgattgtgctttgtgcatgctcttgtttggccaagaacatgatgacttggcaaaagaccctactagtagcatcatcactgattaactcttttgtggttgtttgcagtcagatgcaaaattgaactgtgcaaactctttctgaaatcctctaaagaaaacttttctgaaatcatttttttttggttgaataggagtactactatctagttgtcacaggttcacatgcccatatgcctgatgcttggaagttagaactcagagagaacaatcaactgaactgatcaccatgcccatgacttgccaagttggcatgtgttatatattctttctctcatccatgcttgctaggttcatgcatgggcatggatgtaatcattttcatcagtaattcatcatccacaaccatataagcatgcattgaactctcttgagaagtgagaaaaaaatattatgatctgattctctctcatattttcttgtcaacccattcaaagatgcatggcactaattaagttcatggctacctaattactcagagcatgaacctaataccaccaataactactgctacagcagagcttatgcaataactttgatctatgtagtaatgaacaccacatggcatatctagctagggacattaggaaagattcacatcaaatcttccatcatgaattcatgatatatatatcctcttgcaattgcaagggtctggtgtttcatttgccttcagcctggcccctactctgctgagtctgaacaggcacactactgtgcaagcatgttaatagtatggaaaaagtccagtgagaacagtgcccagattggattttgctggggctctccttgaagcaattaattaatcaagatttgattagtattccaagagtaaaacataaataaataaactttgatcttagctagaatctagatacatgcatgcatgtgtggctgaattggtccttggccctacatagagagaggtgaacatcgatcatgtcacacatccaacacttattcccctcctcttttatctttttcagctaaccaatccacatgcatttcagattctaacaagacattaggcccatttcttcatgtgcatctcaaactaggattattggatgattccacaaccttttttactttattgcccatgaaccatcagctactttgtttctctttccctttccttctctttaatttcggttgtcacactacttaattatccagatatgttgaagagtccatttcaaggattttaattggagagaataaagaaaatggatttttgaatggatagatatggagagattatcaatgtggtgaccctcttttgatgcaactattgctttcactgatccagtccaaatagtagtcaatgtactctatatgtggtccatatatatatcatatatatttgaagctttctaaactaatctgacatgttaaccgacaggttaagcatcaggccaaaagaaagtgttataccctgttagatactttaatttgcaaatatttgacataatgtgatcctttcattggttgagtttttcaaatcttaacatttgtataagtaactactgtccattatatatgtttcaacatcaaccaaagactatagtgtctaccaagtttgacatgtggtgtgatttgtctagctatattcccctgcaaattacgtgtctatgtacactattataagattctttattaaatatttccttaaccacacatttttttttggtttttgaaattaaatatggtcaaaaggaaatgtttttagttcctcggaaaagcaatgatttgctgaaaaagaaaccataggcaagctggcatgtttttttttttttgcaaaagaaaattgtttagcagccctccttctatatgttaaaagagagagaataatttgttttgttaattaacttgctgaccatacagttaacacagtacctgttactcataactacctttcaattagcaaaagaaggagcatccaaagagcacccaagatcacccctttgaaatggttccacataggatgccaatgccagtgccactaggcaattaattacaaaattaatcacatttaagaccaacaaaagccatctctctgtacttgggattccataattataattgatagttaacatgaccatcaggggagatgggtttagtttaggctagttgacatcatgtgatagaaggcaatgtggtgtactattcaagtgtacaatatgtagttgattaattaaactaatgagggtttgctccctgttaagtagtggcctgcaacaaggccgttggtaaaggtgacccatggaacgtgcatgccggtgtactgcctctcatgcaggccaccattaagtggtttccaagggttttatgtctctagaagttggactaagtcaagttataggttagcatcatcttaatccgtcttcaacgtctcgtgaagaatctcgtcatcgaaccataacaggtaaaatataggaggtgagaaattgaagatgccatatatgtaccacgagaaaatataaacaccgaaatattatgataaatagaatatgatatttgtactagaagaaaatataaacaagaaaacctacataagagagatgggggctgggtgcatgggtttgagggatgaaaacatagagggtccttagtgcaacccttatgtgttacaagcttcatcgattagatgatgccatagacatcataaggaagaggagttatattcacattaagtttgacttgcatatataattaaccttttaaaaactctacgtaatgagttcatgttatcctttactatggtcgtcaccgctctaggtgtttgtgtgttggtatagtgaagatggccacttcaaggaggcattcctactaatcaccatcatcatcatcatcattattgttgtaattattttccatttacatctcaatatatttgaccggcattttgtcgaaaaataaaaaatctatctaactaaattgagcataggtatacctaacggacggattgagatcctctgacttacttccctatgacgtgggtcactgacatatggaccctctactcaatgggcccatatatcagtgactcaaagttagaggattctcttcccaaacggacaaaaacatttttgttagcaattttggattagtgtggtgtgcgtccatcgtagcaacaaaatcactcagaagtgagagaatttttttcatttttaattttttttcttttaatatttacagaaataatctatcggcgcaaaaaattataaaaatagaccctgccaccctagtggagggcggcaagctgacgtggcagacggcggctcgacggcgccgtctgccgtcgtctacgaaaattgcatttagcccctttgccgcctaaatgcaattttcgcggccctaaagagcatttggctggtactttttacatcggcggcaagggacccagatgcaaaaagtaccagccaaaaagtactaggcctgggctggcttttttgcatgaaggccccttgccgcggcaagggttttcgtgcaaaaaaaaaccctccctctcccgtctgccgtcaccgcccgtccctcccccgtttgccacgtcagcttgccgccctagtagagggcggcagggtctatttttgtaattttttgcgccgatggattatttctgtaaatattaaaagaaaaaaattgaaaaatgaaaaaaattcgaagtgagaagccagcacaaatgcaggcccattgaaattaggcctgcagaacaagcccctgtccgactagtggcccagtccacccagagaggatccgcgaattcggcccggcccataaacccaacagtgttactggatcggatatcttacctctgttgggccaagcgggcccacagcgttaacgccattgtttttgccgggttaggattatgagcagaaacgaaaagaaaaaaaatatttttttactccgtttaatattacaatagagtagtccgtactaattacagcgatgaaaagtcgcctcggacgtccgatcggagcgctaacatcggacgcgtaattagccgtaagatatccatccaataactgatagcaaatcaacaaattcagggggaaatgggaaaacaattctccatgtgttgagaatgtacagtacatgttcgggttggagatgtagcagactgatcgaactatttgatgcaagtgcaaggctagactgattaattagctagactgattgcaaggctagtatattaattagttagttagttaattaattatgctggccaagaaacgcaggccatgcatttctgcaggctgttctaattaattagccagtgcaacagcccaatcattccaaatgacgaccaatagttaatcaaatccaatcccaacttaatcaacgaattgatttcatacaagtgcctacccgtccatccacatccacaccatgttatgtagtattgaagtattctagtattttagataagcctatctatgagcatattaaagtcacataagttctttttttaataatatatcgaaatggtttatatatgtgacctatgccgttaagcggacaaccaataaattctaacagaaaagaaagcataaggtgttaggatatccatcttcctctaaattataacccagttaaaataacaataaaaagactacatagatttatttaagccacacttgattttatctcgtttttcgttaacacgtttttaaattgctaaacggtgtatttcgtgtaaaaaaattatatagaagttgctttaaactactatataactctatttaatttcataccctaattaaaactcaattaaaattaattagttatatgttaatggtttttgttttccgtactttgattctatctttatattggtagaaactagcacgcgttgattaagggtgtgtttggatggaggatatgcatgggtggatagaacatggcggcccattttctgtgggtgtttggttgctgggcaggggtgggatagggcggcccagagaggaatattccccccagatgctggagcggctgggcgagctgggtgagcgagtcgtgtcaccccgggcgagcgagcgagggaggcggtcgcctgggcccgacgacgacgacgacgacggtgcgggcggcgtcggcgggaggaggcggcggcgcctacagccggcgggaggcggcggctggcaggaggaggcggtggccggcgggaggaggcggccgccggcgacgcctgccggtgacaacgacgatgcggactcgacgatgacgcggactcgacgacgacgacggtgcgggcggcgtcggcgggaggaggcggcggtgcctacagccggcgggaggcggcggctggcaggaggaggcggcggccggcaggaggaggcggctggcgggaggaggcggccgccggcgacgcctgccggtgccaacgacgatgcggactcgacgatgacgcggactcgatgacgacgacggtgcgggcggcgtcggcgggaggaggcggcggcggcagtgagccctagatctattgctttttttctttttttatatgtgtatttataatatggagaggaagtggtgtaaaattgctacagaatttataaaatgcatgcattatgcattaatttgatgggggtatattcactatctcaagtgagaggtgtccacacctacaaatccaacctactccctccaaccaaacaaaaaattggatcaccaaatccaccttcatccctacaaccaaacaaaaaactggatcgccatattcattctaccaaacaaaaaactggatcgccatatccaacaaaatatagaccgccatatcccatccaacattgaccgtgaaccaaacacaccctaattgattcaccaatcgatctagataactatagtagctggaataataagtttcagttaatcgatctagataactgattcaccaatcgatcatcagtacggcatgtgtgtgtacgtgtacctgcatatatcttctagatggatcaacgttcagttcgaaagaaagaagaaacttcctgaaaaagatacgtgttccatgaccaaaccaaagctagctagaagcctagaagcaactgatcatcgagcaagatcagatatctgatatgatgagaagtaagaacacgtaaaacttaattttacccaaaaaaaaactacgtagattggttttcaattacttaaaatctaaaaaatagattcatatgatatattaaagcaatttctgtatgaaaagtattcatgtactagcaaacataaaagaacagtataattcatacacgtacgttaattattactcggaggtgtgaacaggagtgaagacacgcgtgcacaccagggacttccatgcatgcatggagaattatatttgagtggattttgaccttaattttagacctgattaactagtgctaattcatgacttcgttcatccacattgccggatccagaaaattaatttgtcggtgtcataacgtgtttattgatatcatattatgattaatattatgattagatcatagtgttactccctccttccctaaatttgacgccattgacttttttaaatatgtttgaccattcttcttattcaaaaacttttttaaaatgtgtaaaactatatgtatacataaaagtatatttaacaataaatcaaatgataaaaaaattaataattatttaaatttttttaataagacgaacggtcaaatatttttaaaaaagtcaacggcgtcaaacattttaggatggagaaagtataatatatggataaatagttttgctataggttttgtcaaaaattaccggtgtcaggtgacaccggtcgtagatccgcccctgttcatctagcattccagctcatgagcaatatgagtagtagctagctagctagctagccttttaaatttcatgagaagtttagcagagtactagcaagcttcgtagattgttccttgtttaaatttgttcatattatcacgagacttccatgcacgtacgcacggagaatcccttagctatccagtgctcaactgctcatgtttgagtggattttgacttaattttagacagattactgctgacttaattacgtgttttgactcgccaccgatccacagattgagcaagctaagcccagctaattaactagtggctttttactactgctaatttctttacgagagcaggtacaataagtagactattggccagctgtaaacatattttagcgagataaaagatgagagagaaaagcagcagactacagatctatatagccagctacagcgcgggctccaagacacaatgtgtgtatgacaggtgggaccatatataatagtatagtaagcaactattgtatgaattaactattagattgtctataaatgaattggagctggtagtgggctatactattaaacttgctctgagagccatgctagcaagcttcccagagtgttcctagagtctttaatttttcttcagttaattcaggtgttgaccacgttacctaggagaagtaatttaattagtgccataacttactaaccaagcatatgcttatagataatgtctttttcaactcgtgacagttgttagttacctagagttttcctgcaacctagccaacaggttggtcaaacaacaaccacgttttgatcaactaaattctcctccacgtcacacccaaattctacatgataaaaagtgtatagtaaagcacatgtacacataacatgcattatcccgctaattataaagtataactttattctataggtgataaaaacgtgcacactaactgtacagcaattaattagtattgtgacaacagtattaattcagtacttgatcatcgatcgacttaattagaacaaatatcataattctgttgctgtactgacacgtacacggcctctgaatttaatcatctcaagcaagcaacctagccagccagctattaatcgtttccttccaagttacagtatctcaagaggttgtaggtaattaagctacgaaaccagttaacctataatgactagtattatcaagacactttgtatatcgatcataaaacatacacgtgctaaaaatgatttggtcagtcttagagtagataagatgtgcacacaagctagctaagtgatcactgattggtagtagcatcacacggcaagcaacagctatctctgatcgatctcttaactccaactactacctatcacagaattaactatagctatttaattatttagctatagctgagcaaccaagaattaattaacaaaaaaattaaatacatatgcgtatttttcttatacatgtattttacatattgtatatatatacataaattaaaccaattcaaccaatgaaagaattgatctgtaactcctatatccaattaaaccaaatctagctaacaggggattaattacaagatacaaatgatagatgaacaaacaatggctatatacacaaactaatcatcattcctaagactaatcaccaaattaagaaagtaattaacagaaaaaactatgggtttaatttaatggaattttatggctaaaattaaacaaatcttgtgggcttggctagctatgccgggatcatgagcctgggcttcttgaaggcgagagggctgagcacctcgtcgtcctccgccgcgcaccgctggtcggcggcggcggcgacgtccggcagcgccggcaggttgaggtcgaagccccggctcgccgccaccgccacggtcgtcttcgccgccggcttggacgcgccggcgccggcggcgctgccgatcgtgccgtcgtagtggcatcgcttgtggccgcccagcgcctgccccgtcgggaacgccttgccgcacacgttgcactcgtgcgccctcccgccgccgccgccggagacgcccgacgccgacgaggacggcgtcgcgatagccgccggtttcgtctccaccaccacctcgtcgtcgtcgaccatggcgggcggcggcggcttccggtggctggccttgtggccgccgagagcctggtaggacgcgaacgccttgccgcagacggagcaccggtgctccaccgccgccgccgccgccgacgccgacgccgccacgtcgtcgccgtcgcgtcgcccgcgcgccagcatgaggaggcagagcgcgaggtactcctcctcggagggcggcagctgcggtcgccgccgccgcgaccgcttccgcttcccccacccctccacctgtcctcctcctcctccgccgccgccgccgccgccgtgcgtgacgatcacctccgcctcctcctcactactacttctcgacgcctcaagaaccgcctccaccgccatggccactagtagcttaattagctaagcttggagatgatcacaactatcttaattaattgggtttcttgagcttgcaagggaaagagaagtgcacaagaaaaatggaaggagaagagagaaatggagaagaggagtggtgagtagaattgaagagtaggggaagagtgtggggtttatatgaggaggacaagtactcctactagaaacatatactcctacatggagagagatggagtggagtcttggggtcaaacaccgagaaaaatatatggatcaacatggatgaattagagatttataatcaagtctgtggatgattgattatgtgttgctaaataccctactaagctagcttgcttagtactacatgcatggttgggattcattagttattgattattctactagcaagattattctagaagagaagagagtgtagtactgtagtgtgtgcatggtgcaaaatactcccccgtctttaatatagtaatctagtaccggatggaacacttcatagtacaatgaatctggataggaagcatgtctaaattcgttgtactatgaaatgtctcgtcctgtattagattgctatattataggaccggatggagtatttattacttgttgtattaattaattaattaattgtgttggtgtagaggagctaattgagctagtccacaggatggaaaattaagcgtggaatgatccaatggaatggtctgggcagcagaggcggcgaccggtgccaactgccaaactgtattgtacttgtgctactgtactagtgtgatccatgtagtagtagtagcttccaaatggatatggctgtcaggctggagtgacgtgtacactacgtgcatgctgatccatcagaaattctattttcacaaggcaattttcctaccttagttttggttcttgttttccatgcttacgtcacacttcaaaactgctaaacgatacgttttcttaaaaaaaaattataggaaaagttgttttaaaaatcgtaatattttattttctatataaaattagctaatacttaattaatatcctaataaatcactttgttttacgtgcgagagattagtttcaactcatcggaccaaacacagccttaattttgcgtaccaccggtgtgcatgtgttaaataaaggtgattaactagttatgctatgagattgaataaaaattattatactaactaatctactttctccgtcataaaatattctatctagacgatggccaaaacatcttacgacgaaggtagatactacctccgtcccgatataagtgcagttgtaggtttctatatccaacgtttgatcgttcgtcttattttaaataatataatttttttaaaaaagtcacacataaagtactattcagttttatcatctaataacaataaaaatattaaccacacatactccctctgtcaaaaaaaaattaaatataggatttgatgtggcatattatagtacaatgaatttagacagatgtatgttcagattcattatactagaatgtgtcacatccagtattagttggttttttatggacggagggagtaaagtagtgcatatcactgcagtacacattgaccatagtgtccacgtggagggtaacgatcgataagccaggcgccacggcagcatgcaacgtcagcaaagtggccagctcacacctaacagctgacgtcagcaagaatgcccggccggcgccttctccggtctccacctgcggcctccgctagccgccacctggagtcaacctgtgccagccacctcagcatttcatggctgggtaatatacaggactccctctgtcccaaaaaaacgaatctagtgctagatgtaatatattccattataataaatctgaacaaaggtatatctaaatttgttgtattaggatgtgtcatatctagtactaaaataattttttataggacggagggagtagggcatagctacacgcctaagtaaaaatagaattataactactcccttctcttcaaattagtcatagttctagatttatcctaagtcaaattatgattatctttaaacaaaatatgaattatatattatagaagtattttttcctataaatcctacgaggtagttaagctatatgaatttatgaaaattgataatcaaagattacctaaaacgatagctaatttgaaacggagggagtaacatgtatgatatactagtttctctattttttctcctcctctctctctaaactatgtagtatatttagtgtacttatcttagagtactatgtgtagatctagctttgtatatttttcctctctctctaaactagctagtactctatccgtttctaaatatttgataccgttgactttttagcacatgtttgaccattcctcttattcgaaaacttttgtgaaatatctaaaactatatgtatacatataagtatatttaacaatgaatcaaatgataggaaaagaattaataattacttaaattttttgaataatacgaacggtcaaacaaaattaaaaaaagtcaatagtgtcaaatatttagaaacggatggagtatgtatttagtatatttagcttgggggatgtgtaaatctagctattgtacgaaaaccaacaattcttttacttggtctcttctccaaatatgcttgcagccctggaatatgtgcatcgtttaaatgctatatacacacaacaaactatataaaaagtatagaaaatgaaaaaattggtgtagcaactgatgagtacatgtccacacgtatacgcgtacatgtacttattattcttcgcggccaagcaactgagctcacttgagtatacgtacacatgacgaagctcgctagaattgtctacatctcagtacgtaaaagtcatgaaaaatatttctcgaatacgagtctaatggataagcaactctcttaattcaattgtcaatgaaaagttgcaaagtttaatcttaaaccccatcattggtgtggtcgttgtagatttgtaatcttaaacccgaaagaaaggtctaaattaatcatgatctcccataaatatgctttgtttgcgtttttaattagtgacacatgctttgtagctaataaataaacataatgcgcgagttgaacctagcttagcttacatccacttcaagttttgaacctaaaacgagttttcacattacgattaattgttttttaatggtaggcaacgatgtatcaacgagatgtacatctatcacagatatatgtctatgatgattttattaagtttaagatatgtcggtttagttttcggaagatattcataagttagcgttggatgagtgcgcttatacaagtaccgtgtttcgaagaaaaagatgcgcttaatcagcgtcagttcttgcctcggtgcaaaatgtaggtagcggataaccgtggcccatttctaaagaaaaaagagagaaaactgtggcccaggaacagattgtaaaggaacttaacaagcccaaaccgttagagaaaacccaatgggccggatcagataccaatcaggcctccactagatcacggcccatcagtccagcccaaatttccgggctttataaattgggataagttcattctaggcccctcaatttgtcacccagtctgattttcatccttagtccgaaaaaccggatgcaacgcatccctcagcttataaagccatgcaaacagtattgacccggttttggccgacttgattaggtcttcgtcccatgtggcattaacgtggtgcttacgttgttagagtgcgcagcccgacccaccaaccgtgggccacctaggtcacattgggcctgctccaccacaggcccaaccggagccacaactttaggtcctgggcctacacaaccaaaaagactagtctgatgggtgagaaccgcctccaccttttaagtcgtgctcccccatcaccaattaccgatgtgggactaaacccaacatatgtggcaattctatccggaaaaataataacccgtggggcccatatgtcagttacacacacaaaataataaaaaaatggtggggcccatttagccccacatgccatccctcttctctctatcctatctctctcacttgggcagagcatggtggagcggggcggccaaagcacacgacgggcaagccggagcggccgactggcggagcaaagcggcagcacccggagcaagccggcataggcgagggtcaaggcggcggaggatgacgacaacaacgcaagcgccgcagacaacgtcgacccagacagagtggagaaggtgaccctatcgccgtcactgccagagtcaagggcgtgccaggtaaggtcgtcgtccgttgtacacctcttgtgtcgtcgtcgccgcctagggaggagtccttggccatgtggtcctcctcgccacacttgtagcacgcacagcagcctccttgccgtcgtaccagcctccgcctccatagccgcagtcaccccaaccgtagctgtggtccccgccgttgctgggacggaatccgccgatgacgtcgaaccacatcaccatccctttcaccctctccgacgccatctcacgctctccacctgttggccatggagcgcgcgagctcagcggtgaagatgagcgttgcgtgtgggagaggagcagcgcgaggcgtggccacgggagagaaatgagaggagtggtgcacgatgtagcggcggaagagagaggagcatgcgcgcggcggtggcgggggagagagcgtcgtgcggcagcaagcgggagagaggagaggagcgtgggtggcgcggcggcgggggagagagcgccgtgagggttgccagcctccccacttctccctctctgccatccggtggagagaaggagataaggtagatgtggggtccactattttattttattttatttgactgacatgtgggtcccctatattttgtttaactttttagtttttcaattttgcttttttatttttttcccggatcacattgccacgtaagcgccatgtcaatgccacatgggacgaagaccaagtcaaaaggagacacgtaggcgccacttcatccaaaaccggtgacaataccgtcgagggattttgtttgcaccagttttgtaagttacaggatgagttgtatctggtttttggttaaaggatgaaaatcagactgggcgacaactttaagggacctacactgaacttattcctttttaatttcactagctgcttaaatcaggcccaaaatcaacatattagtcatcaaataaatccactccactagagtcaggctttaattggagtatttcccaaacaggagagaaaaaaggaagtaggaaaggcagattaggccttactattagtttccaaggtacgaaaatgacattttgcgatttgccaacatcaacagattcaacactagaaagaaaatttaaaaaggtgatgctgattggatccctgaaactaaagtttcgtccctgaccatcactaccctgtcacaaggtgattagtgacgactccccaattgtctcaatcgatgcttcttcactctccttttgcttagaccttatccctgagctatcacacattttcacacacacagacacctaccttgtccaaagacaagagtcgtcatcatcatccacatcataatcactttcttaatccttctctgatgagtcaccaatgatttgcacagtagctgtagtgctgtttggtgacgattaatactccctccatactaataaagaaagtcgtttaggataatgtttaagtcaaaccttgggaatataaatcatgaataactcttaagttattgagtttgaaaatgtaaaaattatatatatagatttgtcttgaaaaatacttttataaaagtatacatatatcacttttgaataaatatttttatagaaataagaaaatcaaagttgtgttttggagaccgtgtcgctgtcctaaatgactttctttatgagtatggagggagtaaatatatacaggtgcttaattaatttcatgtatttattttcttaatcttttttcctgtgaagtcgccatcagatggtccattacggtaaccgtgtgtatatatgggtataattgcatcaaaagagtcatgtcatgctttgagcgagcttgatgtgaatgtgatgtgttgctgtacatttgtgccattaattaataaattaaagccagtccaataatctggtcaagagtgtaataaactattggattagtactaattgctgttctccgatgcaataaacaacactaattacttgcccggaatccgatatgcacagtttcatatcactccccagtagtaccaggtcggtgccgactttgccatcctgcaaattgtatcagtattttatcattaaaatttagcactactaatttgttagtagtatatgcttttctgcatattaataattgttcagttgccacagaaaaagaacattttctgaggcagaaaatgcactatttcagaattgaatcatgcttagaaggaacatgccatggtctgtctgctgtgctagcagctgtaccttttgcctcttcatctgcttcattccatagcacataggccaaattttcacaactcatgtgatctgtccaccacaaggttaggtctccctaatcattaaccaaagtgtgacattaattattaaagaaggcagttcataatcaaagtgatttgtgagcaaatgtagtgccaggatcatgggatcctgacaaacacagttttttttttcatcagtctataacggtgtcattatttttttgtgtgtcaatcaagcaaaaaccttttctctgaacagtaaagtatgcagcaagtcgtcaacggagtatagtactagtagtagtgacagtagtactacctgaaagctcatgcttaagttgccagggaagaatagtaaacagcaatctccccatgtgatgatccttctacaacaaaaaaattctttttttctgcatgatgctatgatgatctttgaaaagattggagtagtagtgtcatgcactacacagggattacattacaagttgaggggg

SEQ ID NO: 82025 - DNA, 2900 bp, Oryza sativa
gcggatgtagcctgtattgtaggagtagtttacaacttttcgttgcttctttgcacctcgcaccctgatacaagcaacttcttttttttggacattttggttggtcacttttaaaatctgacaattaaggatttatcacgcgctatctataatatatggatcctcatgtgtatatgatagatgggtccagtaataaatcatttatcaccgtttataagagtggcaaataggtaattattcttttttttccatggccacaacaaaaagatgggtttgtccttgtactagtactaaactctcatgattaattctctattaatttgaggccaactgtactaacaagttatattatagaagtcttgccaacaaaaattcatatctcaactatttgatttattcattttgaagttctgataaattaagatgaatttttttaagggtcaccactcacgaggaggagaggttccccttctgaattatcgttagtaaatacttgaaacaatatgtataacagatgaaaccaaaccaaagaaaagaaattaaaactaagatcaaatcatagtgtaccacgccaatttttatgaagagtctgaccagtctaattttttttaaaaggggctgttcagattgtaatcaaaataaaccttaccaaattttagtaaatttgcaatattaccaaaattttaatatgatttcttatgtatttattaaagtttggcaataaactaaatgtaggcatttttttagcaactttacccaaaaaattgtatatttgaaaatggcatcaatctgaataggcacgaagagtctctaagaaagttttcgtgtgtgtatcattttctatttgagatagagcagcggctttctataataacaacaatttattaggccaaactaagggggtgttatcccaccctaaaatcttacaccccgtcacatcgaacgtttgaacacctgtatgaagtattaaatataggcggaaaaataactaattacgcagattgcaaccaatctgcaagacgaatcttttaagcctaattgcttcatgatttgacaatatggtgctatagtaaatatttgctaatgaaggattatttaggcttaataaatttatctgtgtgtccgtatatccgatgtgacacgcaaaaacttttcacccctaatctagacacaacctaaagcttcgaaaaatacgtgtaaattcccagaatgacgtaaccagatattactctaccatatcgactgcgtcatcgctgatccatagagaggaaaaaaaaacttgtgccatttgaggcgcaacttagcaagacgtcgtcttggttagttggttgccttggagacaaagcataaatgcataatcagtataggagcaaatcgttttaaaaaaaaactataggagcaaatcgcgattaaggaggtgtttagatggggctaaaactttttagcccatgtcacatcgaatgtttggacgctaatttggagtattaaacatagactagtaaaaaaactaattttataaatgagagctaatccgcgagacgaattttttaagcctaattaatccataattatcaaaagtttactgtagcatcacattgttaaaatcatggcgtaattagactcaaaagattcgtcttgcgaattagtccaaggttatggaatgagttttataattagtgtatgtttaatactctaaattagtgtctaaacatccgatgtgacagggacttaaaataagtccctgtaaaccaaacaggccctaaatagaatcttgggggtgcaaattggcaaccccacttcttcccggaggtgcatatatccgagacgctcagcttctcgaagcacacgtcgcgtcccaccacgtctctctctcctactgttttctcacccaaagatccgattttcaccaactaaacccgctccgatcaacggcgcagccaagccggcgcgcgttccaggcaatggccgtcgagacggacacggcgagggcggcggtgtcgtccgagacggcgccgatgtcgccgcaggccgaggcggcgccgcgcgccgccacggcgcgccgcgggaactggctgcggcgcctcataccgcgggactacctgtcgctcagccggcgctggaagctgggcggcggcgccttcgccgcgcccggcggcggcgcggcgtcgaggaggctggcgtcgctgtcgcggtcgctccggtggaagcggcggctcccggggttctccctgaccctgcggagcggctcggcgtcggcggtggtcgacgcggttgcgttccgcgtcatgtacgtcgtggaggccgtcgtgctcggcctcgcgctctcctgcttcttcctctgctgcggctgccacctctaacctctcctctcttcacaccacgccataatcgggcgtgcaacagctgcaaccatcttaattttccctgcttttttttttcttttttgttcttctcttgatgcttccgctgtaaatttctactacctacctttcggtgctaagattgaaatttgcaatctgcaaactgcaattcgtattttcttctctttggatgatgcaatgcaagagatggatggcgtgtggggacttctgatcggaaaacccaatgaaatgatttatttgtcgctgtctcgtgtaagagtagaaaatgcgacagctttgggtacacttggggaggtagaggagtagagagtggaggtggtcatggaggtggacgtggcggcgtttgggttccctgctccggtgaggccgggggcgacgcgggtggggtgggtgggcatcggcgtcatgggtggcgccatggccgcgcgcctcctcccccctgggttcgcggtgaccgcgtacgcgcggacgccggccaaggcggaggccctagtcgctgccggcgcgagcctcgcgggc

SEQ ID NO: 82026 - DNA, 9645 bp, Oryza sativa
cgaggcgctggcgttcgccaacgcggcggggctcgacgcgccgctgttcctcgacgcggtgtccaagggcgcggcgggttcgcgcgtcatggacatcttcggcgagcgcatgctgcgccgtgagttcgcgtccggtggctccgtgaagtacatcatcaaggaccttggcatggcgctggagaccgaggaggggccggagggggccaaggcgctgccaggggcggcgatgttccggcagatgttctccgcgatggcggcgaacggcgacggcgacctgagcctccagggattgatcaccgtagtcgaacgcctgaacggcattcgcaagtaaggaaggtgttcgtcagaatgccgcactgggaacgaaacgcttctgtatgttagacttaatcttgttgtttattgtgtgagttgtgattagtgcgtgcatgagttagcttgatcaagaaaatccatgatctgcatgtaagtgcttgcatgtaggaagttatatgtggatatcggctgggagtagtggccgagtcaagtagctggagtagtggcatggattgtggatcagttagctgtgttgcatgtgtgttagtgcatttgcatgcaaagagatatggccttcatgcatagagacgtgattagtggttaattagtggctaagtcatgtgagtggtggccggttagtgcggcaaaaacgtggctagtgtgctgctgcgcgtgtgtgctatttaagcatgtaatcagtgtgtgattaatgtgtggagaatagaaagtgaagtgtgtggtggttcactggtgtgcagtgacaagaaatttccttgcgtctctttgtttcattgcgtgctgttcatcttcttcctctgtcattgcctcctctgtatgtgtgtgtttcatcgagtgaaagagagagagagagagagagctgtgcgtgtgcaagtgagtgtttgggctaacactgtattcttatttcttaataaaacttgatgattgttctgtattcttatttctgaacaaaattcgatgcccatctctctgtaacagcatgaacttcaagggttcactcagctgattgaaagtgttattttactcatgcttgctgatgtaacctcagttatccgagctaagtgtgttataatctgatggattaacatatggagtacttggtcactaaccttatctcctgacagaaactctctgcacaaaaatatctccaagagaggtgcatactagagaagcaccttaactaagctcagaattgtgccaaactgccaatgctacactaatctgacagatgaggaccagtttgcaaaggctgagaactgagaggggctttgctgatgagctgctgctatagagaggatttttcaggtgtcagatatttgcacaggcgaagataacatatgtacggtcttttcttgtgtagtgcaatcttatctctttccctccaagaaacacttcagcagaggagcaacaatggcggcggcagggtcgctgggacttctccaggcgccatcgtccttcacggcggcagcggcgagccggccggcttctcggcgagcaccgcgagctctgttcgccgtgagagcctcggctgccgccgatgccaccaaggacgccgtcctcaaggccttccgagagaagagagctctcaaggtatcactcttatgaatcccagttcttgttgatgccttagctctgccaatgcaatgtttaactgcattaagttctgaatgctactccatgtctgaaggctgaagtgtagatgtagctgtctctggattttgaggcctaacagtataaaaataatgttgcttagattgctggaatctgatattcattgacatctttgcactgcagatcatttcagggcttcagaatttcgacaggagtagtgttgcctctgttgtctcggctgcagataaggtgtggatattgcatttatcttgcttatttttttggtttggttctttgcatgtggataaagtgtttgtaccaattacgttctaggagtagctttgcaggcttatctgaaaaactgaaatcatgtcaacgacaaaaacaatgtattgcgtggctatcatgaaatccatccctgaatatagtaatactagtattcatttttacccagtcaacacagtaatgttgagttgcctactgatgtgctccgtagctataaataatttgggcttatgtcactcctgattttctcgacaaagaagtctacaagcaaacggcactgcagtctagtgcagacgacctgttgtttagctgataattagagtcataattttagcgcacagcatttactatgatatatcaatgaaagttcgctgcatcacccaagtatgctctttgaagtcatacaacttccacaaaatcagtaagcagccattaatttttgaactaaggcaaccaatattgccatctcattctcttctccaacagtcaaaatattttctaaatatttgcagaaatctctgtatgaagtttgttaataagttaggtaactttcaactagaacagccaaattttggagggaattacacatttgtaatgctattcagctattttatgatttcagggaggtgccacccatgttgatatagcgtgtgaccaagacttagtaaagcttgctctggagcttacttcccttccggtgagcaaagcgttcatgtagctatcctacattatccaactgtggggttagctattctaaatgcattgtgggaattgcttgttgcagatttgtgtctcctccgtagatccttcagcattccgttctgcggtagaagctggagcaaagatggtcaggctctaagttttgataagaagtatatgaatccgaaagaactaatttccagtagttccttccgctcacaagcttttctccatgcagattgagattggaaactatgattctttttatgacacaggcatcgaattctcttctgagaaggtaaattcgttctctttgattatatgagtagtcagttatgataatgcatctgtttactgcagttatacacgatttgtttctgagaagaactgctcatcatttcagatcttaaagctgaccaaggagacaagggaaatgcttccagatataacactgtccgtaacagttccacatacactgagcctcctagatcaggtataccacttgtcatctcttcaacaatactctgaaatggtaaataaccaattgtttaatctggaaacgtttatgcataattacaggtaagacttgcagagctactcgaagaggaaggcgctgatatcatccaaactgaaggagggaagtgttctagtccaacaaagcctggagtgcttggattaattgaaaaggtatggcaaaaattacagaaaaagaaagacctcacaatcaaatttagtatacaatgtaaactcataaatactgtttaacaaattcaggcaacaccaactttggccgctgcatactccatctctcgggctgtcacaattccagtgatgtgtgcatctgggctaagctcagtgactgcaccaatggcagtaactgcaggagctgccggtgtggtatgtatccgtctctgaaactctgcagaatggttgagtaatcttcaggcatcacgaactttgtagcccaataatctatagcttactagttcatgtgttatttcatgtttcaaacatttgattatagttggcttttcttgtgattgcagggagttggttctgctgtcaacaaacttaacgacatcgtcgcaatggtcgctgaggtgaaaagtattgctgaagcattgggtttgccttcacggaacgtgtctagcaacttgagaacagttcaccattaggggctagttacctcctcttctagacaaactctagcgatcaataatattatcaaaagatgcagtagcttgacatttcacagtctactgcctttcgtaacatatatgcaaagcaatgcagaggtgccaattggcgttttcgacggttgtaatgtagctttggccagtggcgttgttgaactgagatcaagtttcagctgcaatcaattgtcagattgtcacatctttcccatgcaatttttttgcatcatgtccgtgtaaattgtcagatattccccttgcaatcttgtatatcaatgcctatgtaaatgcatgtggtgggtaaatccacattacttcacacgatatgcaacttaagcagaagctattttagaataagacatagaagagaaaatcaagatcgaaatacaacagggactccgtggcccaatggataaggagctggtctacggaaccagagattctgggttggatccccagcggagtcgaatcattccctgttttttactgcaactttccctgttttaactgttcatgtctatcaggtcaatttcttatctactttgatcctaaatttttttttgcccatgggttaggatcccagttggtgtaacattgcttatcagccgtcatcgcaggaaacaaccaaccatagcccagaggatatgggctacagtcaatagaactaaataccatgtccctggcgacatttggaacctatatactgctagtagctgacaatagcattcccatgaccaatttttcgaggtatagtttagacctctcactttgtcattcagaactagattatggactcgactgtcagctagacaagtctcggaggcttgtatgctagcatctttcagcaacaccgagccaccaaaagatgcagtttattcaggaaagcagaaatactggagtagtacatgattacacgcgcgagcgcaacaacatctcgtgcccaagaatcctgcaggctatcgacgcttgttgccggtggcgatctcccaagcttgcaggatgtggttcacaatttcctccacgccgactccatgtttcacctggaagcagtgtaaaataagcatgtgtaaatatggagctatgtcccttgcaattatcatcagcttctgttaattttcccccgctaaaaaaggaacaaatgtgtatggtttaatactgaacctgtgcaaagacaaaaggccctccttcccgcatgcgaagcgcatctcgttccattacagccaggtcagctccaactgctggtgcaaggtctgtcttgtttattatctgtgttcagaaagattgaaattgatcaaatggtaaatgcaaaagggtacaagcatatcagaaatatcaacgtctttgatacaggtatgcatcgtaacagaatggagaaagtaataacacaccaaaagatctgcttgggttatcccagggccaccttttcttggtattttgtccccaccagaaacatcgatgatgtagattatgtagtctgccagttccctgctgaagttggcagccaagttatctgcacaagtgtcagtatttcttttagcacttcattttggatttagcataacaatgccttccaaaataaacagataatacagttctgtctgtagcaggatgccaggatggtttgcaaaagcatacatgataaaaagaatagagaagtgcttccaatgttgggattcagagagttaaatacctcctccagattcacagaggagtaaatcagctttgcacaagtttgatagttcttccagaggacctagatttatgctgatgtcctcacgtattgcagcgtgagggcagcctccagtttcgactgcacggatgcgctcttcaggcagtgctccatgtttgatcaagaattctccatcctcttttgtgaatatatcatttgtaacctgcaagagcaaagagcaaagagacaaaagtccaagcatgagttcaagaaaacatggttgagactactaggttgatatgttaaaaaagaacagtatcacaagaatgatagatccttgtctttcgatatcagcccgctggaaagcgttgaatgataccaacaaacttttttgttgaattattggaagcgtgttgtacaagaatttactttacgaattaccatttacaaataagcaagaggcgaatcaagaaaagttccattcttgattgaatacaatcaaatgataagatggtgcttgcaaaagatctgaaacccaacaagcatgtagtgataaggaagagtaaaagaatcttgccacataccgctgcgagactatatttttcacgcagggacctgcaaagtgctagcatcagggcagttttcctgtacagcagaaaaaacatttttagggatcaaatatcacttatgctaatttcgcaagttacaacacacacacaagcaatgctttatggttgttatacttgttttatcaatagaagggaacatgcaaaattgcaaacgcttttgctccaaactaaccaggatcaactcacagaacaaatcctaggaagcttatgctaccgacttactgttctattatagatttgtagaaacacaattctgaaagcaagaatagaaaaactgattttgatgtacaagagaggtgcctttttagcaagaaaaggtatgatgtacaagaaggtgcctttttagcaagcaagtttacaagaataccgaaaactacaacccagattaccacaccaataatcactatttttcttctggcactgtggcacaacgattacattccgacattcgcaaacacattttgtcaaaagcaattgaagcaactaaatctgcgtgaagaagtaaacttatttatcgccaaagatatgcatacacctaaatctctccaaagtccaaactagatcaatcaagccctgtgcgctgaaattctcagtttctcaccaatcctacccatgggaaagatgcacaatttcagagaataatgcaaagcaggcgccttcctccacctaccatcacaactcacaaccatcaccaaacaggaaagccacgccactgtttgatgatagtacactacactacggggaaagcagagtcgacctgcaggaatgcaagcgaacggccgaacctacccagtgccgacggggccaccgatgccgacggtgaaggcgcgttccgcgaagcgccgcgagatgagcggcggcgcgcgcttggagaaagacgcccgggggagtaagatggggctcgtgggaaagcggcgcgagggccgccgtgcgagtgccacacgcgccccgttcttcccgacccacgagccgccgcccccgccatggctgccgtccctgcaagcgccgagtcaaacaggcagcagggagcgagatcatcagtacaaaccaccagccgaaaaggggggcagatgcccggctgcacgcactggtggtgggaatggtggtggtcgccgtcgtcgtgcctgtggtggtggtggtggtcgtggtcgtggtcgtgagacgccatggattccgaccttgaattgcggcggattcctccgggatgcgggaggttagggatgacgaagccgatagattctctcaacatgttgacctcggctcgttgacctggcccatatttggttgggccttaacgggctttccattttgtgaggcccaataacggaataaggatcacgtgcgggccaaattggttgggccttaacgggctttccattttgcgaggtccaataacggaattggacttacgtgcgggccatattggttgggccggaatgggatttcgatttcgtgcggcccaataacggggttgggcctcacctaggtgtttcttccccaactccggcccgcggaatcctctcctacattggcgccgccgagaattcttcgccgccgacgtgacgccatccgcgcgacggcagaagccacggcggtggttggccgcggcggcgcttttctcaaccgtgaaaagacgcatgtgatcgagcaaggcaaatgtatctgagagcttcttgtactgtacagatgtgagctcctcaacacaagctctctctctctctctctctcaaatcaaagcatttggcgcaaatccgccattgattctgtatcaatttctactgtaatttcactacggcaccacggcgacctccttgtgatcattggcagggtacacgtgctcctccgactgctcgtcgtcgtcgtcgtcgtcgtctccaagtgcggcggcttcttgctgctgctgctgccgcacgacgtggttccacctgtcctggaagaggtagacgaacgccatggccgacacctccacggtgaggagcaccgtccacggcctcacgctcctcccggtcctctcatggtaggtgtgcatgccgatgtagacgttggcgacgcccaccacgcagatcgcgatgccaagaagccagtgggtcaagtaccagatgctcctgaacctcacacctctgaagaaatgaacagcatgttcagacatcaagcttcagagatttagacaaatcaatccattgtataaatggatttcagagatgtgttcttctacctgtctggtctcaagaatccgatgagtggttgaagccaaatgaaaccatacagtgccaatcctattctctggtgtgtgttgttgaaggcgttctcgaagttgcttatcgacagcactgctccggcagttgcaagaatgacagcaacaatctgcaggcatgtgtccaacgcacagttaatttgcacctgatgcatttgtgagaaattaatcaagcaaacgaggatagcgagctaaggttacagacctgtgaagcaacatggcagtagaaaagaatcctgatgctcctggtgcttttcacattgcttgtgactctgattagcagtactcctattggcatcaagaaaccaaccgaagaccagagcaggaaggcatggagcttgagttgaagggagagtttgggtgtgagctgcaagaatagttgatgtgctgcagttagtgattcatcatctactaccagatattcagattgtagtgcagttaaatggaactagaaaattcctcaaaattacatgagaaggaacaattacctccaaaggctggacaatcttgtaactctgatttaaactatcagggctgcttgaagcacactgagttggagtgagaagcgaaagaatcgtacaacaacttcccaacacagcgagaagtctttttcttccaaacagtagcattgatgctagtcaatttagtctcctctcaacagaaaacaacgcaaaggaaagatcaagcagcagaggtgaacctcttcgacaggaaaagagccaactgaaacagcaaatgatggtcctaagctaccaaagacaggagaagaacagctaaaatttcttcatctctctcactatcatctcatgctggtatggaagtcatcccttccttcaaaggtctacctcaccttaaatactggcattacaagcgtattaaagaaatctatcttcactaaagaatgaacaaaaagaacaggaaaaaccaatgccttctaagttctaactctctgcacaatgtggatgtgttccaggataacttctaggcgaacgggaagaatctgccaagcaaattaaagaataagagttgtcatgggggaataacttgagaggggtgtcctatgaatgatttggatatgagcagctgctttctctgcttagcaataatatactatggtggacttttgtgctgttgggggatggaatggaatggaatgagatgggctcttttgatcacattcagcattgcttttacagctctatggtatgatggtataaaggaaggctttttgtggtggtgcagcaggaagca

SEQ ID NO: 82027 - DNA, 670 bp, Oryza sativa
gacttggatctggacataaaaccgaaattctggagccagctgcagcgcctgctgaagagcatgttggcagctgctcgaccggcagcttctgtcggccaggccaacgccagcaacagcagaggagacaccgccaaactaaaagagatgtatcgtctgtcgctcaaatcaacctctctgggccagctgcacgcgttgcacaagatttgggtctcctaacacatctctgttgtacaaacatagacatcagattgctctacaaacgagtgttgtacatgttgattacatcgtcatcagcatctttgagcttgtaacttatgctgtcttttatgtttttatccatttgttatttattttttaaaatctctgggatgacttacatgctgattgtaaatttgcaattgtagtaatagttgtggaatgtgttgtaacttacaaataccatcggcttgcattgtaactttacaacgtggagttgtactgctgcctttgaaatgaaatgctcgttttcttcagaatgtaccacaccatgttcccatagagcccgacaagcataaaaaaaagtttgccatcatgatgctgcaaaagttataaacatcacacggaagagagagcacgcaatggagtatgctggctatcgctgaacaaagcttgctactagatgcttttaaac

SEQ ID NO: 82028 - DNA, 5011 bp, Oryza sativa
agggctccaacaccaactccagcccgtcgcccctcccagtccagccgcactggaacccgtggaccagctagattcaactctggcccaccgcaggtcttcttgggccacgtcctggcgctgtcccacggcctgctgcaccccagtcctacatgaacacaccagggcatgcagcccatgccgttcggcctccaaccaccaacaggtctgcccatgcatgccatgcagcacccgccgccggcgccgatggacttcgctgccccagtgcacgccggcactccgtctactccgacatgggacgccaacagcatcgccaactccctcaatgccatgacgctgcagcagccgtccgaccagtggtacatggacaccagcgccaccgcgcatatgtcatccggctctggtaatatatccatctctgacaagccccctccacacacatgaattgttgttggtaatggtgcttctcttcctgttactgccactggttcccataaaatatccaccctctcccagcctttccacctccacaatatcttggtcacacctcacatcatcaagaacctcatctctggcaccgtcacctcggacatcccggacatcacacacaacatcacctagctggccactccagtattgcgtctagctcaaataaagatagcatgctttgccatgcttgtcaattagggcgacaagttcgcctctcattttcgttgtcttcttcaaagaccactgttgcttttgaaataattcattgtgatgtctggacctcgccgtttccagtgtttctgggttcaaatattatcttctacttttagttgattttactcatcacctatggacgttccccttgcgtttaaaatccgaagtttttcagattctgtccaatttccactctcttgtacgcacccagttctccactgtcctgcgtgccattcagtgtgacaatggtagggaatttgataactcatccatgcaccaatttgctgctactcacggcatccaacttcggttttcctgcccctacacatcgcagcaaaacggcaaggctgaacggatgatacgcaccaccaatgaggtcgtccgttccctgctgttccaagcacatctaccaccaagcttttgggttgaggcactcaccacagctacacacgttctgaacataaactttctccccgttcgacggcttgcgtcttccttggctacccgcccaaccaccgtggttaccgctgcatggatctcgcctctcgccgcgtcatcatctctcggcatgtcgtctttgacgaaaacatgttcccttttgcagctaccaccactgcctcgcctgatgaaacatatgactttcttgatatcctagcagtacctgcaccgccagttgcaacccagccagcagcagccactgccatgctgccgaccgcgccgatcgcacccaacaccaccgctgcataggggtgaaaacggtacggaaacggacggaaacaacctttatcgttttcgttttcattttttttttcggaatcggaatcgaaatcggaaaccccggaaacgaaaacggaaacgaatattatcgaaaccgaaaacggagcaaaaacgaaccggcgcggatacggtaacgaaaatttatcggaatacataaacccctcaaactgagcctcacagcaaaatatattcttctataacttcaaataatttgcataacaaatattctaaaagaatacagcaaaacaaaatggtataagcctataaggtatacacaattcaggtgctatactgctatcagcctatcactccaggaaatgggtttgagaacaacaacagaacatcagtccatcaacacttagttcatcaatcatcacagaacagcaatagttcatcaatcatcacagaacagcaacgcacatcagtccatcagtgtttcagtacatagttcaatcacaaaacacatcaccctataaatacatagttcatcacaaaacatagttcaatcacaaaacacatcagtacatggttcaaacatatctcatccacttgtgcagcaggagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcggtgaggaagagactgcagtggtggtgtcgtcgtcgcctcgtcggtgtggtggttgttccgtcgtcggcggcggtggtggcgacggtgaaacggcgagacgcggtgggacggcgccttgagatggcggggaccgagcagaccggcggaggtgcgagatggtggcggcggccggcggcgaaacgacgaagagcaagggcggcgcgagatggtgggggcgaggacggcgggggccagccggccaggcgaccagcagtgggcggtggggcgccggcgccacgggcggtgggcgtgagggcacgccggcgccgcgatgccgcgatctggacgccgcagccgccgctccgcctccaactcgcgagtcgcgtctgagttctgagtctgacggtctctctcctatagggttagccggttagggtagatgccgccgcgatttgggttgggctgggaagctagggagaattatggactattgaatctatgggatttttaacttcggaaattccgacaatttttccggaatgtttccgatcgtttccgggttccgacggaaactgcttttatcatattcgattccgtttccgagaaaatatttccgttttcgattccgattccgagaaattccgaaaaaattccgaccggccgattccgtttccgaaaacatgaccggaatccggaaaaattccgtactgttttcacccctaccgctgcaccatctgcgctgatcgcacccaacaccactgctgcaccatctactcctacagctgccgcagcacctcgcatgcaaacccggtctcactctggcattcaccgcagcccgcgcgagcggctcaacctccacacttcggtcactgctttgtctcttattcccaagtctgttcgttcaatgttgaatgatcccaattggtatgcagccatggttgaggaatttcaggctctcacctccaacaatacctaggaacttgtctctccaccaccccgagggaatataatcactgggaaatgggttttcaaacacaaattccatcctgatggtttccttgaacgctacaaagcacgatgagttcttcgtggtttctcccaaaaggccggtgttgattttggagaaacttttagccccgtcatcaaacctgccactattcgggccgtcctctctctagcccttacatccaaatggccaatacaccaactggacgttaaaaatgcctttctccatggccatctctcagaaacggtctactgtcgccaacctaccggcttcgtcgacgccaagcaccccgacgtcgtatgttgcctgaatcgttctctctacggcctcaaacaggctccccgggcctggttcgagcgcttcaaagcgtttgttcttggacttggcttcacggcggcaaaatcggattcttcactgttcatctttcggagctctctcggtactgcgtaccttctactgtacgttgatgacataatattgacagcatcaagcgcctctttgctgcaacgcatcatcacagccctcagctcggaattttcaatgaaggacatgggccctctacaccacttcctcggcgtccaagtccaccgcagtggttatacaatgctcctgcatcaggagaaatatgccaccgatctccttgatcgcgccggcatgacgtcgtgcaagccatgctcaactccggtcgacacttcgtccaagttgtcttccgccgtcggcgctgccgttgcagacccgacagcatatcgcagcatggccggagctctccaatatctgacattcacaaggccagacatagcatatgcagtacaacaaatatgtctacacatgcatgatccacgtgaaggtcacttgaacctggtgaagcgagttcttcgctatatcgaaggtacactttgtcacggcatacttctgtcggcttcgtcgccacacgagctcaccgcttactcggatgccgactgggctgggtgccctgacactcgccgatcgatgtcgggcttctgcgtcttcctcggctccaatttgctgtcttggtctgccaagcgccagcctaccgtctcgcgatcaagtgccgaagctgagtaccgcgccgtcgctaacgcggtcgccgaaacaacctggattcgacaactcctccgcgagcttcatcaaccgcttcaccgagctacggtcgtcttctgcgacagcatctctgccgtctacatgtcagctaatcctgtgcagcaccaacaaacaaaacacattaaacttgatctgcactttgtccgtgagcgcgttgctctcggccaagttcgagttcttcatgtcccgtcgtccgcctagttcgtcgacgtcttcaccaaaggactgccgtcgtcgctcttcctcgacttcaggtccagcctcaacgtccgtgaactcccggctgagtctgcgggggtgtgttagcgtactgtacatcttgtatagcatagtagtctgtttgcatggatagatagcagcccaatcaacctaaactacttgtttctagtcatacgtaccgtaccgagtctctcgttcggttgttatgaggctatactctcctgctatatatatatgaatgagatacgccaccaaatgtgtggcttcaccctcaaaccctttcaatatgtatcattaacgataaaaacttaatcactttaaaattaagtttaaaaatttaaatgtatctcataaaagcatccac

SEQ ID NO: 82029 - DNA, 890 bp, Oryza sativa
aaacaaggggctatgccccctctgtcgtaggacaaacgaatcggcaagccacctattcgcccactgtagatacacctgaagaatttgaagcctaatcgtctcctgggtggcataccaacagctgtacccgagccactgggaacaagccatagcgtacgaaaaccagtggaaaatgctgccaacgaaaaaggaagtacccaaaaaaggacttcataccataatcctgttggtcgtttggtgatctggaaggaaaaagaccaacaagttttcaagcacaagaagaccacagctcctagcctcctggcgaaaataaaggaggaagcgagaacatgggctttggcgggagcaaagtggcttcaagtgtttctaccaaatactacatagcctctgtatagctcggtacagcttcctcattgacggagcgtggggctcctcaccgggagaccgcgcaggcccccctttgccggttcggccggggacgctgagtgaggttcttcgccctcgatctgaggaaagtcagcgggagaggaagtgcacaagacacgggtgacgtagacagattcgggccgctgagaagcgtaacaccctactcctgtgttctggtggatctgtgcgtgaaggaatacagagaaccggagagcgagagtgagttcaggctctcgcccctcttccccagagtcccaaccccctttctcctaggcctgggcctcctttttatctggtcaggggtcaccacatgggcctctagttgcctaagaagggaaacatgctttttacaatgagggctagtctacagccggaaatgacctctgacaagcagagcacacgcctcctgccccgctcgcccgctttcccggtgacgcacatttcaaccttcatttaatggccag

SEQ ID NO: 82030 - DNA, 561 bp, Oryza sativa
gctccccctcgccagaccccgcgcgccgccgctcctctctcgccctaccattggccgccgacccaagcgcaccgccgttcctctccctccctcccgtcggccgacgcgcgtcgccgctcctctcgcgttggaggtgcgcccggcatccttggcgaggttgccgccgccgctccgccgcaaggacgagggagagccgagaggaagaaaaggaagagccaagaatggagagggataggggaggggagctggcgatctcaccttgggggacggcgggtgtcacaccccgaagttctcctcccaagcctaaaatttaatttataaatgaccctaagaaaatgccggtgcaaatcaagagaaaaccctaaggaagtaatacaaataataatcgaatttgacatgtggaatttttcttgagttctacatgtcgaaattcactaacaggatttttagtggaattttcagagccctagaaataattttgaccaattaaaattgagcacaagcaatatttaaatccctggaaattcctttcttcctttttcttttttttctttttccttt

SEQ ID NO: 82031 - DNA, 640 bp, Oryza sativa
agtcgagggaggcaaggtagacttattccttactactactatagtacaatacaactatagggccatcaggttaagtcttttccaaagaaaaaggcccatcaccatcaggtaacttactcctcgtccgtccgtgtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacggtacactcttcgatcgcctcgattctttcttccgattcttcgacgaaatcgcattgtatggccacctaatcttacctgtgtccctttctttctgtgttcttcttcttcatgggcgtcaagatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatgtgagtgtatatataatccacaactaatcgg

SEQ ID NO: 82032 - DNA, 2202 bp, Oryza sativa
cagtatactgaactaatccttttccttttcaatctactgaacggaacatgatcagaacagtgtacatgaaacagattcggctatagattaaagagaaaaaaaaccaacatgcataatcagtattcaccggcctatgaagtttacagcaagtagcaagctaaaggctactggattgttcaatctaaaaataaaccaagagaataagttctcttacgaaagagggaaaataaagcgataaagtccaacatgcagaaacgaacacattcacaaaatgagcagcgaggatgtgagtgtgatgtgacgatccaccactcgattcgctaccaaggattgaaaacattggaaaaatcgagtgcgtgcgatgaattcaggcaacggcatatattccgaagcttagctatacatggccaactactcaagaatctcccttcagttgttgcaatcctgcagatacactaccgcctgtgacgttactgaattactgcaacctgttaatctgaagactctgaagtgctactatactataaatttgctgtctgaaattgttaatctgaagcaaagctggatgcgatgtctttctctgttccccagtatatatcaatacggagtactactactttgtgcgccgtcagagattgcaataagctgctttgtttggccgccaattatgcggccaaatgttccgatacgcgtgtgccacacaccctgcatgcgcgcgggatcttcgcattggcgcgccgaaaagcttcgtgattctctatctgattgtcaattagcgctacctgtcctaatctctttcgtgcctaatttcagcctgcactaacactgaaccagattgatttcttcaggccagatatgcatatggttctcttgttaacggctatttgcattagattgtctattctgatttttttcatgattagtaccatgctggtgtagtttttttgtcttcatcttcttatttaaattggtggttcttgtcttcttgatatgtgcgtctaaatgcgacatgaattctttacggagtatatactaagtatatatatgttacagcgactagtgtgctattttaattgtgaattgaatcggtcctatcctaatccttttttaatgcaatctgaacaagtctaagaggtcaattacctggaacatctgtctcgattttggaatttggattactgaacattgaaagaacaaaaaataataattctggagcaacgggtggatgcagctgtttatgctttaaaactgaaggatcatgcaagttcttttctactagatctaccacccaaccactctgctctcccgaactttcttccaacggcacggcagccagccaacgcaagcagcagtagtactgtatctgcttcttttgcacgaacaaatcaaatcagagagccacggaccagccgtttcagaaacttcggtgtcagaaacgcattgggtctgaatttcctgcgaaatttccgtgaagatttaataaccgttcgtcccaacagaaagggtttcaacggaaaattcgagtttttgacacgaaccctcacattgacgacacccacttctagctctcttgacagcgaaacaagcgaaatgaatgaacaagagatggattaattacttaccttgacgacctgaataaaaaaaagaagagcttgggcaatgggcatcgccatcgcatgaggcaaccagcagaggaaaaacgaatccgccgcgagtgcatgtgtggcgtccgctgctagtaccagtatacatctcagtgacaacgtaagccattgctgatttcgctagcagctgcatccgtcgtccatcgaacgcctggctaggccggcctgcaccagctttgcactaagggccctgttcaaatctccaacaaaaattgaataatcttttggatagaagtgacatgcttttcaaactgctaaacggtgtgtttcgtgcgaaaactttatatatgcaagttattctaaaagatcatattaatctattttttaagtttgtaataatcaaaactcaaataatcacatgttattaccatctcgttttacgtaaaatacttaatctttatctttatcttcaggagattcaaacaccatccaagcatcgtcactcctagtctactccgttccggctctgcactgttgttttcaatattttcatcggccaggcaggcaccagcgccattgcgccagccgtgcggcgcgc

SEQ ID NO: 82033 - DNA, 2164 bp, Oryza sativa
actgtgggaattattatagttataatctatttatatgggtttgatatatatatatatatatattaaatttgttaggggcaccatggtgcccgggctccatggccatccaccgtccaaatgctttaggatccgtgcaacgctaatagaggatactatcacatataagcgggtcttacccgataagagttgcatgcatatactttccttagaacatgcatgcgggtatttccatttttgctgtataccgtgcatgtatttccaaatttgcgccctctaatcacgcctacacattttgattagcactttccattttctatatcacatttccataaatacaacgtttgcatgcagatacttacctattgaaacatgattctgtttttgaaaattgacgccattccactaattgcgattattgccatctattttcaaggttatattccattttcaagatacacatataaccggctacagtagtccttttttttatttttcttggccacactgtttcacggtcgaagagctagctatccacctcgtcttcactgagttacctcgccgggattgctcgccccgccgtgaagagggccgacgtccgtggttttcgtcactgacgacgttcgtcacgatcctcttgctggaaaccagacctcctcaaccatttttgtcaagccattacagcgccggacgtccatgtgccttttcactgccgtcgctggttgttcgtgagattcggaacatgcattattcaccagcgagctacattacgtgaaaggtatggtcctcagtttttatcactcacacagtttacattcacatgcagtccctgttatgtatagatgatttgccatttctctttcttttatctactaactgagcacatgatgaatcacctggaacctaaattttagattttttgttgaaatgcagttcaatttagattgtcttaggtatataacgcgtgtgtttgaatatcttggtttgcacatccaatgaacagaatttagctaggtagtgaaacagcagcgatgtcccttgtacatgatcatctcacttctggtgctctctctggttctcgccaacaaccattcgtgttccaggtatgtgctccaacttatctgtacttatatgtacttctcatatatgttgacatcttcatagtattctgaaatttatattaatattgccagtagctatggacaagatgaatggtgcccggagcgagaagatcaatcagtcgctgcagaagtatgatcacccacgctgcagttggcacatattatttggcacgaggtcagaactacacaacttatgcacgcacatatacttaaaatccatggtatagaaaacatatacttggattaatttatattaagttaaatataccgtcagtccaagtaaagcgagttttaaattctaataatatacagtacacagatttaaaatttcgatatacttaagttttacatccggacataacgactaaaatatccttggttccaaatttaattagattccaaatttactatatacaacaatattaaatgacaataataaaatataccgtgtacacaaattgtaaatttagatacacttagattcctaatataattaaattaacgtaactttgtacaagttagctaagtatatagaaaatataatgcgtgtatacatagccattacattattacataaatgagtaaacattttctgaattttgaaagtgcaaaacgcactaatttagctaggtgtacataagcataccatatatatgattccatatatacttatattccaactgcaacgttcatggtgtattataatatctcggtttccatatataattattttcaaaataaccgcgggataacatttccatatatactacatcgtatacgtatactcaggttttcatataccctaataaagttaaatttgagttgttttgttgatagatatatgtatgaatcgaattattataactaggtatatactcacaatttaaaatttttaaaaaatttgagtaattttgtgcatttgaaaccatggtgccccatatgagtgtcctatatatatatatatatatatatacatacatatatacatacatacatatacatacatacatatatatatacatacatatatatatatatatatatat

SEQ ID NO: 82034 - DNA, 1695 bp, Oryza sativa
caccttctatctttataaccattatcttcgtggatgtgtcagtgataacgatgataccattgtctttgcctgtatatatgaaaatttgcaagacatatataaagatggagccgatgtgagctcttagttaatactcccttcgtcccaaaatatagcaacttttattttaatgggatgtatatatatatatattctagtaatacgaatctggacatgcctagatacgtctcatctaaccaaattttgctatgttttaatatagaggaagaacatactacttcctacaatagtaaaggcaataataactctcaaacttaatgtaccaaaatattttttttattaccatttttttcttttgtccacaccttgcaacaaaatttcctttaatagtaaatgctaagaatctactttgagttgttatcatgagtatccatcatgtttcccttttctttcatcttcttcttccacgacaccaaatttgtttgcatgacaacgaagatagtctgttattaaataccgttgtacatgctctgatctatgcgcgttataaatgtccgcgtttgttttgtgtttctaaaaaaaagtctattatagtttatgacgaatgtaatatgtaatgctggtatcttttgctatgacctttgtgaaaagtaaattaatgggaaaaaaagttgggtaaaaacatgatctagaatttccacgagaatattcactttttatcctctcccactctcttttgtgtcgttcacaccacagttacgatgcaccccaaatcaacggaggttttaattagtggaaggtagaaagtaaaaaaaaattgggaggtcaaggtgagtgagacgtgacgtcgtgctcacgtcgtcttacgaacacgacctcttgggcttttcctttttgtgtctgtcatgggctaggcccggcaattagtgcggtccatgggctacaattcctcgcgtagcatgtagttgggctgggcctagggtaaatctgaatgctgcagaatgaaattatagattttcttttcctcttttttttggcaatacatcttcctgatttttgtctctaaaaacaaatatgccttcttatattgttccatctggttggtatcaaagtgtattgagcctttgattataccaaaatatgtcttaccaattaatagtagtatttggcaactaaactagtattagtgtgactggtttggattggagccaagtcatttgtaatgccacagtgctcaatttcgcaacacactgtaactttcttcaccatatcaagcatactggtagagaaccaaacatagagagtatttcatatgagctgtatcttactaaaaagaaaaagtaataatatcaaaatttatctagattttgacaccactataaaaatgacccaatatcacatcacacattacacagtccatgaaattcacaaaggattgtctttgcctctttgaggtggcatgttcttccacgaggtatctgcacatgaacagaacagtgccaacacagttcctgcttgtgctctggttgatcagacaatgagcatactgtgtactccatgtcatacatcggattaatcaagacagtttatagctcttccagccgctataaattatactagtgatggagaaaatagcaccaacactactgtttagatgtgttttcatttttaatgcatggaactcagaacgcaaca

SEQ ID NO: 82035 - DNA, 2205 bp, Oryza sativa
acgtaccaaccaactaaacattaattgcacctggtgaaagaagtcaagaaatgaagaacaagagatcaccttgagaagtccaggacgttcctgtagatggtccaaaattgttcaaagacgaatagtcaggcgaccccttcatgtcattcatctacaagtatttttcagatgattcagcttgcaaaattgtggccagtgtagttaagttgtcaaaacataattgtaattaacattgttctattatgtcaggtacccagctaggagaagccgcactccctgtcgggctatcccaacctatgtgcgtgacatgcttgacgtcggttggataaccaatctccatttggtgttccttcaccactgcaagatggtttaagcaagatcaagaaagaaattaggttgtgcaaatcaaatgaactgactattcatgccttgtgtaacattgtagaaaagaaagtaaaatctacttgatggtcacataccgaagatctgagagatgaccttgaggcccttgaaaacccctttcatcttgtacgccattggtagatgttgttcacaaccagaatcccactggaaacagaagacaagaagcaaaggttagcaatgagctctggtttcacaacagttccattgctgaaagaatatgtatcagccagataattatgatatgttttgtccgatatgattatcgatgaatttacttacctcaagatgttatgatgggaggtgatgatgatgatgttgataccctccttggatgttctcaatggaaggatttggagtaagcaacaggtccatcacctcccattctatttctctagtatggcgtcaggaacatccatgagaagattgtatttgttaggattttatgaaggttggcagctggaatgaagcaaggaaaggaaaatatttgtttttttatggatacatttaatctggcagcaaaatcataacaatgagcaaaatgggtctccagaacttttgagttgtcagaaaatggttataataacagacaaatatgtgcaggctttcctgcctttgccagacaaatgaaaaaaaataaaaatcatatatatgaaaagtattcagaagcaatctaactgtacaagaatacaggtacattggagttccagaccactaagtcttcagctgcatacgtgctgttgtccctaaacacaaagttataataagcatgagatgcagtcacgttaaggacaggcttacaggcttgtgaatcagtcaagaaccgcgtcttgagatgctgctggtaatttgcatagttagacacagctaataatatttggaaagatcagccttgaattagctatcaaagatggataaattgggagatacgcaaacacacaaaaagctaggttgaggatatcaatgtgattcagaaaggatgtaaggggaggtatcaatcattcaaacaattacaaatcacacttttgctgctattaattcctccacaaaatatagttcacttttgctgttatcaattcctccacaaaatatagttgttatgtccctacaaaaatatatagttatgaatcaaattaagaaggttgcatagtgggagactgttgacaatttaggccatgtagatactagtgcaacattccctattcatatatatatatatatatatatatatatatatatatatatatatatatgctctatgtctttatggagttagatatgaaattatccatctttgaaactggtattacggtagtcgattttttagctccttatcagcgtggtagaaaagttggacttttgagggaactggagtaagtaaatgcatagcgcaaagaaatcaaacccaaataaagatgagaaaaataagaaacggttaaagaaaaaaaaactttatcgatctgtgatcctgagacaaaacatgaaattaaggaacatttcatttgcatttgcagctgggtcacataatttcttacaaagtatagttaggacgtatcaatgaaggaagtgaaactggaacatacattataccagatacagctttaccatgttacattcttgagactggatcagattgtgaaggtgaccttatcagtggagctacaaatatgtaggctgcacacaatgtcactgcactgagatgacctttttcctatgttcatacattttagcaaagtataagaaacaggccagggacaaagcattgagcacggtaataagcaagta

SEQ ID NO: 82036 - DNA, 2167 bp, Oryza sativa
tagagatgctgtaacctcagtgtgcagttatctctgtttctttcaaaatgtatccattattaaaataaacataatagcctagatttagattatgatattacatataattacaaaatcccccaatacatcatgctgtatctgatacgtgcagcacagattagaaagtgcataagcactaaatagagcaattttagaatcttaattgtaaagcaatttgcttatccatgggacaagctgagcgtgatgaatgtattcactctcttaactgagatttacaatataaaactggactgccagctatgcatttatccataccgacctctaaaattgcactcacacttgcgttatacacaaaggaagtatcatcctaggaacagaccataggattgtatggacttgtctacatattacatgctagcaggattaaaataggtaaaattttcacatgcaaagaagatatcctttcgagcaaaatcaaagacacaagaacacaccaaagccatcataatacctttggattatattctgcattgcgtgcttgcaaagctatagctttgaggtctaatttgcaatccaaattgaccgtcgacacgatgtttctgccatcaaaatagatgagaacacataatgaggacttcaatttccttggtgagagtatccaaaggaagcatgataagccaaaacagagtggaacacatgcagtctaccagctatgatcccaacgctgaaacataaacaacccagaaaggcagcaaaacaggcatgcgcacttgtgagaacacatggaagcaggtacactatgacaagcagcaatataagcatgctcgactttttctgcaatgcacaccagcatgcaaaatatacatgcctggtagcaatgtaggcaaaccccaaaaacgtttcgatgcacaccagcaagtacagcatgctaataaacagccaggtttgggcatattggcccgtacaaacaagtataaaacttagtggggttatacatggatcaagcctaaatatgtggttcacttgttcagagcttgatgctgtctaaaaacatgcattgacccattgtcaactgtatgtatcacatgagcaccataaactctccacagacacaatacctccctctaaggttgaaatacgtgatgaggggaaagaattaaatcctacaatttagatgcatgattgattgattgattatttatttatttataaaccttaatttttttttaaaaaaaagaacagctgacaagctgattctccaagactccaaccatatgaattcattcatgagaaaacaaacatctgtccagctaaaaagagttgttatgaagaccggacaatggatccgtcacagcacaagcacatcggctgcctctatttcttctcgtaccggactcgcggatctcagatcgcccccctttttcatcaatcaagcaaatcagaacctcaaacatgtagtaaccccccaagctaaacctaccaccaatcacatcatttgcaacaacaaataatatccccggcccccaaaacaaaaccaaatcaacagcgcgcgacgagttaaccgctccacctcaaactcaaccagctcgatgaacccgcacatacagatccgggcgggggcgggggggacttactggagcgtggggatgatgccggaggggtgcttgaccaggtccacgggctcgctcccctccagcgccgccgccgcctccgccgccgcctccgccgccgccatacacacccccaaaaaccagatccgcaccccacgaatcaatcccaccggtgaagaagaaggaaaaaaaaagggcgggaagagagcgcgcgcgcgaagggggagggggagggaaaaatttcgaaatcctaggtcttttatatagcgatcggaaatcggaagcgggagagggggggagagctagggttatcgcgaggagaggatgaggaggggaggggaggggagaaggtcgcggcgagatgtggatgcggatgggtggggtggggtggggcccagcggatgggtggacggggtgcggccggtcggcggtcgaggtcacctgctgcagccggtggccgtgtggcattttgtttttttttggtttctttttaaacctctttttatttttaggttttcttttcaaacctggaaaaaaaatgatagtagtatatttct

SEQ ID NO: 82037 - DNA, 9311 bp, Oryza sativa
ccacctgagcccgcggaacacgcacccaccctctcgatggttcgtgggcccaccatacactcgccattacgatgacacgtggagcccacccagaggccaaatacgtagttttttctctggttcatttatactattcattccaaaatataataaaatataagtcatttttttaatgcttgctttctctattaaagtattatttattgaatcatctactcaagatatttaattctattagatacgtgcattatactatactcctcccaaaacataacaattttcggtgatatggccgttcactcgaaaattattatatttttagttggagaagtatttattagtgtgatcaataattatgtttttttaggttttagtatattttgtaatgtagggacgtactgtacttttttattttacgcggctgatttattgcatgcagtattattatgagactgatttattacagtaataataataattgcttgcgctctctctgactgaaacgtgggcccccatttgtgcagagcgacgcggcgcgagggtacagcgcggtgggaggaggcgcggccctgctgctgatgctgctgctgtggctgacggtgggcccggccttcgtctgagccggtgggggccacctgtcagagagccactgccgctgttactgtcacagtgtcactaccgatcattgcttctgtagagagagagagagagaggtgtagagtttgagagagacgctttgatagtgtcagtattattagtgcaactgctgcggctacttttgcctgagcttgtatgctagtagtattaatacttgctacagtagtattgtgttttggagtattacctgcattgatctgcagcacattgtttacctatccatatgatgatgattagtagtaccactattgcttatcaatgatccacattctgctgcaattgctgtaaaccttcttttcatgaggggttgtcactgacaagtggggcccgctcgaactaacagtaattgtcggtgacctctggttgactcctccatgtgagtgttcagggatgctgctctcctttgcttctcatttttgatactgtaaaatggagtgaacactgcccaagacttttatttaggcaaggattaggtgaaattacagtagctttgttcaatgaagaacaagtgagagtacagtagggagtagtggtgttaccaaaacagcctctggatttgcacttgcagacaggggtatttaatttcttttgtcctctgcaacagtggaagaagaggggtgttaatgtgattgattacagttggcaattttgttttcttgcagtaggagtaagctatagatgttgctgctgtagcatctgtggaggactggaccatgaaaagttgaaaactactacacacatgatatatgcaatgccttgtgagagttcttgttggaatgtttggaaggaatttctacatggacaaatgcataaggatctctaggatgctgacaatactggaaccagataatgacacccccaagtcacaatcacactctgcttggctcctgattgtagttagtggtgaccactgacctgtcctattatatggaaactggaaacattatgataaacctgttattccaatattttgagctagatgtatatgcatatgtttacatggaacatgagaacctgagtactgatgatcttcagaaaataatgttgctcttgtctgatcatgtctagtagatacaaccgttgggtcttcgaacttcacagaagattacaatatcggcagtgctctcctgtctactctagcattatagcaggagtagctgcctagcaagcagtgaaacaagaagaaaacaccaagcctgataaaagagaaagtcacaaaggctggaaaagcgcttcttttggtgacaactgacaagccccatgctactgctactgctgtactgcacacacacaaaagccaagcaatctcaggttgtatttatatatttttggaatcttgaatccattcacagtgttctacacatcttcaggatcaaagaaaaaacaatccttagcttgttagatatgcaaaggatccatgaggatttaggaacaatctttagattttcctttttctgttttgaggatcagtctttgatgattgatcccccacaaggccacaataatctccaaaaggaatgagactctttctccagaaacatcaacttgcttggagaagagacattcgtttggagtctaggacaactttatacaaacccactatgtaaaaaatgaaaagcaaaacctcaaacctctaaatgcatcccatattttgatatcttggtgaaagttgtgtttggctcaatctatgtgacagaaaagagaattcaccctttttgtcacttttcttttgactatatttggttttttatgcaaaaacacaaacctaacccacagcaccatccattgcaagattcagcctgagagggtggtgatccacctcttctgagctgccggagaagatgtcaaccggcgcattggtgaaccggaaactgtttctgttacccaaattaggccgcacaccatgcttgtgatggtcaagatagaccacaacgactgtgatatcgtcgtggaaattccgcctgctgcctctctctatatgtttgatatcagtgtatctcatctctcgtttcctcgccgcttcagtcagcgctgctcgcaccaatcgcttcgctatcccctatcaaacacaagttcacacaaatgcatcagattttgtatatacagttagtcgtgagattggagtaaaccatagcttactgctctgggattcttgaagacgatatcaaccgctgctttatcagttagctgctcccacagaccatccgatgcaaatatcaagaataagtcttgctgcctcaactgatgttctttgatcgatggttcagccgtcatgacaggtcgcttcaatggaatggaacaaacatattgccggaatatagggtctctagcaaattcaggcttcttcaggtatacatctccaattgatctggaaacctgagaatgaaacaaacagtgtccatatgttaaacagcatctcacatctcagatgcaagaaagcagatagtgagtgtaactgttgaaagttttgggaaacgtggtaaagcatactgatgattatggatgcaagtagccagtgtcattctttttatgtaatctaatattccgcaagatcgattaccgtgaggcttaagaaaatacaaaaaggagaaactttacacgagcatggcttagcataagggttagccacactgcacaagcaatcctacttactggctttttagaacaggatatattcctatgtttttatcggatgcaagaagtgctttacaaaagaatattagaacctaagtcacgatttcgagaacagatgcatcaatgtacattgaacatgaaatgaaagtgatgtccgaattttatctaggaaagaggaatattgcctttatccgagtaacaaattctgcacatcacggtataaagccagcaaatgagatgcaaggacataaatatgtaactttgctagaactttggattgcccatcaatttcagggtgtatttaaaagcagccattatgagttgcgatgataaacagctaaatcaaatttcattatattcccttaaaactactatctggtctcacttatgttttgcttgttcataatcatctgaaataacaggaggtaaatttgaattactatgtttctgaaacttaacgtcagaaacctgcaacatgtttgttgcgccttagcttctgcatgaagcttaatagtacaatccagatcacttggcggtgctacacatgactccaaatagtatgccacatacgacaaatataccgactaacagggttgaacggtacatacctgaatgatgcccttaatcctccaaactcctcgggtatagatgactatacgtgaatcatcaggatgctgctcagtgagctcctttctgacctcctcctctgcaacattgtggtcattggatagtctctcagccactacctcccgaccatcaggccccctacggccaaggacggccctcgagtcccctaaattggcgacatatagaacgttatcggtgattgctccgacgaggcagcatgaaccaaccgaggcaatctgtggctgcttgagccaggatcgcttgaccatgtgcaagaactcctcctccgtggcatggaatgccctcttgattgcatcggtggacatgccaccttgctcagatgcaaaccctgatccaattaattcagagcatggcatcgttagtacatcttaagttaatggtgagcacataacttgattgaattatgatgacatctttggtcagaataagtagtaaaccacaaaattcatctcatcaataatagacaacacaatctagagtctaccaagtaccagctggagctatcaaaagataaagcatatgcaaagttctaaatgagcaagtggtatatcaagcaaaaatatataatcatcacaatagaacactatccaggtatcaatagaactggacaaaacaaaggattgttatttcgacaaacaggttattaaattgcaactacacaaagaggagtataaactacattaattaagtaatcaacaaatccaccgaattctacgctaaacctgactaaaaagacgcagaaaactgaacggtcaagttaagcaaactcatataaggaaagaaaaaataaatattacgccaaacaaaaagaacgcattgttttttttgtcagaaatgaaaaatcttaaacctaccaagacattattacgaactgattggttctattctagatcaaatccacacgctaacaagcgaaaataatctcgttatcgaggcactaaactgtggaggtgggggaagaggcgggaggagatgaagcgggacgcctcggggccaccgtggccgtcgtagacgccgacgaaggtcgccgccggcgaggtcaccacctgcccctggtcctccagctccgcgttcgcctgcgccaccgcgatggagtactccccgctcgcgtgcggcttcagctccgcgtgccacagcaacccatcccctcctccccctccgccgccgccgccgcctcgccccaggcacctctccgccggccgcgccagccaccgcagcagcatcgtcgtcgccgcaaagatcgccgcgttccctctcttcctccacctcccgaaaattcccaccgaatttcctccgaaattcgcaccaaaactgcgctgtcgttgctgtctcttttgctcctattgttaggagctcgaaagcttcgctttttttttccccgtttttttctgtttttttaatgaaaaggcgcccaattaagaggcttgagacgacgattgaccgtccgattggctctcgatgggacacgtggacggcccacgttgtcgtatcgcgacgacagtgtggatggtggggccctgggagactgacaggtcaacgcaccggccatgcggtggtggggcccacgtggagtggggagacgagtcgccgtggcggtcgggttggcggcgaccgccggtcaagctagccagcaagtacagtgtactacacgtacccagctctctactacgcggctacgcccgagaaaatattaaaaaatatttcctctatttcaaattgatctacatatttcatagatatactctctcatactatatttactctagcaacaaactcaatacatgcaccatccccactattttctagccaatagcaaatcaagatattgcatgtgggttataaatgcttgtatgcatgtatcaatatccatttactccaatgcaaaaataacgaatagacctaatgaatgaacacaaatatgtagatcatttagaaataacctcaaaaaaaaactatatgtagatcaatttggaatggagggagtagatatataagatttagccatgccattctgagtgaatttttttttactttcggatttgaccatgagtaaaagttttatacaaataaactttcaacttttccgtcatatcattccaatttcaatcaaacttccaattttagcgtgaactaaacacacccaaaagtaaaagttttactacctttatgttataagctattttgacttttttagtcaaatttacttaaatttgatccaatttataaaaatattagcaatatctataatattaaattagtttcattaacaattaatatttaatctattttcaaaatatatttgttttatgtcgaaagggttattatatatttttttctataaacttagtcaaacgtttaacttgaaaaaaaaatcatataatatgagacagaagggtgcttagggggaagtttttagaatatatgaaacgtttaactgtatgtgtccaatttttttttattttctacgatatttgctagttggtgtgtacaaggtgtgcacggaaaaattgtgtgcataggatatgttcatgtactaagaatgacgtggataaatgttagacattcattttttttattattgtacagtagttttcatgtttacactaaggtttgcattatatatatttttctgtattctacgtgaatactgtcttgtatgtactatgtatttatacttatctacggaatctggtcttgtatgtacgtatttatacttatctacagaatctggagacaagtacgggtgatagagatgtcgaataggttatatagaaagttcgttgagaatgtgacttgtgtgatcaggacagagatctttgctcactgaatttcgtcaagtatcgattctgcctctgaaagtctgaagtctgaattccaattttccagatgacgaacaacatacttgcagaaggaacaaaaacgaatgaacgcgacacataacaaactgcaatgctcagctggattggcatcagcaagacgagagcaaaagcaatcactcactttcagattgcacaacatggaagagcaaacaaaagcttccatggaaaaacaggtagcagctcagctctcactctatatgcatggagagagcatgatccagttgcaaacaacccagtcaggttcaagacacattcatggtacagtaagatgctaactttctgaagcctcacacagtgacaaaagtatcacagatttcacagcctcatcagcaaaggggggaaaaaacttggtactggaagaagagcatgtgagcagtgacaaagttaagggcttaaagagaggttctacagagctgggtttagtttcatcctcaaattctcatccttctgctgttaggagcacgctggccctgcagtaggggcagtcgctgcgagagcgcagccatcgctcgaggcaggccgagtggaagatgtgcttgcaccgcagctcgaggagcccatctgcatccccacatctctccaggcatatagagcactccgttgaaggtcccgcgagttcgtcatcatctgttactctgcagcttgctacttcttgtgtaggagccggttcagaacaatgcgcgatgaacgtatgcttatctgcggtgttgaaggtttcagctgtgctctcttggagtttgcagggagcgatcgatacgtcagtgtggaagcaactggttagactgctgaatatgctatctgcggtggtggagacgcccggggctactccaccatgaatggtttctgatgacaacgatgtattttgcctgcaacaatgggatggaatttgtaaatgtagattctctgtagcttaagttctaagctggaggagggagtgcgaaaaagttgatgcggaccttcttcctgataagtccacgctgttaagcctctgaagtagccgttccctagcctgctgaacggaatcaggaagccggccatgatctgatacgctgcggtttagccttgagctggagcccgtgctgcctgcttgtcctgttatgtttccagcagatgcgacaccctttgaggtatctcttttgcttcctggaacatgttcctgaccctagtttcatcaatgacaaatgttagaaacagtggataattgctgaagaagatttcacaacaatcatcaatacatgaagaaacatggaaaaccatacttatttctgccgtgaaaatgatattgttgcatactaagaaagagtgcagataagcaaggggcacatgaaagcaatagtgttcagtaaaaagagatagtgtccatatgattatttggtgcatgagcacacttcacagttgtctgcacaccacaaaactagaacactggttcagcaggctactacgagggctgatacttaacctgctaaaacactagaactatgttctgactgtatatgtttagtaatgggaaatctagtccataattttggcgcgaagacaagcattagttagtcagaaacgattgctactaaacaatgggaatttccataaaaggttttgaaatagcagtttaccagcaattaacatctaattagtactagtatgaatgtaaagtactacaggcttaattgggctactaaatttgagataccaaccaaagaactgtctttgtcatttaaccataaatctacattgaaattagttgaacctctcagaaaaagatttcggtatatgctactagtattccacgagtaccttcttatcatggttgtagtaaatacccttcacgagttacagcacatgtacagatgtactctacctagtttgaaaaggattgtcaaactttctactagtaccactgtaccagctgatgaattccccagaacaccagcaaacacattaatgtttcttgaagaacaaaagatcaccgaacccatcatttacactcataatcatagatctcatcaacgaccaaatttactaacacataacttagattttgcgagaaccagacttgacatttttttttttgagaaaattcgatctatagcacagaagagaaagcggtaccaaaaaatagcacataaatttttcgctttcggcgagaagcacaggccaccgtttttccttcgacccgtagcacttccgtcacattatgaggtaacggcgttagatcgaagtggagaaaaatatcgttggactcatttgcccttcgtctcttctcccttattccccatttcctccctctttccaagtccctatacgaagtcccaccctctgctaccgccgctgcagccatgcgggcaagcgccactgcacgctccctgaagggcttccccttgtcgccgaccacggcggcgatcgccttcgccatctgcccagagtcaggcacggcgtccgcgccctccgccaggtgcatcgccacgccggcctccaccagcaaaatcttgttca

SEQ ID NO: 82038 - DNA, 601 bp, Oryza sativa
ttgttctgacttctgaggatgaggaagattttggttcacacagtgtagtttttaagaatgtgattgcttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataatgttcaatgtaacatatgatggatgtttcaaacttccaagtcactgtaagttctgttgaggtctttattatcaagacctgactttttctgttaattcaacagctcctaagtacctagcactatcaaacgggcatgccaccaagaaaacaaaacaaaatatcatcgaaagtacggaccgagcaacaaaatctgaataaaacatcctaccaaagcaacaaatgtgctaaacaaacacaactaagtactattaccaaatact

SEQ ID NO: 82039 - DNA, 13431 bp, Oryza sativa
  unsure (1)..(13431): unsure at all n locations
cctttttacctataaagggaaaactgtattttctagttgcacttttgccgggttcttttttgtttctgcggatttcaccaatccattcgttcgccgtgaaactgacagctactcgtgtagtccctctctgaaacgtcacaatacacgtctgtgctagtagtaggtgctattcttttcagatgaaatgttgattgatgatctacttaaataaagaagaaccaaatattatactccctccttcccattttaagtgcaactatgagttttcgtgtccaactttaatcatccgtcttatttgaaaattttttataattaatagttttgttgttaagagatagtaaaacataaatagtactttatgcacgacttagtatgttataaaccgaacaaatagcttaaaataagtggtctacgtatataaagttgttggaaaaatcatattttgatgcaaataatctaccagtaattaataagtagtatcactgtctactctactatggtctatatatacaggcaaaataagggcctgtttattttgatgccaaaaaaaaccttatcaaattttggtggcatagttgctaaaattttggcaacttgccaaaattttagtagaatttcttatacagttaccaaaatttgataacaaactaaatgtagctattttttttttaactttactaaaatttggtaaggttaaaatggcatcaaagtgaacacgtcctaagattatacatacttacatacttggttggcttattcagggaaaaaaccaaacgacatatttgcnnaaacgaaaannaantanantncntnngtgnannattnnanannannantnntnntnttntttnaantttttacgtgttttttagcgatttaaaagcaaatgctaaaaaaacaaactacgatgaaaaaaccacaaaatcaactctaaatttaaagtcaactctaaatttaaagttgaaacttttaaattttagtttataatataagtataagcatataaacgaaaaaaaatgaggatagtcatggtacacgtaccaagatgtagaggagggaggcgcagacgatggtgcggtagcggccgagccatgagtcggcgacggccgagccgagcagcggcagcagcatcgaggtgcccatccacacgttcaccgccgccgccgccgccgccgtcggctgccggagcggcccggtcaggtagatcaccaggttccccatgatgcccgagtatgcgaacctctcgcctacctccgctcctgcacctcacaacacaacacgcctcgttacatgctactttttttttctcttcttttctttttccaaaaaaaaaaggataaggcggcggcgaacgtacgtaccgatgaggaagaacgcggcgggccaccggccggagctgccgcgggaggccgggccgccgaggtggtcgacggcgagcagcggcggcgactccggctccggctccggcaggagagcctccgcctccattgccatggctgctaacctcccaaccgttttgagtgtgatttttcaattagcgtgcgtgcaacacaaacatcaccagccgaaagagatgataatatatatatattgatatgatatccttgtagtatcaaacgccagccatttgaagggaaagggaaaaatggtggtagcatctctcaccttcaaatcatcgacggacgcgtgcaaatatacgtcgcgatcgcacgggcgtcgaggcgatgaggacaaggcaccaaaatgcgaaagaaaaaaatcaccatagtacacaactatactgctggaaattttgcaaaactgtcacattgatgctttttaatattatttataactgccataactttcacagtccacaaattgtacaaccacccctgaaaaaagaaaatcaacatttctccacagcaatttttacttgctgtggcacctaggctagatctccttctccatgcgaatcgttcaaggcttcaagcagcaacagaaaagcatcgtacgggcattcactcttgaaggcactgtacagcactactacagcagcataagcaagctgcaagccttttaccgcctgaaggtcttcgaaagtgatatgccaacaaccaacatgtgatagccaatgcattttcagcatcttttgacacatcctcactgtactgagatgcccttcttcttgtggacatacactcgcgaaaagtgtagataagcagctaaaccaagaacactgagcacagccaatagccagtagaagtaatcaagatgacctcggttcagattgtccgagaaccagctatccccagtcatgctggtcaccttgtcaattgcatacacaagaaagctgctgatgaagctcccaatcccaaatatgctcaggtacaaagcaaggcccaaactgcgcaaaccatctggtacttggtcatagaagaattcttgcaggccaaccattgtgaacatatcagccaaaccagtcaggatgaactgagggaccacccaccagaagctcatggggattgtggcttcaggattgtccaccaggccaaaatctcttgctaccatgagccttctgtctccacaagggcagagacaaccatcagaattactgagataatcaatccaattccaatcctttgcaacgttgtgataccgcgagggttctttgagtacctcctagtaagtggaacaaggattcggtcatatataggaacagagatgacgatcgacacactgatcaagctttgtagggcagcagctggtatgtgtactttacctatccacctgtctagtgtgcttgcttgcttagtgaacagtgttatccactgggcaaaaacaattgcgtaaatcaggcaggttgcccctattgggaacaatttaagcacagcggtggcttcatcaggaaagcatgccttttctgcatcattgtgatctccctgggatgatgatgcttgggtgcagtgaagatcccctgatgatctgcatgccagaggaagaacgagcaagtaaggttgtagtttgcaacggatgggctctgcgggtggtttcattgcatacatactttgaacaccatgatgcgcaccaccatcgtatctttgctagaagcgatttcccaacctggtcgaataggcttgtgttacttcttagaggatagaagcggtaactcttggtcccaagcaagaatactgcaagagaaagagacatggcaatgcaagggattccaaacccaagctgccagcctatgttatcttgaatgtaattcaagattgaaactgtaatgacattgccgccatatatcccaaagtaccaccaattgaaaaatgagctccttgaggcacattcttcagggtcattctcatcaaattggtcggccccaaatgcttggacacaaggtttgtggccaccttgagcaaaggccacgatatacagggacaagtagaagaaagctacatgaatgtccatactggaggatgcattattatctgcattatctccagattctgcttgttgatgaggtacaagaaccggtgatagcgtgagcatgccaagcccctatattgtggatacaattcagtgagaaatctacataataaaaaacatccaagaaactccacaatatcattgtcttacacagaaactgaatagtatcattttatcacagtgatgcataattgcatagtatgcccattatgatggtgatagccatatatcatgtggatggaaaggacaatatttagctgaattattgcctgaaattcctccgtgcttcagatctaaacacatcaaacttgcccctatggttaatcctttacccggagaaagtagaaactatatcaggaaaaatcattgttagcagagctaattactctgaaaattccaggtgaactcacagaatcagagtagcatatgttcagcattgtcacaggttcatcataaaagtggcagttgagtaagccacacaagaacagccgacagcgagagcactgcactgcacataccaggatgtagaggagggaggcgcagatgatgatgcggtagcggccgagccaggagtcggcgacggcggcgccgagcagcgggagcagcagcgcagctccgttccacgcgttgatggcggcggcggcggacgccgtggactgccccagcgggccggtcaggtaggtgatcaggttcccggagatgccgccgaaggcgaaccgctccgagatctccacgcctgcgatggcgaccgacggcaactgcacgcggattagttcgggagagagagagagagagagtgcggtgagagcgcggcggcgcttgctcgttgactcgccgccgccgccgccgccgccctggtttctcggggggagttttttggaggtaccgatgatgaagagggcggcgagccaccggccggaggtgcggcgggaggccggacggccgaggtggtccaccgcggaagccggcggcggcaggaggggctccgcccccgcgtccatggtggctcggtcgccgtcccgttcagatattttttcctcttctcagtaaacgatctaacggagtttcaaaaagaaagtaaacgatctgacatatttaactaattgccacttttagatgttgcaattaactatttgccaccatatttaattgccatatctaaaagtggcaaatatttaaataccctagcgcgcacgttactctcgttactatatatttgtctataaatttatatatgtctaaagttaaaacgacttataatttgaaacggagggagcactttgttggcggttgctagttgctataatnccgttccttgaaccaaacctnnaacatgntnngacacngtnnngacanantnanntnantngnccnananantnntntntnantnnntnnantgtngngnngnaantnaaaaaaactgtaaaaaaaaagttcatagaagtttgacattccacctaagttataggcaaagtgacatatttcagattaaaagttatagtttgactaaagtaacttagtacaaaacacattaacagttcacaacttacaaaaacaagttgattcggttaagcacataagcattttgggtggttttacaacaaaattgattaggttgacagtcatttgtagcaaaataacttatgagatagaataccaaaattcaaataatttatgcgatgaattttataaatttccctttattattttctgaaccttactaaatctaaaatttaaaaataaacctcacaaaaattattttaaaaatatactccctctgttccataatataagggattttaaggttttacttgcactgtttaatcactcgtcttattaaaataatttaaaattatttttttacttactttattatctaaagtattttaaggacaactttttattttttatatttacacaactttttaaataaaacgagtgatcaagaccgaccaagccatagcacggtatgctcgctaagctaagtgtttcttcttttatttttatttcttgttacagtaagagcctggcatgtattgtcaactagtactgcagattttcagaaacctcggctttgttcttgtagacatatcgctttgaaatgtacacgaacacggcgacctccaaagcgacgagtgcagtgagaatccagtagaagtagtcgaggtgggcgcggttgatgtcgtcggagaaccagctgtctactcctctcctcgtcgctcagtcgatcgccgacacgagcgcgccgctggcgtagctaccgacgccctgcgcgctcacggacatggcgagcccgacgctgcggagggcgtcggccgcctggccgtagaagaacaaataaaggatttgcaaaaacaactttacgcttctttcaaccttacattaaacacctaaattcccgtgacttgctaagtacaaaagtactcacccttactctctctctctctatatatatatcctccgtcttgaagagaagatgaagtgaagtgaaaaatagggtttcgttctggttcccagccgtcacatgtggtgttgggtgttagtccgttgattccgctactgttgctgttgctgttggtgtttgcctcgtctgtgtcgccgattgcattctcgtgttgttctgagctacaatctaagttaagataaataagtcctctatttattttaagcatcacaatgattcatatttatcaccagcgctatgtcctgagattggtactggaatcgcggtttcgtaggaagcagtgcgagaatcgcggtttcgtaggaagcggttcgcactgttttttctacgatacgttcctgtcgggtgccgttgtacggcggtgccggatcgaggagtgacaataaggtaaaccctgttcacaccacaccgctatacatcttctccataccaaccattttccagatttataaacttcaaaagaattattgctcgcctttgttcttgtagacatatcgctttgcaatgtacacgaaaatggcgacctccaatgcggcaagtgtggcaaggatccagtagaagtagtcgaggtgcgcgcggttgaggttatcggagaaccagctctctccttctccccttgtcacccagtcgatcgctgacacgagcacgccactggcgtagctcccgacgcccagcacgctcagggacacggcgagcccgacgctgcagagctcgacgggcacctggtcgtagaagaactcctcgaggccgatgaggccgaacaccttcgatgtgccgaggaggacgaattgcggcaccagccaccacacgctcgtcggcaccgtcgcgtctggcctgtcgaccagcccggcgtcgctcgcggcgcggagccgtttggcctcgacgagcgccgccacggccatggcgaggcccgacatggccatgccggcgccgacgcgctggagcgtggtgatgcccgcgaggtgccttgtgagacgcctcgcgagcggcacgagggcacggtcgtagaccggcaacagcgtgacgatggtgacgctgatggcgaactgcagcgcggcgggcggcacgacgaggcccccgccgacgttccggttcatcgtgctgccctgcttggtgaacagggtgatatcctgcgaggcgatgatggcgaacactatgctggtcatccagattttttttttcgccggaaaaggcagaaggagaccatccgagtatattaagaagaagtaaagttacaaaaaaaaaaaacacgacagaagctgtcgaggacggatgtgcacgagacaccacacgctaaccacacaagcacaaaccactgaaaaatgaaaccaagcaccaaaacgacccccgctaagcgtggccgatcgccgcccggcctacaacaacaccacaaaggcgagactccaaaaaaacgatgtccccaaggaggtcatgacatcaaggacgccgccatcgcccatctaagaaagatgtggttttcacccagagagaactcgccaagaaaggggaagaggtacccacaacagcgcccccaagagggttacgacacccgaaggcgtagccgctgctagcccggtgatcaccgagcgaggcttacgcctggaacccctgcaacctttcaagtagtttgtcgcccatcaactcattaaccactacacaagcattggcagcgcgtggcttccaccaagaccgcaccggcgcccctccaccggccgacttccgaacttgctgcagaaccctgccgccagctcgctgcatcccaccgctcctcccctgagagctggcccaggccacctccgtcccgccgcccgccggcctctcgccatgttcggccaaaggagaacccgggactagacaacatcgcttcggccgcttgagcttcctccactgaccagcagccgcctcaacccaaccgaaactccccacaaagaaggggagaagctcaagaagggagagggtgctgaccggcaacgagaaaaacgacgcaccgccgccagctctctttgcacagccgcttctcccataagcactgacaccggacctgcaatgccgaaaccggccgccgctcgaggtctccagctccaccaccgtcaagcgtcctagccgcccgcccactgcgcctcctcgtcgccggcagcggaagccaaggaacaaggcgccgccgacgccaccggctgcggcagcctcggggcgtcccgccgccgtccggcagccatggcggccgcgagctgctccggccagatacgcctgcagcggcgcccgcgccggcgcccagtctcggccgccgcaacagtgccgacgcccctccggccgccgcggtgacgccagcgaaaccaccgccgcagccgctctgccgccgagccctcaaggccccgggccgccgcgccctcgccgtcgcgttgtcgcgccgccgtaccggccagatccggcctcagaggcgccggatccgccgcctccccacgccggcctgctgtctccgcctccggccgctgaggtcgccgtcgtcggctatgccccatcctccccgcgctgagttagtggcctccgagcttgaaaggcctcgccgccgccttcccagctcgccaccggcttggaggaggagggggcggggttgtggcggcgcgggcggctagggttttcgccccccgagccgcccgcgcgagagcgacgcgggggtattctcctcgtcgttgggcttggtcatccagattggaagcacgttgacgagaaatcccttgccatccaccacttctttggatagaagcctgcacgaataacgttaagagaaatttgatgtcacgcgaagattgcaatttgcatccgtgcgcgcgtgctcaccgttctgtgcaaatggcatccttgcggcaaaacaccctcttcgtccacgcgcgcgcggccgcggcggacgtctcggcgagtcgcgcgagcggcgcgccgtcgatgggtcgctcggcagtggcacggtacgtccccgtgccgagcaggaagacggcgaggtacaacaccatcgtggcccagcacacggcgaacccgacggtccagctgacgttgtcctcgacgtagctcagcaatgtcgtggcgacggcgtagccccaggatgtggagaagtggaaccagttgaagtaggagctccgcgacgcgttcgcgccggggtcggcgtcgtcggcgaactggtcggcgccgatggcctcggagcagggcttgtggaagccctgcgccagcgccagcaggtagagcgcggcgtagaagaaggcgaggcgggaggtgggagacggcggcggcaggcaggcggtggctccgccattgcagctcgccgggcgagggtgctttggttgcagcgtggatgagaccgtcagcatccctaagctctgtagcagacattgtagttgggtaaggagtgtcagaaatggcgatgatgtgtccaatggcaatggcaatcaccctttttttttttgaacggaaaaaaaagttgaggcaatcaccttgaaaaatctgttcaatttaggtaaaacaaagtcttatagaaactatcttacaaaattcaaggttgattttatatctcaaaattattgtctagaagtttcagattcagttttattgaggtgtacttgataatgcagtggcaaaaggtgtgtggtttcaatcccgaggtcatcttacaatctcttcttagaaaatgtcgaataaaaaaaatttagtttgctccctctaaattcgttgtattaattagtatcatactccattctagttttatttattattctagttttatttattttgaggtgaatgaagtagctttcacctacagctgttggactggaccaatgtaccagacttaagcgctacgctcatactccaatttcttgccaaaaaggggagtagtttactcctccaacttaagcgaaccggatcatgatcatgacatgactaacgaagatgacaggcttgggtatccgagaggatcgaaatagggaggtgcagagcggcgacgcgcgacggagcactgaccagaaggtagagcacgccggcggccacgacggcgcgataccggccgaggtgcgagtcggcggcgagcgcgccgacgagcgtcagcaccatcaccgtcccgccccaggcgttgtccgccgcggccgccgccgccatggacatgcccatcagccccgtcaggtacatcatcaggttgccctgcacgccgtagaacccgacgcgctccaggaacccgacggctgcagatcagtgcagatcgatcacgccgcagcaaaagttagtagaatgacagccgcatgcatgggcgaggtttaccgatgatgaagagcgcggcgcgccagccgccgcggccgtcgccgtgtttggaggcggcggacgatggctcgtcggaatgtgcaagtagccggccggactccatggctgattggctggctctgcccccctctgacctttatagttacgaagtacaacttatagctgacatatgaagatatatttcttttatcagattaattgctcttgaacgagaactccctcatgccgaaaatgtggagcacacatatcgataacataaagaaacaagtatgggtcagtgtcacgatcttcagaaatttttggcacaataaaaagaagcattggtagcactcacctttctaaaaaaagatctggtaccactccatctcgtgcactaaatatttgagagtaacctaagtactcctatttttaaagttattgatggtcaaagttataaaacttttgacctcagccttgtctaaaacgtcaattaatatggaaccgaagggagtaagagcaactttaatggtaggtgataaagctaactatatatttatgtgcaatcgaataagaaaaaatgagtagtgttaactagctctatacatattcctagataaatgcattaattatataagcgagagagatattacctccgtagtcgtaaagaaagtcgtttaggacaatgtttaagtcaaacattgggaatataaatcatgaataactctcaagttgttgagtttaaaaatgtaaaatctatatgaatagatttatcttgaaaaatactttcataaaagtatacatatattactttttaataaatatttttatagaaataagaagtcaaagttgtgttttagagaccgtgtcgttgtccaaaacgactttctttatgaatacggagggagtaagagataaaagattagaaataattttatactccctccgtttcacaatgtaagtctttctagcattgcccacatacatatagatgttaatgaatctagacatacatgaatgtgggcaatgctagaaagtcttacattgtgaaacggaggaagtagctaatttattatattttttggggggaatttattatatatgttagctctaattctacttttgtattagcttatagtttgtagttagctctactactaaacttactgtaacaatgtttgtctaacttgttctcctgcaatccaaagatccaaacccaatctatgaggttatccccttttggccttttggattttttttattaaactttgtcagttgatttcacaacaaaattaatcacaatcgtatcaaacatttcaaaatgatttcaaatctaaatctaacggtattgcttttgtcacagaacccacatattattcactaattgttgttggaaaatcaaaaaagattatttctttctggaaaattcaacgcagagagagaaaatccactttggtaaatccattgcagagtactactaaatatatcaagtagaagtattgcagtaagaaatgcaaattgcaagttggtttgctccttttaatgcacatttggaacacaagattttcgaaacatgcgaacaggaaaaaaaaaatagcattggattgtcctagcatgtcaaattatacaaccacatgcattttcaataggactataattatacatgcaaatgctgcgaaaatgcaatgtatgttcaaactacactagcatacatcttctgatcttccccatgcgaaccatttttcagatatatatataaaaaaaacagaagaatcattgctcgtctttgttcctgtagacatatcgctttgcaatgtacacgaaaacggcgacatccaatgcggcgagtgcggcgaggagccagtagaagtagtcgaggtgcgcgcggttgatgtcgtcggagaaccagctctctcctcctctcctcgtcgtcgcccagtcgatcgccgacacgagcgcgctgctggcgtagctcccgacgccctgcgcgctcagcgacatggcgagcccgacgctgcggaggtcgtcgggcacctggtcgtagaagaactcctggagcccgatgacgccgaacaccttcgatagcccgacgagggcgtactgcggcaccagccaccacacgctcatcggcacggtggcgtccgccggcagcccggcgtcgctcgcggcgcggagccgtttggcctcgacgagcgccgccacgaccatgtggaggcagcacgtggccatgccggcgccgacgcgctggagcgtggtgatgcccgcggggtggcccgtgaagcgcctcgcgagcggcacgagggcgcggtcgtaggccggcagcacggtgagcatggtggcgctgatgacgtcctgcagcgcggcgggcggcaggacgaagacgcccccgcccacggcgacgcggcggtccatcgtgctgccctgcttggtgaacagcgttacctgctgcgagatgacggcggcgaacactatgctggtcacccagatcggaagcagcttgacgacgaaacccttgccatgttctacctcttcttctttcgccagcagaagcctgcaagattagcgttaaatttaaacctacgccattagaatttagcaagagtttagacaatgcacgagtcaagaacgcagtctgtaccgttccgtgcaaatggcgtccttccggggaaacaccctcgccgtccacacgcgcgtggctgacaaggacttcttggcgagcagcgcgagcagcgcgccgtcgatgggttgctcggcgcggtacgccgccgtgccgagcaagaagacggggaggtacaccgccgtggtggccaagcacgcggcgaacccgacggtccagctgacgttgtcctcgacgtagctcatggcggtgttggagatggcgtagccgcaggaactggagaagttgtaccagttgaagtaggagctccgggacgcgcgcgcgccagggtcgctcggcggcgtgaactggtcggcgccgaaggcttccgagcacgggttgtggaagccctgcgccagcgcaagcaggtagagcgcggcgtggaagaagacgaggcggccgagagatggcgatggcggtggcggcggcgagcaggcggcggcggcgtcatggcagctcaccgggtgttggtgcgttggttgcatcactgatgagatcgtcagcatgcccaagctctactttttttcataaaagaaatggctataaaacgtagggctgcaggaat

SEQ ID NO: 82040 - DNA, 2371 bp, Oryza sativa
tccttaatcaagtatcagcaaactcgataaatcccattttataacgactatgttctcttatacagtaatatctcaaaatgataataactaaacatttaaataatacacatgcattaggaggaaaaaaaaaggctaagcagcattttaataaccatcagcattcgaggtccggacagaaatatctatgttctgctcggctataagttgtagccactgaattcagatacataataatgccaatatttgcttacagcagcacaactgccttgccattcgcttccccctaatcaatccatcaacaatctctcataccaatcaacaaatcgaacaaagagactgagtccttgtctccaaatctcagctaaaccccacttcctctccttagtcacccctaacgaatcacaatcacaaacaattctaattccaccacacagaagcgctcgctccaatggtattctagctcgaattccccgctcccaaccgttaaaatcctagcaaaatcccaaactcttataaccctgcgactcgatcaggaacagctacaccagaaactcaacaaatcgcgaacgcattgctgaacaactcgacgcatcacatcatcaatcgcgcgggaacgcactccgaaccgaagttcagggagagagagagagagagagagagagagagagagagagagagagagagagagagagagctcacggggacgaggatgggaggagggcggggagcgaggcgggggagtcggtggggacggggagggagcccacccggaggtagcgcgccggcggcggcgcggcgacctccagcctccccacgcactgcagctcgctcgacgcgtccatcgccgccgtagccgtacccctcgccgccgccgccgccgccgccgatcgccgcggttttttctcgggcgtttggatgctttggctaatggcctagcggtttggtgggcccgcgaattccctcggagtcagtggatggtcgcttcctgtggttgcatcgccatcgatcggtcggagccggacgcggacgggacgggataaaaaagacgaatctgattttttttttcttaggaagtctgatttttagggtgtattttattttctataagaaaagaaataatttttgatcaatgcttgtagaatattttttcgacaaacaggggctcttaaaatgagcacactcaactctataagcgcacatcctattataatatgactactattcgttcaaaacaaaattataatatgactatctctgaaaattagaccgacatatcttaaaattaatgaagtcattacaacttaaaaattaggctggcatatcttgagattaatgaagacaataaatgtctcgttattgatgggtatatcgtctattattgaaagaaatacaagcacacgtaccaagtttaggactttaatcccggtggacaggtttcaccgtaaagaatttaaccagttaagttacgcttacttcacaattcttttataatattatgttatcaaataccaacaacagttataaactatgtaatattacgtggaaaacactttggcataagaatttatttaatgatgtagtttttccgtaattgatttacttgcacttcgactaaacattagtcaaaatttacataattcgacattttttttaaaaaaagggaaccatttggtgtaatgccgaaatcaaccggattagttctagatttaattaaatgcacaactaattagtccgaaatcaaccggattaccaacgaagctaatgtatgcacatttaattgaagtacagaaagtaattaaatgcacggtgatgtagtcatttcttcccacaactaattagtcctagatttcctagaagtgatgtctttgggtgacggaggaggtattggatctgtgtggaaagcttctggtctagtttttgtagctacaacttttctcaaaactaaaagctctctaaataaatctagcttttcattcagattctaaaaagttagttataaaacctagaaattgagtacatgtcagaaaattcttataagttggccatcaaccaactgcttacccattacgtgggacaaagaaaatattagggtggatgtgttatcaggtgtaggattgcgatgtgttgtgcgtgtacattttccatgtaatcatgaaaaaaatatttttaaggatagaggtgtaatagcatgcttgatttaaagttacaacattttttttggtgtgttttgatacgtttacttgtgaagttaccaaactttggtacattatgtatgtctagagcatgtttagtttgttgcatcattaaattttgcaaggttaaaaatgttagcaaactaaacatgccttagtagttaataagccctaaaaca

SEQ ID NO: 82041 - DNA, 8555 bp, Oryza sativa
  unsure (1)..(8555): unsure at all n locations
catagaaaatgctccgttaaacttgcacaaaaattctattggatgtctcaaatagcaaggaaatgcatgcctgagagtgcgaaatttgacctcttggaaaacaatttccatagtgaaagcgggaaaccttttcacagatttctgactccaataggatgtatcactaggtctgaaacgtgtcgactcccaagtcccaacagtgcaaaggtactaacgaaataccgcaacaaacttaatactatgacagtagagtgatttgcacatagacatggtactcacaacaattctattgttagctcaaaaggcaaacaaccatggatgggaagatacacaaaagatgagacaaggacagccttccaatcaaaataagaaggtggtatacataccaaaaaggcaactttttcaccatgtgtcattgaagcaattatctcgttcatcatcatcaccatgatggcattggcaatacaatagatgaatagacagatcaaacttaaccgtatcagctcgatcaatatccaatagctaaaccttactcccaaaattcagattgatgaatgcaattgcaaggacaaatattgccaccaagccccaaaattgagtctaaaatttctatataagcatatgcagattgcagagtatagtagagccacttcccctagttgcgagttcatgtcagtcttcgaaggcggacaccaactccggcaccggctccggcacggtggggagcaccgggtaattccgcgagaagcaggcgtcgcagagctcatgcgcctcgtcgccatagatggtgtggagcttgtcgagcgagaggaacgcgagggagtcgcagccgatcgccctgcggactccctcgaggtccatcctgtttgatatcagctcgccctcgctgggcgtgtcgatgccgtagaggcaggagccgatgaccggcgggctggcgatccgcatgtgcacctcgcgcgcgccggcgtcgcggagcaggcgcacgatctnnnnnnnnnnnnnnnnnnnnnnnnnnnnnnnnnnnnnnnccaccacgctcttgcccctgatgacgccgtgcacgggcgcgagcttgagcttgacggcgaggtcgcggatcgcctgcgacggctggatgaagctgcggccgctgtagtgccaccggatgaggccttgctggaactcgagccccgacgtctgcgagaatcccagcgcggcgtagaaccccgagtccggaacggggatgacgacgtcggcggtgggggcgggggactcctcggcgagcgcgcggccgtaggcgttgcggcgctcgtggacggcgtggccgaacaccacggagtttgggagcgcgaagtagatgtgctcgaagacgcacgacttgcgggggcggtgcgggacgaggcaggcggaggacaccgacatgtcgcggcggtcgacgacgacgacctcccctggctccacctcgcgctcgtacgtggcgtcgatgaggtcgagcgcgcaggtctccgacgcgaacacgatggcgccgttggcgcggcggcccatcaccaggggcctgaagccgaacgggtcgcgcacggccaggagcttgtccgccgtcaggaacagcagcgagtaggccccggcgaggcgctcgcaggcgtcgcagatgcgcgcgagcagagggcgcgagagcgaggtggcgatgaggtgcaggatcacctccgtgtccgacgacgtgctaaagatggagccctgcgcctccagcttgttccgcagcgcctggtagttcaccaggttgccgttgtgcgccacggcgagctgcccgaacctgtacccggcgaggaacggctgcacgttgcgcagggaggcggcggcgccggcggtggagtacctcacgtggccgatggcggcctggccggggagcttgccgaggcgggccgggtcgccgaacacgtccccgacgagccccagccccctctccagcttgatcgtgccgtcgtcccccgcggcggcgatgccagccccctcctccccgcggtgctgcagcttctgcaggccgaggtagcagagcgacgtggcgtccgggtccccgacgacgccgaacacgccgcactcctcgcgcgggtggtcgtcgccgtcgccgccgtccacctcaccgtcatagtcgaaaggcgtgacgcggtcgtattcggggaaggcctgcagcggcgcggggcggcccgcgcggtggcgcagcgcgagaggggacggcttggcggcggagcacctgaacacctggtggtggccgtgcgccggcgcgcctcccgtggcgcagcggatgaggccggaggaggcggtggcggtggcggcggcggcggcggcggccattggtggtgtgcgtgggagttttgggagggtgagggcttccgaggatgccctcccgaacgtaagtgaagggacgagatttaaggaggcccaggtgggcgtgtggcgatcgtatttcttactaaatttttttttatacgtacgcagtgtgtattgtaccgtataatatacggtccgtgttatccggaatggtatctttgggcctcgtatttcccagttcatcccagcgaaaagaaatggaatcgtttaattgtagtcttggatatggaaatttttaatcggttttccatctgctgtgcgtgatttttaaggggtttttggctgtcaatgttttgaatcaatttacagctgtgcccaaggcttgctgccgtccgagtctcttttatgggtgtgtttagttcctgaaaaaagttgaaagtttgaagaaagttgggagtttgaaaaaatagttgaaagtttatatgtgtacagtggcggagccaccatgattcttgggtattcccgggaatacccaacattttttatcaaaaaataaatatacttatagtatatacacatgtacacatatttgtacacctaaatcctcaactctttgatccaaacacagcccaactagtctcttgcgatgcttccaaccaacccgacccactccgtcatgacccatcagacatcagttgacccacttagccaccactcttccagacagccccctctcgctctccctccatgacccatccctccctggctcggctccctcgcgccactccccatttgcaaaccctaggtggtggcgcggcgagacggcaatcggcggcgggagctggaccgtgctaccacggagggggaggccattgccacggcgggcggtgcccgacacttcgccaagctaaggcggtcaggtcggttgggtggccggcggctgcgaggggcagggacgggcaacggcacagcgcttagacaagaatatccaactttgaaatcctggcgccgccactatatgtgtaggaaagtttttaatgtgatatgatgtgatggaaagttaggaataagggaaactaaacacggcctatatcccgtttgggcatgctgatagctaaactaaggcaaattttgctacaggacatcgtgactttgcggttttagctgtaggacaccgcgcgaaatgacttttggggaaacacactctcaaaatgtggttatttgctggtggacactacacccattaaattaataatttccgtgctgactagatgagagggccccacttttttacatgccttgaacaaattgccctttctctctctctctctatcttcttcctctctctccccctcctctctctctctcttccttgatggcgcggctcgcggtgattgtgtggcgtagcaccgcgcgcgatacgggcggccggcgacgcggcagagggcagcgggaaggtggagtagcagccggcgcggctcgcggtgaccgtgcgacgcgatgcaggcggctggcgacgtcctctctctctccctcgacggcgcggctcgcggtgaccgtgcggcgcagggcggcgcgcgatacaggcggccggcgacgcggcagagggcggcgggaaggtacagtagcggttgacgcggctcgcggtgaccgtagacgaccgccgcccctacgcccagctcttctctgccccgctgccggcgacgcggcagagggcagcgggaaggtggagtagcggccggcgcggctcgcggtgaccatgcggcgtagggcggcactcgatacgggcggccggcgacgcggcagagggcggcgggaaggtggaatagcggccgatgcgtctcgcggcgaccgtagacaaccgccgcccccacgcccagctcttctttgccccgctccctaaccccacgcggctgcccggcggcatcatggcgcttcctcactcgtcgcgccaccacacttctacgtggacgtccagcacgcagacgtcgctggtcaggcatggcgcggccggcacacagccccgacgacgacgacgtgtcgtccgtcctaggcagccgcgcaccgagcgaagaacggcatgcccccgccccgcgcctcctcctcctccccctccccctcccacgagacctccacgcgccgccactcacctgtggtgaggtccgccgcagccagtgcgcactccgtcgctgtcggccccttcccgtctcccccacgcgcgggtgtggcctggatgaggagcacgacctccttgcccgccccggtcgagctgcgccacccgcggtgcatcgcctaaaagcaaggatggattgagtcgaccattggggcattttggtccagacgcgtcaaaatgtgggtccgctcaatcctagtcagtgcaaatatactaaataaatgggtgcggtgtccgctggcaaaaagtgttttccccaaaagcgactttgtgcggtgtcttagagctaaaaccacgaagtcgcgatgtcctgcaacaaaatttaccctaaactaatgtagtcaagcaaaaatgtggaatgttaaaagaaacaatttaacctggaatattattagaaggcgattacatgtcaatttaataattgaacctaggccaacgcaaactattttgtatctctctgtcgaccgagctatgctccatttttaaccataataaaagaatattgggaaatgaaaatttcaagctcgatcggtttcacacaaagtcaacagatgttaccatgatttatcacaccactctcttttcaccatgggactatcacatctaaagtttcgctaccacaaagcgccacgtcatcagaaatttaggaccgttggatgcagcagggaattaaaccgatgccattgtatctaaaataaacatgagtgaaaaatcatggtcaatggtagaatccttgggagttttcacatagccaacggtccatgttccacgcagcagacaaagggtctgtttgggggagctttcagctgcagcagcttctctcagaatcagaagctatctcaaatagtacagtttttggtccagatgttgagaagttgtaattgtcgaatccaaaaattatactagaagctagaagctagaaaacccaatttttccagattctcagaagttggctatcaaccagctgcttctcagaatctcagtctccctcaaacatgcccaaaaggtcacgaaaaaggagaagcccacgttcatggtagaatatatatacaagaatcactaagcaggtataaaaaaacgcagaacccatctactcccagcagccagaacacatccaccgctgcctgtcgacctcctcgcttccatcgccacctccctgcctcttccccattccggtcgcctcctctgcctccacttccaccacacatccacatcgaccacctcctcccccgttgcagctagctgttcagttcagttgcaatgttctaactcttttcgattagatattcgtacaatgtataacccttacgatattacatatactttgcatcagcatacacctacggtgcgtgggtgagcagcaagcggcgctgcagctagcagtagatacccggggcttctctagacgggccggcacaccgagcataggtgacggccggtgtgccggccgcggttgcgcgaagcagcctagcacggaaagaagcattcgaccgagccggccgggagcgagcaggcggtgaaggaagctccgacggcagcggcttatggtgaatgtgatgaatatttttggaagattttttcaccctttgcaggtttgtgaaaacctgtcaaaaatcggtcggagtttggttacatttaacgaaatatacaatttttattataaaagtatgggtaagtgttaaaggatgtacgtgtagttttataacggagttgacacttttaagtcatcttaacatagtaggagcaaaccggtgtttcatttaaaagacgtaagagcaaaatcataaatcctagaaaaacaaaatcacaattgtatgttttagataatagaataaaacatcacgacatttgctcaacgagttacagccaattattacaacgtaacattcaaaacaagtgtagttcaataaataaaagaagataccaatcatgaagaagaaacaatccaaaaactaccaacctaaaacaaggagtacacaattattgatttatatttgtgaatctccatctaaaattgacaacaaattgtataaccatttgtttcaagattacgacatgcaacttttaaaagttcgccatctttatcacacttttatgttgtgcccaggacctgagccaattgtcaaaagtcatgacattcctattcacccataaagcacaacatataacatatgctctaagttttatacttttcttgtccacccccaaaagccaatcataaaaaatactacatctgtcccaaaataagtgcagccgtggatatccgtgcccaacgtttgaccgtccgtcttatttaaaaaatttatgaaaaatttgaaaatatttagttacacataaaagtactattcatattttatcatctaatagcaataaaaatactaatcataaaaaattttcaaataagacgaacggtcaaacgttgaacgtgaatagtgcaaaactgcacttattttgggacggagggagtatgagatatgatatatttttaaagaaaatatgagatatgctattaggaagatatagaccaaaagaaaactgaattgctctccaaataaactatgcataatgacattccataattagatgctgaatagtctcatttttcatacataaacaacctctcaaactatcattccaatttctccttgccaaattattcttagctaacacaattcctccatatgaaagtatggttatgaacattattgcctcaaataaaaactggtatgattgaaagtggaagcaagtaaaacatgccgtactgttcaaattactgccaaaatcaaccttactaaaatttggcattgccaaattgttggcaagtaggtagaattgctaaattttgtcatgatgaaataaatacattatgccaaaattttatatgagttaccaatatttgataacaaactaaatacaactatatatttatcaatttttaaaatggcaccaatcttagataggcccgtcatgtcttgtatgctgtatccttctcctgcaaacgacaaggcaaatcgatgaagaaaaaaaaagcatgacggtgctatctctaaaagagagataaaacacaatggcaatgtgaagaatgaggatttcaacaatagattatgcatatgcaaaatgcgccgtttcattctcgcgaccactcctacatctacacaataattgcctttttgacttagcaagtctgatttgccagagaatttccaatgaactatacttttcttttcttttttttttacagccgccaagctagaagactgtaaaccgactttgatttgtgtgactcgctcggtcctttgcttcagctgtccaacaaagattcagccgccggccgtgcatctaaaattcggcgagctcgaaactaaactggtggctggttcagcaatacacgtaccttgaggtatctgttttgatttacacaatttcactgtatttaagacgaattttaatttccgtataaatcagaaaatttcacttataccaaccctcccaaactagaaagtcagcaacatgggcactttcgtcttcctgtatgccaattatggatagggattagtctgttctctttgggggtgggctcgagaacagggggccacctagcgctgactcatggggcccatcactgagccgacctgacctctacagggtgggccatggtactatggaccgtggtcctttcatgtataaaggccaggccccaccaccgatcacaacttggttcgggccttctcgcgtcgcggtcagggccaagtggggatacggggcacacgtcccacgtcacgtacaatacaagtatacaaaaactatggtgacgcaaattctacattgctctgctagttcactcccttgcagctaccttgggttacctctttcaaccacaaaaatctctcataacatgctgctgctagtcaactcaaaagttgacagatatctagccggatggttgcctctttcaaaggggggaagtctaactatgatcaacgcaatcatgtcagctatcccgacatactacatgtcatgttgtatctggccggaaaaaatctatcgaagcactggacaagataaggcgtgctttctt

SEQ ID NO: 82042 - DNA, 2228 bp, Oryza sativa
tctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccctcgccgcccatttgcaagcgcccccccccacagtacaaaatcgccctagcggagggcggcaagggggccgcctgcaaaattccatgcccccctcgccgcccatttgcaggcggccccccgcacagtataaaatcgccctagcggagggcggcaagggggccgcctgcaaatttcgttgacggccgtcgcccgagagtgaacggccgtctgccacgtcattttcgccgccctctgagagggcgattttcccagagggcggtaggcgactacttccgtcaattttcaaaatggaaaattatttttgtaaaacttttaataaaaaaaattataaataaaaaaaaattccccttttcaccgacttcacctcacctccaacattccttgcctcctcggcacttaagtgttaccatcaacttaaacaagaacaaagtaactaaaggaaaaaaaggttaaagccaaagcaagccgttaatagcatcatctcaatctagtgctaaacaatctagatttcaccttttttgatcgagtgctagatttcgtacccagtggtgtaagtgtataacatttttcgctaatctttttatcaaagcttactgtttcaaattcgaattctcaaaaaccatttgaaatttcacttagaatctactctcctgtaaaaaattagtctcacatctacagtaaaaaaattcgcagttctgaatgggctttcgtcgaaaatataaaccctgaataaaatctcccttctctcctggccacctgcattcttttctagcagaagaaaaaattaatttcaccagacaatgaactgcaaagccactgtaaggaaaaaaaaaaaaggaagtgagagactcagccttggtgtggcccacacacagtgagccagcgagtggctgacacagaggctagctgctgctgccagtgggccccactggtcagtgtgcttcttctctctcagttctccaccactcactagccagtgtttttattgctctccttcacttcttcacttcagctcagctttgctctctcctccttcactcctccacactgaaatctcactgccattgccaatggcggctcgccacctcctcctcccggtgctcctcctcgccgccgcctccgcggtgacctcccagtcgtctccggccggcgcgcccagctccggcgcggcgcactcaccggccgcctccgcaccttcgtcttcttccaagaaccgccaccgccacatctccacctcccccgccgcgtccccgtcccactccggcaacaagctcacctccccggcgacctccccggcgccgacgacgtcgcctccgcccgccgcggccacctccccgtcgcccgcattgccgcctcccgccgccgcgccggcgccgacgacggtgtcgccgtctcccccggcgccggccccggtgctcggcgcgccgccgcccacattgcccccgccggtggccgcgccgccggtagcgctcgccccggcgccggcattgtcgtcgtcgcc

SEQ ID NO: 82043 - DNA, 1548 bp, Oryza sativa
aaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaacttaagacagtggaataaagcagagagagaaatcaaagcaagaaagagagagaagaagcgaggcaagagtcaagaccatctcccatggccagtggtgatcgtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgccgagcggggcgaagctgctgcagatcctgaacgtgcgggtggtggggagcggcgagcgggtggtggtgctgtcgcatggcttcgggacggaccagtcggcgtggagccgcgtgctgccgtacctcacccgcgaccaccgcgtcgtgctctacgacctcgtctgcgccggcagcgtc

SEQ ID NO: 82044 - DNA, 19843 bp, Oryza sativa
ttgcctgctccttactactctcctttgaaacttctttgcaaatgcttccacaatttctgaacataccttgcaatttctccctttaaagaattcttttgtttgcctctgatgacttgcttttgcaaagatggatgaatctatttccataaagaaagacaaatgaatccagatatgtatccagtacaggtcaactattttaattttatcctcttgtccacagcttccaaagatatcttggtcttgaattactgaagccaaagcaacaacgtgtgacaacagcttcattttatccatttgcatcttctgaaactttttttttttggtgttgttttttagttgcaatgatccccttttcttgcctgaaactctatcttgttggcatgcagaatgttcccttcaagagtcaatcatcatagataaaaaaaaggaatatccttttttcctaatggtgccatttgttctacttctcttaattcttctttttttaaaaaaaaaaatcattgatatttaaattctgaactgatctgaacttctggggacagcatgcctactggccatcagctgcaaccttttgcactgcaaagaatgcaacctcttttcacttcaatttccatgtagtagctacctatgctttctttctactactccctcagtttcactgcctgattatttaccttttcactgcaactccctttttccaggttacctttgcattcattcattcatccatgcatgcatgcaactgtgcaatcaataatgctccaatattgcattgcaaatcatgaacatgccatgatctagtaggaatagacacaaatcaatcagcatgcactcattaattagccaagatcgatcaaatgatgatcaatggacactttgggatcaggaattcaggattaggacttaatcccccctgcccaaactgcactgatcacctagctagaacaaataattgattaattaacagtgggagaggaaatgattaagctagtggctagcttcttcttgttcttcttctcttcttcttctacaaacacaagataattaagctagagtagtagtagcacagtgtgatcatggacagcttgagcttgagcttgagcttgctcttgctgttcatgtcatcctgaggctgagatactggcactgaaccagccatggcgactgctgctgcttcatggcgtcgcccatggcgaggtcgaacgccattgcacgctggcacggcggcggcatgggcggcggcgcgtggaggaacatggcggcgccgtcggagtactcggccgacgacggcgacgacgagaggccgctgccggagcagtcggaggcgaagggggaggagccacctgcggcggcggcggcggcggcaatggcggcgttgcacttgcgggagctgcggccgccgccgacggcgagagtgaggtccagctcggccgtgtcgtcgttgtcgtcggcggcgtcggcgctgacgatgtactcgtcggcggggagctgcaggttcagcgcgcggcgaggttgcttgctgctccggcgaggctgccggcggcggtggccggagctcagctcggccatggtcaggtcgctcatcagctgcctctgaattcggtacaggcgatgcagctcatgaacctgattaataattaattgaaacttaattagaagtagttcatatgtaggattcaagaaatttgcaatggccagtaattaactactagtagtaagtagttgataggattaatttcagtgagatttacctgctgcctgaaggtctcctcatgcttgagcatggccatcttcatcacctccatgtcacattgcctcacaagcttgtccatcctcatcatctgcttcagctaagcctcttggaattgattgattgatcctagtgattccctcaactttgattcaggattcagatcaccaattcttgcacttgcaccctgctgaaatgtgaagcaaagataccattaagtactttaaaaaaaacttcattttcattgatcctaatggttcagacttcagaaatgataaattacatcaaaagagctagtagcaagatgaacaaaaaactgaactttgagagcaggagctcagatcaagaaacatgatgatgtcatcagaacaatctctgagtgacacaaacaacatttcagacaaggatgctaattctaccacaaagaacaagtaactaaccaactaactaaccttgtatatgtatccaaaacaaccaccaagatgcttgcttgtttctgttgtctgttcctctcttcctctactcaacttccagaggacaaacaagataggttcagaaggaggagtatgagttgtgagagtgaggctggtgaatgtgtgaagctggaaatgggagttacaggggaggtggtgatttataaacactggcaatggtcactagacactaggtagagggtatatttttaccttggaccctcctcctttttggcatgccaagcaagaggcccagaggcctggggcaatggcactagtcagtttgcatgaggtgcccctcccagagcagacaaccctgcaggactctagtttaatcttcttctctattctctcttgtgtgggcccccacaaggaggagtagtcgtacatttcaaaggttttttttttaagtacatttcaaagttgaagcagtggcactttgtgtgtgatggatgcaatgcttaacacactaaacaagttagggcccctttgaaatggaggattagcaaaggaattttggaggattcattttcctaaggattttttcctatagagccctttgattcataggaagaggataggaaaactttcataggattgcattcctatgatcaattccataggaaaataagcaagaggttagacctcttgtgaaactttcctttgttgagtgtatcctgtggtataatcaaagggctcttctctccatttcctgtgttttcaattcctgtaggattggaaaaaaatacaacttcaattcctacgtttttcctattcctgtgttttttctatcctgcgtttcaaaggggcccttagcatgcatgatcattgcacaaatgcaggcaaatgcattgcacacatgtaggagtagtaccatctaccaatgccttgtgcagttgtgcaattctttactgaatgaatcagtttagttcttttttttttcttctgaaatgtatgcgcaagtcaggttgcaactaactggagcagtagtacctagtaagatggagctgtcagtgttgtcactgaaaacaagcaaaggtgcatttccatgtgtgaaatgtacctgatgatgatgaggggagagatgagatgagatgagatgagatgagatgagtgtcctcctgtacaatgaattattgccacagcattgcaacatatgctaatttccctttgcaatgcctgcatatatgcatatggatgcagggatctaatatctatccaaatggatgcatccaagagcacaacatatctttgaggagggagataagaagggcaggttcttgtctcattgttggcccatcctgacaaatcagagcactgttgtttgttgttaacagcagttgctgtggtatatgtttgcattgcaggaaaaccaagcaagcagagaaaagaggagaagcaaaggctgatgatgcagacacatccctttgagaggaagcatcagctaagcatgcatgtctgaactctgatcctgacacaagcacaaactatgtggggtctgcatagtttaatcaccggtgcttaattaattttgcttcactgaccaaattactcaacactgatgctactagtgtgccattgcagcaaacagctgactataagacgtaatacctattagtgataaaaaaaaaactgttcataaaacctttatgtatacgttcttcgcaacttaaaaatgaatgctgaaacttaaaaatcaattctgaaaaataaactacgatgaaaaaaatcatcaaaatcaacctaaaatcaagttttcaaatttaaattttagttgcggctgataagctgaaaagccttaatatacataggtcggtattctttgccgtcccagcgaaaaaaaaaagttgaaaagcaaacgatggagctaagtccacagcttcaagagctgaggaagagagctgtattgtgcagggacgaattgcttacaataatggagacttgaaaagaagaagagatcattttttaagtgattagtgcactaataagaaagcctaagcaaagggtgatggatgatagtccaagggacaagacaatggcgcacgctttgccggcgcagggaggcgcatccgtacggcgaggtgggccccacatctagagagagagaagcactcctgctttctcggctttcttttctttctttctttcagtcttcttcctactgcaatggctttttgcaaggatgattattattaatttattattatcatcactattttaccattaacaattactactactctactcactattgttatgattgttactagtgcctttagaattaacaagtacactcactgattagtactagctcaatgcaaacctaaaatttagctctagcagtagtagtaaattagtaatagtaatgtagtgtgcatcttttgtggataaaagattagtaaaaggtgaggaattggaacagtagaagctttgtagatagaggagaaagtgctaaagagagagggagcaagctctcacccatggtgagaaaagacacttttgtcaggaggttttagcctctcttcttccaattactccatgattttcaggacagctcatcgattgttttcttcaggaaaagcaaattgatctgtggtgacacacacaatgcagtataatcagtagtcagagtagcagagagtgttcttgtgcatctcaaaagcatactctgtactgaaaaaagaagggggttctgttgatctgttctattctgtttctagattcatggttataactagatgattcttgttcagaaaagtttcaagtttccaatctggttttatccatttcaagctctcgtcagaaattttccaggattagatgatgcttgctgttaataagtgatagtaacagacagcaattgtcatctctgatgtctgatggctgcctgacaaaacctgttcatgctgttactctaaagttgatgccattttggcctgaatgatttgtcagggtagctctcaaattttaaccaacagcagcatgcatgcaggagcatcgactgatcagtgaagtttttttttataaaaaaagctacttactagcaccgagcagataaacaaacacaagaattaacctgatagctattgcaatgataaagtaatcaggggagtaagcaaagcatgcagatgaactcgcacggggctagctaaaattcagtgctgaacttttcagaggggggaggaaaagtacattacatcggtgtctgtaaaaattcaggtcgcagcctccattctgtctccccacacacactgcatcctcaaagttgcagccttgctcatcatttcggctacctggaaccctgtgcagtgcagctctaacagctagttaatcgtaggatgtaaaagaaattggaggaggaacagaagaatgtccactaacctgaaagaaaaattcagaaaagagagctttgctgatgccaccaccaccatcatcatgatgatcacataagggtggtcagtgtgagccctcacctatttgtcaacacctaaaagaagatgatgaacaatgcactgatctagtctagtccactacaaagtgaagtaattttttgtggatggtgatgatgagtgcttgtgtgagccttttcccatctctgaattagatggtgtgggcatgagtttgttctgcataaaatggttttgttatgcttgtttgactatgtatatatgtaacctgaccaattaacatcatgctaatttcaatgacatatttaatcagctgcagatcaaactgaacaagatggtgtgtgtctgtgtgtgagagtttgttctgaattttctttttgttatgcctgttgaccttctctgcatatacaacctgactaattaacatcatgctaatccacaaactaataccataataaaatcagctgcagatcagactgaatatttaactgaacaagatgatgtgtgcttaaaatcttcctgttatgccatgttgaccttctctgcatatacatcctgaataatcaaacaccatactaatccataaaccataaactaacaccataattaatcagctccatacatcacatgagcacatgactaattacacatcacactgaaaccatgaaaaagctcatgcatatactacatcaaaactaatcaaaactgaagaacaggattagataatgagactaggataggacctgaacttttttgtgctcggctttcctcgaggccggagccagccggagccgacagcgccccgccatgcacgctcgccggccgttgccggccggcgagccgagacgagcaccgaaaggagaagtgatcagtggacacaggacagacagtggctgctgctactttgcaattgcatggtggaaatcttttcttcttcctcctcctcttcttctcaaaaggcgaggcgtggtgatgacctcacacacgcacacacagtcactaaccctaagcttctgtagcttcgaaggatgcgcctcatcatccaggcctcttgttcttgtctgaatttttgttactgttctgaatttatcagagcctctgggtatgaggttttgtttaaagaagggaaatgtcttctgaacccgagttttgtttgaagaaaaaacaaaagcatagagcctctgaattttttctgagtttctgactcatcagagcctctgaatctgagctcttttcagaagaaaatgcaactgaagccgagttttcttttcagaaaattttgcctctgaatctgagtttttctttaattaaaaaaattgatattgaatcttaattttttttcttgtcgttctgattcatcagagcctctgaatctgagtattttctgacaaagaaatgcatatgatctgagttttcttctcaagaaaaataggtgcatttgaatcttcttctaactagtaagcaaaaaagattgcctgtgattccgagtttttccatacaggaaattttggttttgaatcttagctgaacttcaatttttggatgtgcatggaagcagcatggacaggtctttgcgtgtctgatggaggacccatggacgtacgtgtgataaagtgctttgtttcagtgttatttttgcaacaagaagtacactacgcagctttgtcatcgtcgtttttctcagggcctagtatttatcatgtcttttcatggagctgaataaaagcgcttttaactgaaaaaaaaaaaaaagttagctgccatgctcatcgttgatgaaagaaatgcgtgtaagtttgaaaaagaaagactgatactatactcctgtagtcctgttggtactacatgtcgtttggacatgattgcctgcaaacaaacgaacagttcaggtcaaattcgtatcgagaagaactgatgaattgttgactgaaaaaaaaagaaggatttacatcaggttgtttcttccaaattttccctcaaagagtttcattccatgtcacaatctttcagggttctgactttgcatttcaattttgcatgcaaccaacccagcatggattgtgaatttgtgattgacagaaagtgagccctgttcttcagagatatcagataagatacatgtatgacagtatgagatcatataatataatcctccaattcttcagaggtttctgaatctcggcagtctgtaccaaccttaccagcgaaaaatttcagcaattcttctttgacctggagagaaggccagtcttgaagatgcgcttgaactcttatgatctaccccattcttgataagagggataactgactgtatcaggtaatatgtgctgttgtaccagattaaatcagacagcaccagaatacatatatattcagaagaacacagaaggagctgcataaaaaatgtgaatccccatggaacatagagatgtcagacactgaagatgcagaacaccaaatcttgttgggagatatgctgcattgctgggtgacatagatcatgtaaaaagttcagataccaaaccaaactctgaaggatcaacacaataaaccgggaacaagaacgatgctctgcgggcagagcagtgacaaatcaaagattatggcaacacatggtaaaacagttgagaagaaatatgccttcggtagaggaacaacaacaaatccaggcaacacaaccgaattctccatacaggtaaaggtaaactgtaacattgaccagtaaaatccagacaacaaaaccaaattctccatacaggtaaaggtaaactgtaacattgaccagtaaaatccaggcaacaagaccgaattctccatacaggtaaaggtaaactgtagcatttacctgtaagcgacgacaggatcaaaggcattgccagaatttttcattattgttgtgattaatcacaagtaatggaagttcactatcatgtaccctaagatgtatcatcctgaccaccaaaagccatgggtgtaccacccagccctatgacactaactctccctccgcctgaacctaactaaactgtagctttctacagcagaatgaatggcaatgcaacactgcgacaggttgcctacactggtcaacataagattcactaaaagaatccgagataactagccaccctcattcatccgtttaacagatgagcagaaatcttgtcacgtacccgagaggagttacctcccagtaactggggattacacactacagctgtctcaagatctagcaatgaagcttggtaggaatagtcagctgaacctgtagagcgttgatactgcacgccatttataacagcaacagtagtcacatttggatagttcatcatcactctctttccccttgatttcgccacgcccatacaagacttcagcagccgacttaagtatgcattcagcccagagttgagcacatcagcacactcctgagtcaagctaagaccttcagcttgcagcttattctcaagtagcttcaacaagcgctgagcttctggcaattcaccatttttgtagcatatcaacgaaggatgaggaatcgaaggccgagaattctgagccttcggatctccaaacgaaacacccaaaggagccctaatcgggcttctgctctgcgcatacactggactgcccccggcctggttaacctcctcgccatcctccacagacacaacctccaacggcgccttgctcccagccgacacaaactccccggtgccctgatgaccaagcggcgacttcccgagcgggctcggcctctcgaacctcgcctcccgggtagccaacgccggccctctcatcacacccgccatcacgccatggttggccacggccccgttggacacggacacggtgctcgtctgcgagttcccggtggttgcctgcctgctcggcggcggaggcgggggcggcgcggtcgccaagtaggcattgctgaggatcgacctgatgagaaaattgtgatacttgatgttatccctccccattgtagccacgcagatcttgtcgaactcctccttcccaagctgcccacccaggaacttcttcaggctatggaagtagtgctcggagcgctcggcgcccagcttcttcgcaatctgcgacttgatctccatcgtgtccacgcgagcagccaccttcttcgccaccggcggctgcatcttggagaccaaatgcagcagctcaccggcgaccaaaaccctagccgccgcggcgcgcggcgagattcgaagcggcaacctgcgaaaaccagatcaaaaaaaagaaaagaaaagaaagcaagcaatcaatctttagcagggatcaagaactccacaatccagcacaagaacacacgcatcccccaagctgctgatccaggagctcaccgaatagttggaacaaatctaaccctaaccccatctctgaagcagacctaaacagtaataacctaatcggaaaccggaagcaaaccaagctcgaattttagacaaaccccagccaaatccgggatgaacaccacccagaaaaaaaaagcccccgaatttcacggggtatagaactagattacgaaacacggaatggatttgggggaagaagaacagcaagatggagactaacctcgattgggaagagcgtgatgattccggatgtcaagaactcagaattagggtgaaaagaaaagaaaaaaatggatcttttttttttcggattgcggccgccgcaatcgcagtttatatttcccccaaattttggtttttttttcttttttttttctgggccgcgaggacgaactcgacctcacaaggcagtgtttgtcacggtggctcgtgcgctaatgtctctctgacaggtgggccccacgcacacgcgtcaggtgtgtgtgagacaggcaggagaggagataggcaggtttgcctctgcccctgacacgcacgtgccgaaatgcaaaactgacttattaaggctaatgatgagtacttgtggtctaatgcaagtgttaagtgtggtctctccgttttgtttgggtgtaaaagatggttaaatgaacaagatatggtagatttggttctttactctctatctctctctctataagtgtgatttctccttttatttgagttggagatagtaaaatgtagaagaactaaggtagtgtttggtttcgggactaagtgggatgggatggaaccatccctgatttttgggttgggatgattccactcacatgtttggtttgtaagatgggacgatcctaattttttgtttggttgaagggatgagagagggaagggatggacgccgtttgcaatcaccgtcaaccgatcgccagatctgccgccacattcctccccatcgctggaggaagagcaagaggatgagccggcggcgagcaagagcaagaggaaaagccgccgccgctccttcccatcgccggatccgccgccgtccctcgacttcctcctcgcacgccgccgccgctcctcccctgcgagctcctcgttgcaagccgccgcagctcctccccatcgccgaatccgccgccgcaccatcgccagatccgccgccgcccctagacctcctcctcgcacgccaccgccgctcctcccccgcgagctcctcctcgcaaccgccacagtccccatcgccggatttgctgccgcccctcgacctcctcctcgcatgccgccgccgctcctccccgtcgccgaatccgccgccgcagtcctccccatcgccggatccaccgccgccgccctccccaccactggatccgccgtcgccgtcgctgagccccccgccgccgtggtcgtcgtcgccgagccctgcatggtcgccgtcgccgagcctgcagctgtcgccatcgcacgagccgtatgctgctgctcccgagggcgagcagtgcgagcgcggtaggaaggcgtcgtcacgccgttcgctcgtcccaggtgggacgagttcgtcagccacatttttccggatcggttggtcccggatctaagaattcctctccagggaccaacccatcccactcacccctcaaccaaacacccctaaaagtgggttcgtctcatctcatcccatcccatcccttcaactaaacactacctaacagattggttctttactcctaaagagatgaggagagagatagtgagagatagagagattgagtggacaaagtaattggtagggagaaagtctatttttttaatagccattgtgagatgattgaactgtaaaatgagatttcataatgtgattctaaaacatagggatatttcccatttgtttgtgtcggaatagaacactagctaaattatagtcattagttttcacatggaaattctattgtattaacttgtggctttccacgctaaaatgaattaacatgcagtttcccgcgcaaaaataaaaagttgatgtgtaccattcccacgtaaaattaggtctacgtgtcacttcccatgctaaaatgaattaacatgtagtttcccgtgcaaaaataaaaagttggtgtacccttcccacgtaaaattaggtctacgtgtcgcttcctacgctaaaataaattaatatgcagcttcccgcgcaaaactaacgtgcagcttaaggtaagtttagggtttccttgtttaaatgctatataaggaaaaaaaaaagtgctatatatacttaggctgtgtttgagaagaagaaaatagataagattagaaagatacgtaaaacgaggtgagccattagtgcatgattaattgagtattaactattttaaactttaaaaatggattaatatgattttttttaaaataactttcctatagaaattttttacgaaaaacacaccatttaatagtttgaaaaacgtacgcgcgaaaaacgagggacaatctctcctatctcccctgaaagaacgcagccttatatgagtgcaaactttgtcgtatatggtcacgcttcagctcttggtgcatataggatgacgttgggttgtccgcctcttttctccaatccaatcaccgtcttgaatgcactacccccaacagaagatattgtctatctagaaattctcacaacaaaattcatacaacgataataaatttatcaaaaattaataaaaaataaactgagttcaactcagtaagagatgtcgatgtacatccccgctacccaaaaatcaaattttggtggaattatttatatgttggaaacaaagactctcccttcgtaaaagttgaggtagcatcattttcaattgttaggggagtgattaagttgaaaacaaaaatagtatcaaactgcaatattgtgcaaatcaagtgaccaaataagctaatatgcccaaccctttttttcgttcatatgttgcatctttttttagggatatttttaaggtacccttagaataatactggccgtccactcttatcgatctaatggacctgatcttcttctactgtcagtagtagtatgtgcagtagaaaccacgtggagggcaaaaccgtaaagaaaaaaacacagtaatattacgctttatcggtgattagatggaatgggcgcgaaatgtgcggtgagaaggcggcggcgaaggcaggatgtgatgagatcggcatctatgtcgccgtatggtggccgtcgctcttccggccaccatgagtgatggagttctattatggagtaccagttaattcgtctccgcgatggccaaaaattatcagacggcagctggaccagtcttcgatgcggcagtaattcgccggcagagcacacacaagaaatgtggccagcatcctcggcgatgccgacgccgtccaacgggccgcacaaatgggaggttgacccttccgggtttctcggcggctacaccggcgatataactttctctaatagataaatggtcagaaatacccttacaatttacaggataaagtaaaaattatcgtataaatcaacggtcagttttgatttatactaccctactgccatcgctcgtaaaggtactgtaaaatgacccttttttagtttaatcacttcaagcaatttatttatttcttaattaaactaagtacacgatctctttacagtaacagaaatagagagcaagttggaggctccatcttacccacgtccggcgtttacttcccaaatccgaaagcaattcggcaacatcgttttcagatgcaccaataagtcgcagatgacacttttctgaatatcacatctttctgattgagtagacaattaactttcttgtctaatcacctgatgtatttggcatcattaagctctgaaacctcagaaaaatccttttttaagtagctaatgttcacctctgatgcatgaattaaagaagaatcaagaaacagctactgaagaaggtgagaacaataatttacggataaaacttctacattatgtatctatgttagtgatttaaaaactaacgctgcaaaataaactacaataaaaacgtctaaaattaagttttaaaatttaaattttgacagcaatgtatgggtcagcaagcgtgcagtgtaaatttggctgcaatcggatttttagtgtagggtgtactttactgaaagatgaagtagtccgcaaaatctacaacaaaattgatgctctttgatgaaacggccataacatctagtagagtacttgttactacttcatttcttattgctctgatagtctgcatcacaggaggaatcttgcattatttctgtagtttactaactaggtttcactttggtcaaattaagatttcaaaagacaagatttgctcccatgtttcagggttcagaacttcagatataacaataatctactagtactgattagaacacatgacaagttcagaaactgacagcatattgactaaaacctgtaaacaacagatgcaaataattgtgcattttgcataattaactgcactgggagtttgatggggccttggggctacattgattagaggaatcagcagtttggctacagctaactcgaaaaaggatggatcattaacgcataactaataacatattaaatattataaattaaaaaaagatttatttatttatttattaaaaatatttttttcataaacacattattaacgtagttttagaaatgtgctaacaaataaacgagaagttgtgtttcaaactgctgaaaagaatgcccatggtaaaaaagacaaaaaaaagaggggcctttgcctcgccaattgtttgctctcttcatggtatgatcaagatcctctgtagtcaaagtctgacatgtgcgcccgataatttctgagtccacatgtcaacgataaaggtatcgtacatttgactgcagaggatctcaatcggtcgtggtgggggatggaatgggaagggtgagagtgtgatataaacaagtggaccccacttctctccaccaacgctatctaggaccgtgtatttgtgtgatccaacggcacgaaatacctcagggggttccagttttttccccccgacccccgaggggcgctcgaaataggcttgaaaatgagggctctttttggaaatttttgcgaacctcccgccgccgcctcaccgtcgccaccggcgatcgacggcggcggccggccagctgggtgatgcacatcatgaacttctctgttattttgcggcgtgagcttgctactgatgaagtgattaaccgcttgctgctatcttgagtcggttttcagaaatgtgttggatcaaaaagtgtctgcgttgtactatgtaattctataaaaaaaactatcagttttttttttgatgaactggatcgaaagagcaggaattgcactgcaagataaatgtaacattagctccgttttgcgctttgaagatgaatttgagttgcactgcaagattgatggtgtcattgggctttctagctacttgctgcagatgaacatgaaaaaggaagaaactatttttcaagctgaaagaccaagcttcttgatttgaatgtgatgagattaattgcaattgtaaaaagaatcagcttctcagctctgaaagctgaagctgttacactttactgaaagatgaatttgtgatgtaactctgcaacagaattggttgatgttcttcgctaaattgccacaatttctcctcaactaatttctgattgatctgccagtttgcatgacacagaggaatatctctgtacttaattaactaacctgtatttttcactttgacatatttgcaaaatgtgttcccaatgtttcagaacacaacaatctcctgacaagaacacatgatcatcaggagttcagaaaactcactgtactcttctgcatttctgttgatatttccagatgtgaatcactgtacactaattctccttgctgacactgaaaattctgcaacaaaacccatgtctctcaattcatttctgattgatctgctactctgcaattctgcatcacacaaacaggaatatctctgtacttaataaactaaactgtatttatcactttgggggcaaattaatctttgacatgtgcaagatttgctcccatgttttcaggattcagatcacataagacaacagttttttttcctgacaaaagctcatcaggagttcagaaaactaaactgtattcttctgcattttctgtagatatttactcaaactgaagagaagccactgtaataaattccaatcactgtacactaataattctccttgctgacactgacgccttctccggcgtgctcgccggcggcgaggaggagggcgcagacgtcctcgacgtcgtcgtcgccgccgttgtcggacgctgccgatgaggatgatgatgatgatgatccacggaggctgtcaggcggcaccggcgtcaagaactcgacgcagccggtggccttcatgtgctcgacgccgtagtacatggcgacgccggcgacggccacggcggcgctgacgacgagcgtcctggcggaggcgaggcacatgacggtggtgatgaggacgacgggcgggacgcacatggcggcggcgcccgcggcgccgacggggatccggtacgggcgggggaggtcggggtccttgacgcggagcttgacgaaggcggcgaacacggcgagcatcccgaggccgtagaggaagttgaggaactcgacgatctcctggaagctcatgaaggagaggatgacgacgccggtggccgagcagaggatgctgtacgtcggcgtgccgtggcgcgacctgcgcgcgaagatcgccgggatcatgcccatctccgccatgccgaggagctggaacgagtcgccgctcatctcggcctcgaagagccccatgttggacatggccgcggcggcctggatccacacgcgcagccacggcccgccgatccggtcgccgaccacggagaagaacccgtccgtccactcccccgccgtctccgacggcagcgcgcccgtcccggcgaggagcgggatgaggtacgcgcccacgacgagccccaccgcgccgaacaccgccttcgggaacgtcttcctcggctcctccacctcgccggcaagcgtgctcgccttgtcccagtagttgaggttccagaacatggagttgaagtaggcgcgcggctcaacggcggccacgttcacggcgagccaccgcgacgggcggatcttgggggcggcgagcacggcgagcgcgacgaacggggagagcgagaacgcggtgagcgccagcgcggagaggccgacgaggtggagcccccggaagttgaggtaggtgagcgcggcggtgagcgcgagcacggcgagggagcgggccggcggggagagcacgagccccccgccggagcggaggtagtcgaggaagagcaccgggtagagcgcgttgtcgagcgtccccgacgcccacttggagaacccgacgaggaacgccgcggcggggccgaacgcggcggagacccaggcgacgtagccggcgttggtggggaacgcggaggcgagctcggcggtgacgagcgcctcggggagggaccagagcacggggaggacgaggaaccccaggatcgggaggagcgcgccgccgccggcgcggaccgagtcctcgatgccgaaggggccccccgacacgtcgtagaagatgagcgcgacgagggggagcaccgtcagcccccgccgccgcgccggcgccgcctcgcaggctccggtcataggcgccgccgccgcccgcgcggggggttgggggttggtggggcgccggtgaggcgacggcgacggcgacggcgacaaggtgttcgacgaggtcgcgtgggcgtgggtgaggaggaggggaagatattgtggggggtgggtgggtgagtgaatgacaggtggggcccacggggtttctggtcccgcgggaatgggaggaatcgcgcggggtaatcgcgtcgggtcggtgggcccacgtggcagtgtcggatgctttaaattaatttttgccaataggccttctaattgtttcttttatggttgataaattaaagtttttatggttgacaaaaggcagcacatggcgcggctctgtcgctggttggttgcaggaattgtactccttcccaaataaaataaacaatgtctgactataagcaattttttttaagagtaaagtgtacgggcggtccttaaacttgtagcggtatgtcatctaggtccctaaactcttaaaatgcaaatccaagtctccgaacttgtcatagtgtgtcatctagatcccaaatcaccacaaccccttcaggatcctacgtggcgtgtatgtggcatgccacacggacatgacatggcattattttgactgacaaatgggacccatttaatttttttcctttttcttttttttcttatctttttcccctttcttctcctttctctgtgatccgtgcaagaaaaaaaggaaaaaaaagaagaatgagaagaaaacgaaaaagaaaaaaagagagaaggacacgtcacgtccatgtggcattgccacatcagcacaacgtaacatcctagaggggatgtgtcaatttaggacctagatgatacactttgacaagttctgggacctagatatgcattttgagagtttaaggacctacatgacacaaccttacaactttaaggaccgccaatgcactttactctttttttttaacgaatcgatatttatagtatgtcaatttcatagaatttagtaggagtaaaagttgtgcaaatacgaaaagaaaagaagtgtagagaaaaattaagctaagggatgagttcggatagccgtttcgttcctgctagggctcatgttttttgacctcctcgattttcgccactagggctaccgtcgaaagttcgttgtgttggaacactatttggtttctctccttccaaaattcctacgccgtaagtacgatgaggggtgcggataccttgttttggtagtacctcgctagtggccaatatcgtccatcattcatggaccgtcgtagttgtgcaccacattaccgatttgatttgcttgagcgaggtatatgttgatagcatgtcccatatatctattcgtgtatctatattccattaggaggtggaatgacattgtgggttgtgccagcaaagtgagcagtaggtaatatctaaactttaatcataagttaatttattttgtgatggagcgcataacaaggggcttagctattaatttttggttttatattgatacaaaccaaacaagagctagctaattttgcactactggtaggatagagtcatagagaaccaaacgagtctaaaagattcgagtaaaaattggtcaatgataatcccacgtcatatccacccttttgcaataatgtacacctaacgtttgtcacgttgttagttggaaaaacgcacaagatacattaaaatgtgtgacgtttgggatttagcatcaacatcagcgagacgtccgtgcgtgtgcccgatgggagaatcgatgctcgcttcttcatttcttcgcttccgtttttttttttccttttgcttgattcgattggtgattctttcatatctgtttttcttttcctcgattggattggtgattcctttggttgtttacagctgaagcacgctatagtattgcataatcaagcgtactaataattcttttaaagcaaaatggatcaaacaaaattgcttgtaactccatccatggcgattttatgataaaaaagaggatgggattgtaagtaatctttgtttccaaga

SEQ ID NO: 82045 - DNA, 1117 bp, Oryza sativa
gtggcccagtagggggacacgcatccctctactgtttttttttttttaccgcgtcggattttactgcatttttaccctcctcttctcaggcctagaaaatatttcggcgcgacctgccaagaccgagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtattttttcttcgtagtactaatatgttcaattaatttaaatcgtatcattatttgttattaacaaatatataacgatatttactttgttatatagagatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggagcggtagcagctaagcgatggcaaatcattgtcaacgacatgcatggcccatcttatcgccatttatatcgccgataaggaggttgaccctgccatctaaccgcagcctacggccccccagagaaatcacaagtcgccacgtgtaccaacctgattagtcaccagtagctttgtctgccccagttggccactactctctcggtcttaaaaaaatccaatctaatataaggacggacataatctagcacaacaaatctagatagtcttttgccaagatctagatagtcttttgccaagattcgttatgttaggttacgttacatctcaatcctagcacaacaaatctagatagtcttctgccaagattcgttatgttaggttacgttacatctcaatcctatgttagttttttttggtacggtccatacgaggaagtatgttctt

SEQ ID NO: 82046 - DNA, 743 bp, Oryza sativa
  unsure (1)..(743): unsure at all n locations
ggatggaatttgtagactactggtacagnagntcatcaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgnnacangtgacctcacctgtgacggcccanagtgttgggcccgtcacaggtggtcttacctgtgacggctccacggttggcgcccgtcacaggtgaggccacctgtgacggccacatatttggagcccgtcacaggtgattttgactaggggtgacctaaggttggacattcttttagatcgatccataatcggcgcccacttttactcactaacttttcttgaccggcgtcttgcctttctttacctctttgacagcctttaatcccttctttccaccgacgattgtacctcttcaaccgcctcctttatggcgccaaattctcgccctctccggccccctttaacacttcttttcactgttttgaattttaactttccggcaacatttttgctggcggcct

SEQ ID NO: 82047 - DNA, 742 bp, Oryza sativa
aggtattacaatccacaaacaacagaggacaaacttcgcatcatggattgccacttgaagccactacaatactagtataatttgtgttaatagaattgcaggcatacgtgagataagtgtgaataccccaaaatcccaagtagtatgggcaagctctcgtccgttccattgtacactgctaactcttccttggtccacaacctctgccgagtataacacaggaagaagagaaaatagtgctcactatacgatcaaattttactattcacaatatcaaaaggaacatagccaaaagcctaaaacagatactccttccgtcctaaaatataagcatttttagctatgaatctggataactgtgtgtccagattcatagtaaaaaattattatattttgggacgaaggtagtagtaaatctaaatatgtagcagcagtaaagtccagcatacaccatacagttacagccttacggggcatatcattaatttcaccagaaatctgcgaagttgcaactgggaacatctagtactaatagcaactagcaaccagctgattttgcgggcgatttcggatccagaattccggatcagttgcaagcacaaaggcagcttccacacattagataacaaaaaacacgcaatatctaacctcaaactcacaggtaagccagtggaaaatttcgggagaagtagaagtagagaacgcaccggcttcctgaggcggtagagctggaggacgacgg

SEQ ID NO: 82048 - DNA, 10481 bp, Oryza sativa
aaaagcatatcaaaagtcattttggtcttcctaggggctttagaagttgaagctccactcttattctccttccaaatgccaacctccggcttctttggcactatcgtcttaggccttggttcgccaatgaccactccttttcccttagtagattcggcttactccggccgaatcaacaccttcttatcattgaaattaattgtgttcaccagaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatataatttgtttttcttgtaaaagataatcaaagattttgtcacacttggccacatcaaaactatatttaacctcactttgccgatctttgcgaggagtcggcattaggttagagcaaacaaaaggcttgtttttattagtccatgaccattcggcaacatatatatcatgatcaccttcctcctcactatcactagcctcagggtaatcaatcacattaacattaggctttttgtcatatgatctaacaagttttttattatccttaacccggctttcttgagccagagccctttgcataagttgactaacatcaagaaattgttggtgtcacgcccggaatttctatccaaaattccaaacgcttacatgtgtgtgaaccctcgtccaggaatcagccgaggcacataataacaaattgataatagagtacaattattactctaattaataagcgtataaaatgtcattacagaggtagatagttcctctcaaacaataaagatctaagcagcggaaaataagataaacggcgcagacggctccactccacaggcagcttgaccaaagctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaaccatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgaatcttaagttatcccaatagtgagctaatgtttctaagcagggctaagcaattatatctaatatctagttgaaccaatataaataaagctcaactagtcaaattataataacccaaggtatcaaggaataaagtaatcaagaacaaaaagggctataacaaagaataggttaaacccacccaatgacatttgaaaataaatgcaatatttgaatagaaacagtagctttaaacgggatcaacatgctcaaagggttgtttgggatctgtgtgacttgccttgctggccttggaactcttcaaactcttctccggcgaaaacggactctccggaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacacttatatagattttaattgaattatgacgcaataatgaattatttttgaaaaggaaaaggaggattattgcgtcagcgggctagggttttggtggaccgggcgcacggcggcggttcacgcgaacggacggccgagatcgacttgatccaaaacggacggccgagatcgaacggtccacgaccggctcacgggagagggcgacgatgacgtcgacgatgacgtcaccaccggcggcggcggctcggcggctcagacggctcggacggcgcacgctcgctggcgaacggcggcgcttcggcacgaacggagggcaccaacgggtagagcgcgacgcggcgaactcaccggtgaccaaaagagcagcggaagaccaacggacggcgacggcgacgaggttgaaacggcggcggtcttcggtttgacgacggcgacgatgctccggcggtctccgactgtggcgaagcagcggacgaggacggcgacgacttggcgaccacgacggcggttttcccgagcgacggcgacgtctggaacggcggcggcgcacggctggagcgacggcggcgacggcggctcgaagctacacggcgctagggcgcaacggacgaggggaggcgaaggcgagggtggcggcgggtagaggagacaccggggaagcttataaaggggctaggaggcggcggcgaaggcccacggcggccggcgacgagatggaaagctcgagctcggagagagaaaagccgatccgattcgaactcgaatccaacgatttccaaaccgatttagccgatgtttccaaaggagaaaaggtagaggagatctcggggatcatttcccctcttttgattcggccggagaaggaaaggagcggccggatttggaagggaacggcggcggcggcgcgctagggttcggccgggcgacggcggctcggggaagacgaacccccacctgtcagcgagcgagggcgcgcgcgcgcggcggcggactgggccggactgggccgaggagagagagaagggttttgggcccaaaagaagactttttaaaacctttttcaatttaaattatttcttaaatgtaattccatttattaaaaatacttccttagctcaaataaatcccagaaaaatctaggaattatagaattaagcaaagtatttaatgaaattttatctgggcccattttatattggaatttattaattaaaattagatcttctcttcaagacttttaaaaaataaattctaaaaattccatttaaacaacaatttatatattttgaattttcagggtgtgacagttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagtaaacaagcgcaatttaaaaggatcactattagcctcaccacattgcgccaaaaattaacctacatgctcccatgtggtcttactatcctcaccactaaacttggtgaattcgggaactctataattacggggaaacggcacattatcataataatcaggatacggctttttgtaaaccctagcacgattcctagtttcaattcctaataatctcactaattatatcctccatattattaggcccttgttgatttggcggtggatttggtggcctaataggttgtgtttgtggcgcaatatgattatattggctttgtctagtatcaggaggataccccctagtaacgtcattataagcattaggaacatgtgggggaacttggggattatttgcagtagtagatataggaggatcaaatgttctaagatgatacaaataactagcattagtcattggatctattccctgtatcggaataattgcgtcggtctgaccggcccagggcccggtctgaccggcatccagaggcgtggtcggaccagcctgagtcccggtctgaccgccggggtagtacccgttctgaccggctgtctggccggtcggaccgacggctatgttgcggtctgaccggccgtgtgcgtcgctccattggttctactacccgtttgatctataggaggttggttagcagtggtagaggccttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgatacctcatcattgcttaccaaatcaggagcgagcttaggacgtggcccgggcttgatgatcacgccttgacgagtcctagtgcttgccctcatcaacgcctcccgtgtgagctcgttgatgtactcctccatagctttgcggtcttctccttcgaagtcatccaatgtgaccggtatcatattgatggctccacctccgtcttggatggcggcttcgtcatgacgaagtcgaaattgagttgacgatgaacggatctcctccccagcggagttgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctaaataactacctgtctcgtgggcaaaacggaaggttttcaggacaaacctacaaagagatgtcgcactctcgcagcgtcggcagacggtttacggcgcaaaccgacaaagatggacaaactaagagaaaactaaaagcaatacgaaaaaacgattcgattgattgattgtagattggttttttacaatgaaccggtcatgtcccttatataggggttggtcttgccctctacaggccctcctccacgtccaacttgaggtagaaaccaaacgaaacccgaaacatgccttcccgagcaaggaaacctcgagacccgacaaaacacaatcggactcggacctgccggtcagactggccacacaccgccggtctgaccggccctcaaccggcggtctgaccgcccaacacacggcggtcagaccggcccactcggaggaaaccggtagacttccaaattttggcaatctttcctattttaatcctaggtgccaaatttgggtttaaacacatgcccccctgcctttttgatgaacaacgtgaatctaaaagcatagaacatgttttggtcttaggacgataatccaattaccggccatagtacctcctaagcgtcttgccaaacgctcgggaagtatttcttcaaatatttcccgttgattgctcgctgaaaatgctccccttgaagtgtctccaaaaaatatgcgttccctcgaacaatgccgcacactcgataaggaccctcccaactaggagaccacttaccgaactccttggaccgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaagattatctcccatcaacgtcttgtaatcttcacttgacaaatcattttgcttgatataacgaagagaaccaagatttacctccaccggtaaaatggcttcttgaccataaaccaactcaaaaggagtgactttagtagcaccatgtttagatatcctatgcgcccacaatgcttcagaaagcacctcatgccacctctttgggtgttcctcaatcttctttttcactaacttcaacaatgtcttattactcgactcggcttgtccattagcctgagcgtagtaagtagaagaactcaacaatttaataccataagattcggtaaaactcttcacttccttagacataaaagaagcaccttggtccgtagttattgtttgcggaataccgaatctatgaataatatacttcaaaataaagtcaattacctccgtatgagtcatattcttcaaaggcacggcttcggcccacttggtgaagtggcttcggctcacttggtgaagtaatccgtagcaactagcacgaacctatgcccctttgatgacgaaggataaatttgaccaatgaaatccaaagctcatcatcggaatggccatggtttgattatggggttcaacacggcggcaggcgccaattgaacattgccgaaccgttgacaagcttcacatcctctataatatttgaagcaatcatcaatcatcttcggccaatagaactccgctctcctaagcaatcaattcatcttgtgggccgattgatgagttccacaaattccttcatgtacctctcccatagccactttagattgatcttcatctaagcacttcaacaagacaccatctatatttcggcggtataaatcctcatcaagcaatgtgtatttgaacgcttgccgcagaattttccgatcaaccttaagtgtgggatttttcaaatatcgaatcaaaagaattctccaatctccttctgcttcctgggcacaaatgtccgaattcacagttaattcggccactatattgattgaaacgtgccccccagcgctctgcccagaaccggtcagactggccacacagggccgttcagaccgctcagagtcgccggtcagaccggcggcatgcggccggtcagactgcccctggtcaccggtcagactggccgagcaatgccggtcagaccgcccctggtctccagttttgccaatttcgcacaaagatttaaaatcaagcaccggctcttctaatatcagaaataatcccttcttcacattatagccagatgcttgttgtgccaaattatttgctctagaattatcatgcctagcaatatgtctaatagcaaaattatcaaaattggcaataatatctaaacatgaatcaaggtacctatttagtgatctgtccaagcatttgtagactccggcgacttgttgcaccatcaattccgaatcaccaaaagcctccacgtatttagctccaaccatctccataacttgtaagccgaacaataaagcattgtattcggcttgattatttgtacaataatactccaaacgaaccgatgcttcataacacatgctattaggtgaaaacaaaactacccctatgccttgaccttctttgcaagaagaaccatcaaaataaatcttccaaggtataacttcaactaagccaacttctccctcataagcaatatctatatgatggtccactataaaatcacatacaatttggcctttcatagatttcaatggttcataagccaaatcatatcctctcaaaagctaacctcaaatcggctatgtatccctccataccatccgatttgacaacaatatcatcaatgtagatctctaagataatgcctagcaaatcatggaagatcaaattcattgccctttgatacgttgcaccggcgttcttcaacccaaaagtcatgacaacccactcaaacaaaccaacaaatcccggacacctaaaagccgtcttgtacatatcctcttccgccataaagattttattgtagccggcattaccatctagaaagctaatcaccttatgacccgaggcatcattaatcatcatgtcggctataggcataggatactcatctttgggagtggctttatttaaatctcaaaaatctatgcaaactctaatcttaccactccccttcttctccaccgggactatgctagaaacccactccgcataacgacatggcctaataaaccccaccttcaacaaccgatcaatctcctctttgactcggtcatatagcaaaggattaaaacgacgaggtggttgcttataaggcctaaaacccggtttaattggaagccgatgctcaacaagctcacggctaagacccggcatctcatggtactcccatgcaaagcaatcaacatactctttaagtagctcgataccttaaccttataataggctctcatgtttttgtttacaaaagtcggccttggtttagttccatcacctatatctacttcttcccaaggatcggccgatgtaaacccttttccaaacttctctacttcatcaaaatcttcaatggtttcaccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgacaagcattggatattcccatgacgccactcaaaagtagcatcggccattgcaacctcggtcgatgtatccgcttgcacaatttcaacatcattgccgtcccattgaattaaacattgatgcaaggtagaaggcacacaacaattggcatgaatccaacaacgactcaaaataacattgtagttaccttgcacatcgacgatgaagaaagcggttggtagcgtcttgtttcccacggtgagctccgccgaaaagataccctttgcctccgttggttcaccattgaagccattgagaatcatgttggtcttcttcaactcatcatcctcacgccccaatttcttgaataatgagtacggcatcaaattcacggtggcacctccatccactagcatcctagagaccggcttcccatcaacatggcctttgagatagagaggcttcatatgacggtttgattcatcgggcttctcaaaaaccgcatctttaggacctaatgaaagttgagcaacctcggcttcatccatagcacaaaactccataggcaacatacaaaccatgttgatatccatgtcttcttttggagatgattcacttttatcaaccgattgtttctccttctcttctacatcaaccggcttttccttctctatggatttatgcctccataccggtggtggtcgcaactcattgaatcttttatctctttgttcttcagcctttttctctcttatttcttgagcccgaagacgttgcaaccttctcttttgagtagccgtcaaatccttaggcatccatctaggattcggctctgttccaggaggtaaataatgtcccctaataattttgtttgaaaacgatgaagccctcacatcgccctttgcaattctcctgttaaaccggcgctggagcccggttagaccggccgtagaccaccggtcagaccgaccagatgcgccggtcagatcgacacttggcgaacggtcagactggcctgaggcgtcggtcggaccgctgtcgggtcggcggtcagaccggcctgatggcccggtcagaccggccgcatggctgcggtcggaccggccagaaggcttggtcagaccggccgactgcgaggagctggtttcggcttcggattttttgtttgaagatactccaattccatctccagaaggtattggcacatcatgagaccccactttgatggtaattacttctgaagtccttgcctccaccttgatgcgctttccttccctcctttcttcattggcccggttcctgccataaaaccggccattatttggtgaagacaaacgctcatgaattggccttcttgatcctccccacccttggttgaattgcattggaggcatatgattgaacattggcggcgttgccccccatggcatgtaataaggataaggataacccggcggctgcattggataagaccccatgacatgtcttgtggatgatgatatggaggtgaatgcgaccgtcttggtgaa

SEQ ID NO: 82049 - DNA, 1474 bp, Oryza sativa
ctgcaagtagttcatcactgatcttatttttttagtgcagcatctattataaaatttctcattataattaataaactctgctaggaatttaaaattagattcaccaaaaaaatatcatggcagaaatagtggctcagctcacataaggtcaagatataaacataatggctggcttgcagcttatggatgctaaacatgtcttgaatcttaaaactaatgatacaaatttaatattaggtcaaacaaaacagcaacctctggattttggggcttatactgtttgtgctttgcatgtgtccgaaacaaaaagaaaaggtttgcactttgcatagcattatcagcagttttaacaaacaactttcaaattgtcaatgattagcaagctgaactatttaataactacaaccccccaaccccccccccccaccaaaaaaaaaagaccacattttataagaaaagatagctcaaacacacaaaaaaaaaagttttcactttgcataacattatcagctgattttaacaaacaactttcaaatcgtccatgattagcaggctgatcaaatttattaaccagcacccccaattattccatttctgcgcacaaaaatgaattagcaagcaactcaattgtggagtactggcagtgaaccactccaccaaaacagcaaagaaagataacgcaacactccgtgcattacctcgccatcagccgcgggctccggctgggagtgccgcagcaccggcggcgcagcccgaagcgctagcgtggtctcatcgtcctcaagctcacgcgcggacttgacgatggggagcttcttgtgaatgtcgagcgggcgcggcctgaaggagagcctactcatggccgcaacttcatcagcgaggcctcaatggagagccttcccttcccgcggggggcacgggagagcgcccgcgcgggacgagccccccgcactacgccgaaccccgtgggcgagggggtgaggggtggtcgagggcacggccgcgggcggcgcggggagcgggcgggagcggaggaggcggcggagatggcggagaggggattccggggcggtggggtgccggaacgggcggattggggagctagggttagggtttcgggggtggaggacgtgccctagggtttgaaacggggagatggagggaagaagcgggggatgaagcagcgagagagaaagagtcgaggggaaggggaaggacagagaggcttggttcggttgacggcgtattccacgagtacgtttccctcgtgtggttacgtatccgtctcaacggtccatatcctatggacacataggcttcccatgtatgcgaactatcaaataaaattcgaaaataaattggacgcatactttcaatagtattacacctacatgtgaaatcttaccttcaaattcaatatattttagccgtagcaaaaacgacaaaattctgatagaaaattacccttaaaact

SEQ ID NO: 82050 - DNA, 4605 bp, Oryza sativa
caaccaaataagataagttttcaaatcattgcaagtttatgttcttgattgagcacgattattggacggctaacaacatgattgtgactttgtgatttattttagctctgaggtactgatgcatgcattgccctaattacaggtaaatcttttattcaggtaattatgttatcaagatagttaattaggcgccataatgtttttttgtataattttgtgatcactacattttacctgatatgacttgagatatagttttgagtttggtcattaggtaggctaaacaatgcgtaagtcatcaacctcttcttcagtaaaatatgtttatctaatatattctactcctacaattgcgttgataattgccatatagtactagccattatgcaactaaaacaggggcaactccttacgtgtcaccaagcatatatagttagtttttagtgccttgaaaggaattcatcaaaccatgagtggcaaatcaaattgtgctcagaagagcctcaataaacttctgctgatctgcactctaggcagctaatctttgatctgtatacttcctgcatttcatccacaacttttgtttggcatgtggtaattaagaaaaacaaatgacccaattaggtgcaatcagcacaagtaccgataaaagaccatgttaagataatttcaacatcctctggtgttgcagatcacaggacaagatcaaagatccattcttttcttttcccggtgaagatcaagatctgctgaaaaagctgaattaaacaaaaggcaatcaagcagcacacgaagtaataatttggcactactaagctgaataaagaaaggtaatcagcacacgaagtaataatttggcactattcatttgttcattttcacacgctctgagcacattatcctcaaccctgctgcctttttcttttctctctttcctctttttcatgtccagatctgcattctgatttgatgacatacgaaatgtgaatcttctgatctatgggatggagtggtgaacagaatttgaggaaaatatggacgggcacacggcactacgtcaaactggttggcaacttgtgatcatctgaacaattgcaacaggagtgtacaatatgattgcaaaatcacggtctctgctgccagtatatccatattttgcaatgatctaaatatagatgacaagatggacccgaatatgccatatccaggtgtgatataaatggaagatgtacacatttgctgttactgtagtaaatcagatcgagatcaagaaagaccataaagaaaccaaattaaaactggatcattcagctttgcaggagtcagcgtgaccttgtattccttgtttgtttagatcaaacattatttcgttaaatttgaattgttacaatactctctggagaaagtttacttgtaaactaactaattgattcagcatttgtagaaaaatatgaccgtattgttggagccaaactgcggaaaagtagtacagttctcaggagactaataaatctaacttcagaagaagaggaacctcaacatatctcaatgatcacatttgatccatgccagctcaaaaactatgcagcacgagccgtagcttcagacccagtgtactcatcaggcctgatgaacacaaaactttggttagtagttgattatatggggagaaaaaaaaagcaatgaagaattagggataggtcaaattaaactgaagtcggatgagaaaattagcaagaaccataaagttacattgcaaacaattgatgtctaaaagaagagattgctttttttatgggccatcagtttgtttggtgcatctgctgttaaaggacaagaaggtttatagtgcatatgcactactgcaaaagattaatcagataaaattaccatccaccccaccaaaaccccaaaaaagctcaatccattgttgttgtgacaaatatattgtacctttgaactccttcaccaacttcctttgacaaatcattcaggacgctctgaaaatattgacatcaagaagcaaaaccattatgtaccatgaattcacaattcaaactagtacataattataaaaaaggaaaaggttttatcagttcaccttgatgtttgtgctatcgttgtcaacatttttgctccaaatgcacaacttcttcaaaatactttcttagtcggccttccaccattttctccatggccatttgggatttcctggagctttcagcctaaaaagtttcatagtagcatgtcattaaatctcacataacttgcatgcagttcagtcatattctggatggatgcagtccatgtgtccccagaagatgacaaaagatattgctatttaattcatggaaaaataaacataactggtatcataaacttctaatgtgattcacattgtgttccattgcatagctcatctctgaattttaacagcccagctgtcttgcttacataaacataaaacgatgtgacaggaatactaattccattgtgagtcaacagtttcctttccttttcttttaattataatgagttaggacttgtcgcaagatatgcatttttctctcaactataggtcattattgcccatgtctgttgttctgttaagataacatcataacacttcgtacggtatgaccttatgatacctgatatctcacttaatatgtaaagcacacgtccatttctgcaattgtaagctaattatatagaattacggcgatgctaaatttttccggtgcaaagaaagtagcatttgtcagaataaggtacttgagtccggagtatgcccctctcattttcaacagctgaagcggagaccagttcttttgataaaaacaatggttttgttgcaacgatatgcattgcaatagatttcccaactctcttaagagcatcaaggggagcattgctgtcttctgcctctagtgtgatcaagccagcaagacgacccaacccttatttcagaaaaaaaaaaactcattcattcagtgaatgagaaattgcaccatttaccatatatcaaatagaacttcataattctgacgaacataaaatatggattgctggtaggaatcaaattaataacgcgagcaagcttagccagctcagtgtaagaggcaagtatcactaaaatcatattactaccaatggttttacaaaagtaaactatgagcttgcatcctactaaataaattttttaaaaagctaaaattcatcactggacaatctaagagaatagattaactacaatttagattaaggaacataatgtccagaaagtccaacaaatttggatttctgaaaaatgaacccaaaagcaccacaactcattcactattgccaaatactagtaaggtgcccattgcaacagcttggtggagggcctcgtctgcacaagtaataggatcacttctagctatgttaattaggagcaaggccaactctgcccccaactgatttgtcgtcagtgagcccccctgatccgagtgttaaaccaaataattcatccaactattgtaatcataaattatgcatgcaaaataattgtacatgccaatcaaggaccagccagcaaagtaccgattggatggaaaagcagagtttcctttgtcctcccctcccacccattctgtgcagtgagacccatccttcccggtagaaaatctagtataaaaaatcaaaatagcagacccagccccaatgcaacactgaggtgttaaccatgcaaccgccatcgccatcttggctgtcgtgtctagggatgtaatgctgaggatcgaatactaacacacacacacacacacagagaggattgcccatttggtctttttctgaaccagttttctaatggaagagttgggtctcgcgctgtgcacgatcggtgggagacaatagtccactttttagagtagtagagatgcaatgtaattaaataaatgtagatctaatgctgttataaatccaaaatcattatctctattccactgatcttattcataggaaatgaagaaaatgtagtaataattagatcagcaagcagtaacttactaccaaaacagaagacaccacccaggcaccagaggtagaagtaccaattcccatctccccttgagcacagcacttgtgccttcaaatccaacataagaatttgattaaatgacaggaccaaaatctcatatagagatgaaatagtcagggaatttaccatatttatgttgaaacaagccacaatgtcctcctacaaatttgaagttacataaaaaaaattgagatgcaaatcaatacaaaaagaacattgaatagttgacaggaaatacactcaaattgacaagaaagattggttctatcgacaggcaaaatatcacacaagctactacttcagtaaataaagttgattgatacttgagcgttgttgatgcttttacacaaaaaaaaagagtattgtagatacaaatatacaataactaattgctctgatccttcagaatcagtgctgcttatagttaaaaaaaatggtccattaagatatcaattaagcatggtcatcaactaaggctgagttcgttttgagggttcccaaccccactccctcgttttccg

SEQ ID NO: 82051 - DNA, 11886 bp, Oryza sativa
tattaagtatttacaaaagctgaatgtttctttgtcctaccaaaaagttgattggtttttcatgatttctgactgatgttttctatttatatgctaatctacaatgttcttatctgtatatttcttatgttctttctgtagaggaatagatttggcccattggaaagagcagctacaaactgaagcagaaccagccaaccttgacaagtttgttgatcatttgtccgagaatcaattattccctaacagggttttggtggactgcacagcagacacaagtgttgcatcccactattatgactggttaaagaagggaatccatgtcatcacgccaaataagaaagcaaattcagggccactggacaaggtaatttttttgcctatcagcaggctttgctatcaaataaatgcatatgcctttttatttttaaatagttgatcttcaaatgagcatatattttttatgactgatttattcagtagaacatggttaaacatattgatggaactagacacatgtcagctttgtatggatgtgagaagagtcatccacagtttttagtacagttgaatttacagtgctagatataattggttgcctttattgactaatgaacttatttcccctgctgcacagtatttgaaacttaggactctacaacgtgcatcatatacccattacttctatgaagcaactgttggtgctggccttcctatcattagcactctgcgcggtctcctggaaacaggtgacaagatattgcgtattgaggggatcttcaggtcagtttgagcacatgattacattgtgtggcatatcaattttcatatgctattataacgcatgggtggagtaagatacttaacagatacttttatttagtgaatttagtgtgatgctgcctgataatatgctctgctgattgttcaactgcagtggaacattgagttacattttcaacaattttgaaggaacaagagctttcagtgatgttgtttctgaagcaaaagaggctggatacactgaacctgatccaagagatgatctgtctggaactgatgtagccagaaaggtacttcttccatcataggcttatcaacctacataactatacttcctattgactactctgcataacctgcttctattggtggttttgagtaacacgtcataagagatggaaaataattttatgtgccttcatgcttcaggctactctaccaggctcctcagtctttacactcttcagttgtatatctgtcttttcttttttttcttttttttttgcggggcagtacatatctgtttgaatggcacttaggttacactgttgaaaataaataaaagggaaccacagtgtaggtactgaactggaacaaattatatttttgtttcctcttgagcctaatttatcacaacttccttatctaggaacaaattgactgtctatgttttcaagatataaagggttcactcatggaccttggtaacttgagtttagttttcaccctaaatggtgccttttcacataggctgcttctattggtggttttgagtaacacatgacataagagatggaaaataatttcatgtgccttcatgcttcagaagacagctatagaaaccttgtcaggctccttttttcctttctcctctttgtgccttatctctctttctctctctctctctctctctctctctctctctctctctctctctctctctctctctccctcttatctgccttagctgctccttgccttggctatacaagcagcctctcagttggccagaaaccaaggctagatttgctcaggggttaatgattggggtactgatgattggagtaaaaattataagaggaaggagaactgagagagagaatatacaccgaatatttgatggatgaattcatgaatatttgctcaggagttaaagacttgcatgattgataggtgcacaatattgaattcgtttttcactatgctatcttctctatccttttcagttttttttataatttaaacaatatatggaagaacatcaatatttcacacttgttttgtgagaacatttattctttgttcaattggttttttttttttttgccaatcaattacttttggaacaggtaataattcttgctagggaatctggattgaagcttgagctttctgatattcctgtaaggagtcttgtgccggaggcattgagagtaagattgcatccttcttgacgactataccttgatattaacactctaattagatttctgttatgcagtcctgttcaacagctgatgaatacatgcaaaagttaccatcctttgaccaggactgggcaagagagagtaaagatgctgaagctgccggagaagtaagtagatctgtttccatgtctcaaagtaaccgttattgtttgctgatattttcatatcacctcatgattacaaaccatgctgtatttcaataggcttcatattagttgttggttcagtacttattgttcgaaatttatgatagaaagcctgctgaaattattatatgtattatatgttgtcaaaatgaagggttaatattatcatctatataactactgattttcagtaaacattattctgatcgtgttgtcatttgctctgaatacatcaccatatacttctccatgcgagattccaatctaagggactagtctaaaccatctattcgtttaggttttgcggtatgttggagtggtggatttggtgaacaaggagggcaggtcgagctgcggaggtacaagaaggaccacccgttcgcgcagctatctggctccgacaacatcatcgccttcacgacgtcaagatacaaggagcaaccgctgatcgtgcgaggcccgggcgccggtgcagaggtgaccgcaggaggtgtcttcagtgacatactacggctggcctcctacctaggcgctccctcataagctttgtagcaggaagcattttctgatggtggtcaagatggctttgaatcttgtaaggttgcctggtttcttcttctcttttcctttgcacaagcattctaaatcacagtgaggaaataagcctttgttctgtagtgatgttcgtcaagggcaataggtaggagttgtgcaggtcttgttggaaaacaattcttgttcgttgcaataatggtgtggtcgtcaggtttgtttttgatggtgacgctagtgaggtgagacggcattacaagtgaagaatcaataatgcaaagcttcgaatcgtgatgatggaagaaaaaaaaaatccaattgtgcaatgctgcgtaagacctgaaaggtggcaatgtctctgggaccgattcgatcgaccttggaggttcactttacatgtcttacgacctttaatcctgcagagtttggttacaaaagggcttgggattgaattagaatccattggttcctacatgtcttactacaccaacaatcattaatcacatctcaacctaatactagcggaacaggagcatgatgattcctaaaccataggttactccatgttctaaacttgaaatgagctcacttggttagataaaacggaggtaggttactccatattctaaacttgaaatcagctcacttggttagataaaacggaggttgtgcattaagagactcgaagcggcatcatgctggtcagacttcagagagaccggcgtttgtacaggaactgaagtaggatagtgtcatgtgtcttgaattgaagtataaataaattgactgtctgtcacttactaatttgagtggaaggcatataccatgtatggttttttatgacgtggagaagagggaatgaggagagggagaatagtgtgtgtgtgtgtgtgtcattatatacccttatactatgtattatctatatgatcaaatcattaattacacgaatctcctatagacaactaatttaattaggcgcatgcagctgcagtttctgtgtttttctttagtgtagagggctaacatttggcaaggggaaatgatgtactaatttttgttatacttttacatagtttcagtacttatttggcaaggtggcaatatcaaacttttaactcactactacacaaaaaaatgttgttatagttaatacacgaaaaataataaaatattaatatttgatacattgacaaactaaaggattatctttttttgagaaaaagatgttttttagaaaaatatatatacttttacatatcattagtaatgtcataactagaaaaactaattatcaaccatatgtgttaagctttcctaaggaaaaccatagatatgccctaaataaaaggaaaacaatagggttcccatataactaaggctgcatcctggagagaagtattctccccgcatacgaaaaatgaaacgcctcatttgtgcataattgattaagtattagctaaaataaacttaaaaatgtttattataatatatttttttcaacaacttgcccatatttttttaaagaagctgtttaacgcttcgtaaaacgtgcacgtaagaaaatggaagggtgaaaattgggaagacggagcactgaaatttatagctacacaagttttccgttccgcatatattatacagatgtatgatgtaaaaataattatattctccattcatatcaaaataaattaatctaggattgggtggaaggtcattcaacgaatctacacaagtcatgggctttgtttggaaagagctcaagatattctaagaagcagctgggtggtagctaacttctgataatctggaaaatttaggtttcttagcttttggcttctagttcttttctggattttataattatagcttattagaatctaaatgaaaagctgaactgtttaggggagaaactgtaactgtcagaagtttcccaaacaaaccctaattggtttatttcggaacagaaggagttgatagcaactgtttgaaccttttatgcccttaaatgccccctaagggatctgtgaacccctacactttttagagattaggctcatatgtagtttggttcatattcaggtttggatagaatatgattatccatatttgcaagtatatggtgatcctgttttttagttggttgaatatgaccatcattatttttttttgttagatggatgagaatggatagaataaaaacaataacatattaattaataataaaatatgttaattaacaataatataactataatatatactaattaacaatgaaatagactaagaggaaaagagaaaattgagaagatatgcaaaacgaggtgagctattagcacttgattaattgagtataaactattttaaatttcaaaaatagattaatatggtttttaaagcaactttcctatagattttctttttgcaaaaaacatactctctctgaaacgtttcaggttataagacgtcttgacttcggtcaaagtcaaactatttcaagtttgaccaagtttatagacaaaaatagtaatattcataatactaaattaattttatcaaatcaatagttgaatatattttcataataaattttttttggttgaaaatgttactactttttttctacaaacttgatcaaacttaaagcagtttgactttgaccaaagtaaaaacatcttataacatgaaatggagggagtaccgagggagtaccgtttagtagttcgagaaacgtgcgcatggagataagacaaatctcctctcaatgtcctgctgccaaaacgcaggttctaatcaacactaattttacaagtcaactactaaatagcaacaaaatacattttgctaattaattgctaactatcaagattaataaaggttgatatcctcatccagtcaatttgactagatatactcatccagtttctttgtgaaatattttctttccgtttaatcccatcatttccctatttcccaccatgtaaggccgtgtttagcttgtgtaccaaaattttttttaagtatacggacacacatttgaagtattaaatgtagattaataacaaaataaattacagattccacctgtaaactatgagatgaatttattaagcctaattaatctatctttagcaaatatttactgtagcatcacattgtcaaatcatggcgtaattaggctcaaaagattcgtctcgcaatttacatataaactgtgtaattgatttttttttcgttcatatttaatgctccatgtgtcaaaatatttaatgtgatggaatttttgaatgtttgaagtaactaaacactgcctactaaacacactgaaaacctggatcaccatctttcatccaaccaaaaacaccctatagcagcggtcggggcagggcgaaaaggtggtcgcgttcgtcggccaaaagccaaagtttgaccgcacaaaacagcgagtctacaagcagaagaaagaatcatcgttgctagctacctgtacccctttaaatttgccccagcaatttcagctcaattttggatggatgcgcccaacttacttcgcgtctacttcaattcgcaccgccattcttcctctcagcatagctaaagctagctcagcatcgtcatgctccaaatttagtccaagatgaagtctttccaaaatccatttgttttgtccaaagaaatctttgccaaaatttttctactagtataatactatctcctgcttcggttgctcttgctcgcttagttaaataatactaaggacagtattctacttggccgccttcttcttcctcttcgcctctacctgctgcatgccgctttaccccttctcgatgcggggttggattccgacgagatacttgagccgacgagaggtaatctgcttctctcgccttctctctccgttgtaatatgttctttgtcctcgatgtgtttccgattttgcttttcgcggcaaaagactttcggtgttgctttttgcgagggtttgtgttagtgttcttgatgggaagattgccgggttttttttttttttgctgctttgcttagcactttttttttatgatttcttggacaattttggagccatttcgtttagtttgagttctttcggtgtttttgacgcctgtgaggtttcttttattctctaaaattttcgccgagtttggcgttctctcccaattgtttcttcgatattttcttgaagaattgaactgggtaatttcattaagattgaattcggtgcgaagtttatgtcaggttgttgcacacgaatgatttttttttaaattttttttgcagtttgattcgaatcgaagctcctagtcttctttaccatgtgaagaaatcaactggttcagcatcaagaagcagccatggccgccgttcgcgtggtggcgccggcgccttcggtgctgctgcttgtggcggcggcggtggtgctgcttcacctggctcgcgccattgccggcgcggcggacgaggccgcggcgctgctcgcgttcaaggacgcgtccgtggccgccgacccgggcggcgcgctcgcgggctgggccaactccaccacccccggctcgccgtgcgcgtgggccggcgtctcgtgcgccgccggccgcgtccgggcgctcgacctcagcggcatgtcgctctccggccgcctccgcctcgacgccctcctcgcgctctcggcgctccggcgcctcgacctccgcggcaacgccttccacggcgacctctcgcgccacggctcgccgcggcgggcggcgccgtgcgcgctcgtggaggtggacatttcgtcgaacaccttcaatgggacgcttccccgggcgttcttggcgtcctgcggcggcctccagaccctcaacctgtccaggaactccctcaccggtggcggctacccgttcccaccgtccctgcgcaggctcgacatgtcgcggaaccagttgtcggatgccggcttgctgaactactccctgaccggctgccatggcattcagtacctcaacctctcggccaaccagttcaccggaagcctcccggggcttgcaccttgcactgaagtttctgttcttgatttgtcatggaacctcatgtccggtgtactacctccaaggtttgtggccatggctccagccaatttgacatacttgagcattgccggtaacaacttctccatggacatctcagactatgaatttggtgggtgtgcaaatctcacattgcttgattggtcatacaacagactacgtagcacagggttgccgcggagtcttgtcgattgccgtcgattggaggcacttgacatgtctgggaacaagcttctgtctggtccaataccgacgttcttggttgaattgcaagcactgaggcgactctcactagcgggcaaccgattcactggagaaatatcggataagctgagcatcttgtgcaaaacgctggttgagctagacttgtcaagcaaccagctgattggcagcttgcctgcaagttttggacaatgtaggtttcttcaggtgcttgatcttggcaacaaccagctctctggggacttcgtcgaaactgtcatcaccaacatttcttctcttcgtgtgttgcggctgccgttcaacaatattacaggggcaaatccactgcctgcacttgcttccaggtgccctctgcttgaagtcattgatcttggatccaatgagtttgatggcgaaatcatgccggatctgtgctcatcattgccgtcacttcggaaacttctcctgccaaacaattacattaatggaacagtgccatcatcactgagcaattgtgtcaaccttgagtctattgaccttagcttcaacctgctggttggtcagattccaccagaaatattgtttcttctgaagcttgttgatttggtcttatgggcaaacaatctctccggtgagataccagacaagttctgcttcaatagcacggcattggagacattggtgataagctacaacagcttcactggaaacatccctgagtccattaccaggtgtgtgaatctcatttggttatcacttgccggcaacaacctgactgggagtattccctcaggattcggcaacctccagaatcttgccattttgcagcttaacaagaattcactctctggcaaggttccagcagagcttggcagctgcagcaacctcatctggcttgacctcaacagcaatgagttaaccggcacaataccgccacagctagcagcacaggcggggctcatcaccggagcaattgtctctggcaagcagtttgctttcctccgtaatgaggctggcaacatctgccctggtgctggtgttctgtttgaattcctagacattcggccagaccgccttgccaatttcccggctgtgcacttgtgctcctccacaaggatatacactggcacaactgtatacactttcagaaacaatgggagcatgatcttccttgatctttcatataacagcttgaccggtacaattccagcgagcttcgggaacatgacatatcttgaggtccttaacttgggtcacaatgaacttaccggtgcaattccagatgcattcactgggctcaaggggattggtgcacttgatctctcacacaaccacctcaccggtgtcatccctccggggtttgggtgtctgcatttccttgcagattttgatgtctccaacaacaacctcactggtgaaatcccaacatcagggcagctcatcacatttccagcatcccggtatgagaacaactctggactctgtggtattcccttgaatccttgtgtgcataattcaggcgcaggtggtctgccccaaacttcttatgggcataggaattttgctcgacaaagcgtgttccttgcagtgacactctcagtgctcatactgttctccttgctgattattcattacaagctatggaagttccacaaaaacaaaacaaaagagatacaagctggttgctctgagagcctcccaggatccagcaaatcaagctggaagctttcaggtatcggtgagccattgagcatcaatatggccatatttgagaatccattgaggaagctcaccttctctgacctacatcaggccaccaatggcttttgtgcggagacactcattgggtcaggagggtttggtgaggtttacaaggccaaactcaaggatggtaacattgtggctgtcaagaagctgatgcatttcacaggccagggtgaccgggagttcaccgcagagatggagaccattggcaagatcaagcatcgcaaccttgttccattgctaggttactgcaagattggtgatgagcggctccttgtttacgagtatatgaagaatggcagcttagatttcgtcctacatgacaagggtgaggctaatatggatctcaattgggcaacaaggaaaaagatcgcaataggctcggccagggggctagcattcctccaccacagctgtgttccacatatcatacaccgggacatgaagtccagcaatgtgttgcttgatggaaactttgatgcctatgtgtcagactttgggatggcgagactcatgaatgcgctcgattcacatctcactgtgagcatgctttcaggaacacctggatatgtgccacctgagtactgccaggatttccggtgcacaaccaagggcgatgtgtacagctatggagttgtgctcttggagctcctcacagggaagaaaccgattgacccaactgaatttggtgacagtaatcttgttggctgggtgaagcagatggtggaggacagatgcagtgaaatatatgatcctacattgatggccacgacatctagtgaattggagctctatcagtatctgaagattgcttgccgctgcttggatgaccagcctaaccgcaggcctaccatgatccaggtcatgacaatgttcaaagaatttcaggttgactcgggcagcaatttcctcgatgacttctcactcaattcaacaaacatggaggaatcatctgaaaaatcagtgtaaatgcttctggttcttgcagattttgattgttaatggaatgtaagtaaactagtttaatcattttaacttacaggaaagaaaagtagccccttttggtaggtgaatttgcagttttggtttcagtcaatgtacataatacacaataacaggaagagacacagacacaattgtaggcttcttttgtgtagaagattgcctctttagttgtagagccaagtatatatatcttggaactaagttcccatgcttgtacatatgttttcctactgagaaagaacacaacacaagcttttgtaagttggaaattgcttatgttatgacatcgttctgtgatttgcatggtgatgttgcaatttttgcctactgtttgaacaatttgcttaaaaactgaccatatttgtcctttttcgtaataaataaaaatatgttaccacgtctatcttcagctctgattgattctttctgctgacaagcttaaaagaagtgtcttaaatctcaccatacactctgcagtaagtattttactatttcccctttacctttcgtttactgtagcaaataaaaaatttagataatagcaaatcaaaattattactgtggctgacatcttatttcttttagaaatcataaacttcatatctgctattgtcatcaactgttagtcttgttgacaatacattacagtgttagattttggttgtcatatcttgacaataatgaatggcatagtgaaggcatcatttccatgtactaaattttccaatctattttatttacaatattagttaaaacagattttgctagatttggttatttgttcctaatggtagttgttgacaaaatgataatcgtaatttgatattcgtaactcattcaccatttgcatttcagattccttga

SEQ ID NO: 82052 - DNA, 720 bp, Oryza sativa
atgagtcatgattttctcctacgctttgtaaggttcggcacggcacctgaaccacggcttgcattgcgtccctgcgatgaagacgcccctcgggcctctgtatttgcattctctgtgccctctccagtcgccgaatagctcatgcttttaccgctttgactttcagaaacctcgtcaataccctcacaggcatcacgtgtttcatgctccatttctgcaccagattgatccactcccgtatcttgctcgtcaccctcttccatgcagaatccaccaccggcgaagagatagtcttttggtgcagtgtccgtatggcaatcctcgggtaactcaaagcccgaaggatcttcgttcatatcagagggatctgtatgcgtttgatcgatgtttaattcactcgtatcctgatggagcagattagattgtgtgtcaagtccagccatgtgacacatgtcctcctccaaagaaccttggccctgattttcatcgatttgatgtatggaaacatcattatcatcagcttcctgaccatcttccgcgtatgtgacctgcttacgcttcctatttgactgcagaaacaacatcagcatgaaaaaaataataatgttactctccagtgcaaatattactgctcttcatgtgcagatcagaagaaatgcataaacaattctgattctttacttcaaaaaagaattgattctcaaagacaagcatgtgtga

SEQ ID NO: 82053 - DNA, 660 bp, Oryza sativa
aaaaaagttggaatctaaacaacaccagggtactacctgatacgtcgtgtgcaccagggtagaagaaatgtagcaaaggccgtggcacgcctagtagagtagtagtgctagcctgctaggctagtgtactacggccgtttgccatcgcagcagcatacgttcgctagcttcgatctggcggttctgcactcgtgtgcaagtgcaaccgagcatggtggagataattttcttttcggtactgtataccccatgggcggagctaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatccaaacacagcccaaccggcctatatgacccatcagacatcagttgatccacttagccaccactcttccagacggccccctctcgctctccctccatgacccatccctccctggctcggctccctcgcgccgctccccatttgcaaaccctatgcggcggcgcggcgaggcggcaactggcggcgagaactggaccgcgctaccacggagggggaggctattg

SEQ ID NO: 82054 - DNA, 3641 bp, Oryza sativa
aattcctgcagccctagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctgtcacaccccgaagttttcctcccaagccaaaattgtaatttttataaatgaccctaagaaaatgcaggtgaaatcaggagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttcctttttccttttctttttcctctctttttcctcctttttttcgaatgggccgccggcccattccctccttcctcccctcctccttgctgggccggccgcaggccgaggcccagccaggccgccccgccgcctcctctctcggggtcgccgacaggtggggcccacctgtcgggtccttcccccacctcccgccgatctcgcccgcgccgccgcgccctcgtctccgcctcctccgggccacgtcgaccacgcccgcgcgtgcgccgcgtctcccgcgcccactcctctccctctcctgctcgcgcccgcgcccgagatggccgggattcgattttcgaatcccgcctctctctcctcccccactccccacgtcggccggcgattcccgcctctcccggccacgtccggttccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcattcgggtgagcaccacctccaccgccgccttcggccatggtttccggtcgccgtggtccatctccctctctctaatccctctcttctccttccttagggcaccccgaagctcgtccgcccgccgacgtcgtcctcccgtggcttgccgtcgccgttcgccatcgtcttcctccgcgccagccaccctcggtgaggcactccctccccacttatcccctccctctccctcctagccgccgctttagcgccgtcgcccgttagtcgtcgctttagcatcaccgcccttcggcgccgccgtctccgccggcggttgccgtcgtcggcaacgcgcgtgcgcgtgcgcgcgccgtcgccgtgaccggtcggccggttttgtgccgagccgagcctagcctggccgccgccgcaccgtccgatcggccccgggccgatccgggccgtcgatcccgtggaccggcggtggatcacccgcgtggtcccggtccacggtagaccggccacccgtgcgccgctgacatgcgggcccctcttgtcggcgccgcacccccccccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatacattaaaaatggttttgttccctgtttcagtagtcttatagcctgtttgcaatgtttgctttgtatgtcgctagattccgattcctccgacgctccggtgtactttgagatagtcgccgaggttcctccagcagcagagcaaggcaagtcatgcttgtcacttgaacatgttgatcctatagtgcaaatgctctattgttttctttcaaatattgcattgttttataatattactatgggatggttacctattgttacagccatgtttttggatatcatgctcctttgttagcttggggttataacatgattagagtttggactaggaattgcttagccatgcttagttcaactagttcacaatggggaaaatcatattaatgtttagactgttggttctaatgataatgttggattagtaccaccgctctggtgttggttaattaaaatgaatcacatggtgggctgtgggtgcatggttttgctggtcgcacccatggcagttaaggaccggttcgtgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtgacatgtcggcgcacggaaacgtgtcgtggggctgtgtcttgtgggtacagttgtacacctctgatcagagtaaaactattcgaatagccgtacccgcggttatgggcggtcaaccagattcaccgtgattagtttcaccttagtgtaatcctttaatttggatagtttaggtggatggttgggcctgtcgcaacgtgggttagcgttggacagtggatagttaatattaattaattgttacaactgtttaaatctttcaatctctgtttataaatgctcgctttatgcaaatgaaccacttcagctcttctttgatgatttccctgcatcatacccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaagtttagtcaaggcttagctcctgttgtctttcttttcttccgctgcatttatgtaagactttatgatgtttgtaagacgtggatttgtatgtcaacattgtcgtttgtgtaccccggctggtcctggacggggattttaatgcacattctgcttggaattctattcgggaatttctgggcgtgacacaccctcaattacctcgttctccttatactcccagggtacatgatcaccctctgatataacaagtccagagaagtcctcatttgcccaatcagtggccattacatcaccttcctcatcggatgatgcgtcgttgtccgcttcctcattatccgaatcttccctctccatttcatcaacaattataccgactctatccccctcatccgccatgcccatagcctgctcctaccttggttgattttcctcatgttgcatcgatggtccaacaacatccc

SEQ ID NO: 82055 - DNA, 7539 bp, Oryza sativa
  unsure (1)..(7539): unsure at all n locations
accgctgcagaggcattttcaacgttgtttcagtcagctttgtccaaatttgggctttcttgatcctgagcattttatattggtgatgagcctgtcagtttctctgcttgtcctaccacatccttgaacgtcctaaagatttttggtacatctttaatgggaatgttgaagcatgagtttgaacatcctcaacagcatatacagcagggagagcacaggctggagttttttaaggatgtatttatggtggctcggtggagaaaaattagcattgtcgtatatttcatctggagaagtgagttgttgtggcttcttgtgtttctgaaggtgaatgtcacctgttttgtcgatgtagagacaatatagatacagcgctgcttctgtatgttagtactccgtatttcttacttgcacagagcaataaagctgttcattctaccaatatgaagtgacacatattaagcccctttacattgtgaagtaaatcgactgatttcttacttgcacttgtgaaacttagcttgcaatgctcacggacaagtttattgtaaattggatctgcccgtgtttggcaggttttttttcctataaataaaaatcaatagaaaaacgcagtaagatcaaattgaggatggttgttttgatcaaattctggttgaattattgtttcaaatttgaattctaaagaaccatttgaaatttcatccaaaatctacttgcatcccatgtcaaaacctcaaattttcacggtattcgatcggctttcgtcaaatcgaaaaccctggtcgcatccacttcgctgctagcatagtccacaattcattaggcaatgggagttctgaatctttcctcgccaccacgagcttgctgttttgcaaatcaagttatccacatccacaaaaacacacaataattgtcccagttttatgtcactaattataagtgattagtagtaagcatttgctnnctnngcaacnnngngtgatgtnannttttaggcttatactgtataccagatcatcacacaaaacgctgcaaaggaaagcaaatgcttactttctgagtagttcaatacttcaatcagaacggatcggaaagctaaataggtcacacagaagcataaacatgtactccctccggtttgaggccaaacttttataacttgaccattaataactttaaaaaatatttagtttaaaggaactagaacaacatatattataatagaaaagtaagattaaaaatatcttttagaccgtgtcattgtccaaaacgtcaattaaaatggaaccggaaggagtaggaatatacaaataacacagaaaatttctccataccataccgaagtattaatagcagatccatgacccgcacaataatagcaagagtttaatccaaagaagcatccacccatataacattattagattcatatagcaaaaacctctaaatccgcacagcagcatcaactgctcagaaggcacgatctaagaaagaactattactaaagtcactactaaagcggtagtaaaggggggcagatcgatcgcatctagggcttgaaggcgatcgtcagatcagaccgggctgaggagctgggcgagggagggcctcggctcggatctcatgccgacgacgatgatgagcgggatgaagccgtagtgcgccgccaccttggtcttcttcatggtccacgtggtccactccttgacgaaccgcaccgccgccgcagccgtggactgctcctcgtcggccgccggggatcccttcctcgcgcccttgaccttgggcttcggcttcagcgacggccgcgacgccatggcacctccctcttgattcgattcggggggtcgctgaacagaaaccctagggctgtgcggaagtgtcgttctggggtttgatgatcccttccggttcggtgatttggggggtaatattggcttgttcgtgggcctcttcgactctaacttgaggagagacctgatgggcccaaaagagcgtagttatattgggctgcgttaccatagagtttgggctggacatttttgacagcccaattgatcaggtcagcctgcagcctgcatgggacaaaacaacagtcgctcagaaatgagtagcactgtaccagtatggtagtctagtcaccggttggtcggcaatgccagcccatatgtaccgctcagcaatcagcatctctgtcatgaattcctcctcattttcacacagatacctcgccttgctacgctaacaccattgccgcatcttattagcatttatatttcaacccgacgaaaaaggtaaccgtcggtatcatgacaattgacagtcgtacggtatgcatatgaagctgaatctgaacgtagccgccaccgagccacggacgcccaaatcatctcattagctgaccgagtattcgagcgggtacacgcgcgtgcatattcgccggccggctcacccccaccttttgaaggaagcagcacctacgtacgttaccggtcccgcgaaaaactccaaacctgtccgagtcacggcccggccccgctgtctctggtagaaccgacacccgatggacacatcggggagcaggcatcaaaatcaaatcgccaaaaaagaagccgaaaaaggagctgaaacgcgcacgcggcggaacaaaccgcgcgccgccgggctcagctccaccacgtaacccaaccccacccgcgcgcgctacaccacctatatacgtcgcgttcgcgtccaccggccaccccgcgccgcgcgctgcacgaacacgcacaagatcgatccgagatccccccgcgcgtccacgacccaccacgccaacagcatatcacctcaactcaattgacctgcctgccgacacgcgcagccgctccccggcccggccccgggtcgatctcgtccgatccgcgcgcacgcacgcacgctcggaaatccctggagatcagcggaggaaaccagacggaatcacggaactcgatcgggagagggcctggaataacccacccggtcccgcgcccactgatgccgcctaccagccatcgtactatcgcggcgccgggccgttcacacggtcgcgcgcgcacgcacgcacgcacgcacgccggcgaatgaattacggccccgatcgatgcatgcccgggacccgggacccatcgctcgcgcgcggccccggccggaggagtctctgtagacggcgatcgatgcttcgcctccacgtacggtgcgatggccgacgggccacgccacgtgtggccggcggagcggtacacggctcggtgacaagcgcgcgtcgacgtcgatcgggttccgccgggttgtttgccgatttgggcgagcgcgcttgaccggcttagatagctaatggcgcacgtgcaggcgcggggaagtttgactccacgcgcgctgcgccgcgcagcgcgccgatcgatcgacgtataccggtatacgctagcttacggcgagacgtgcccggtggccggcctctccaccacgtacgtacaccagagtcgacgtacgccgttagtgcacaggccgcgcgcgagcgagcgagcccaacgtgacgggggactgtagctgcgcggctgtacgtacgggcgtcttgtattccgtgtactgtgcgcgcgctcgtggtgtgacgcgacgcccgcggcgctggccggccggccgtgactcgtggcatgggaggaaaacatgagagagtcgtgatctctctaacaaccgagaccagccagtagccgtggggcaacgtgcgccggccgtttttttataagcgggtctctgcttatttcgttgctatattctggagatttttttttactaatagggagatattttcctatcttataatgttttagttggattttgatttgaatggaatcaaacgacggtcctttaaaatataaaaatgttcaagaaaggtagtaattctctaagctaagtaccagctcgatctccagtatcgtttatgactcccaaattagctagaccaaataacacgcgctgggttagcataatccctcgagggaaatactcatcgtgtaactttttctttttaatttaacgtaattagttgtgaaatatttttaaaaaataacttggtaatacagagtatagtgacaactatcaatcccctaaaattaagtttaaacttgacctacatattgaaaaataaatgaattcaaatgttaacagtaccctactatttatataagtttattattttattatatctcgataagtgagttgagtttatttataccaaaaattttgttaactaatatatatatgtcatgtgagtgttgtcaaattttgtaagatttttctataacttcggattgtttttatttattgtttttaaataaaggagctagatatttttttcaagggattaaaatagtttcatggtcagcatacatacttcgcatcccaaatcacagctagccgtgaccaaatatgcatgcgactgatataacagtaaaaaaacgtgggacgctgagttgaggcaaataaggaataactatatctttaatttgtaatacttccagtatataaaaagtataatatatatgttgaatgatatagttttttttttcacttttaccagaaaatataccaaacacagtactgtaaagagttgatcagctgaaaatcataacatcatttttcttgtaaaaaatgttgatctatatgtgatgtaataagtttcgctggcatcaattcccgtatctatagatcactatgccagcgtcaagtatgttactccatccgtaaaatataatgcacccgtcttttataaaaatcaaaaattttaaattgtactactaataattaaatttacaatacgtgagagtttattagttacatgtagtactattatattcatatttgataagatttttatatgatgttaatttcgtagctgccgatgttatatcatgcaaaaaattaatggtcaagctataacataggagatcaccacgtaaaaatctaaatcaccttatactttatactttagaaaggagggagtatataattttgaataatgaaggtgctatacttctttatattgtttgatcttcagacaactcatcaatcaacagtcttggaaaaaagcagccataatataaaccttaattgatatagtggggtatttctataattaatctaggaactaattacgttatcatttatctctgtgtttcctcattatcataaaaatggcgaaaaaaggagggatcacctacagattaatttcatttgatcagcacatactcgaatccattatctctactacgtaccgtaagagcggtgccatcctcctgccagaccatcgctccttttccactaaaaaaaaacatcctaactcgaaaataaccaacccataaaaaaacagtatttccacgtgaaaatcaatcgactagaaaattaattagatagacgaaccacagctcatagaatcatccgtgtccatcttcctctagaaaaatacagttttcaggatattcatccctaaactttctctaaatatatatgccgacgattaacttcggcaaaagaagtgatcattatttcactatatgaaaagcaagacaaaaaatatcagtgatgagttaagtcaaccctccacgaaatcaacagaaattaaaaacttgtagacgtacatgttcgatgtagacacatctcacagatacacacgcatatactactatattttttgccatgttattcaattggaccatgaggtcaatgctagattgtgtagatcagaaggcaattgcaatgaacattcttctcgattttttttagacgtacgtctttcttctcgaatttttttttgacgtctttcttctctaatttttaaccgaatgaaatatttgtccttaataagatgagagtagtttggtagctgtgcactgtgcaagggtactgtgacagccgtacgtccaatatccaactataaatatgtacagctgtatatacgtatggatacatgtcatccttcaaaacggtacttgtgtggcacgtgtatgtcaagaaagagctgtagtgtactgtgcaaatcatttaaaatcttgaagcatgcctgatcatgcataaacatttgaatcgaaattcacatgcacagtttcgaactcttggctggatccccgtagatgtccgttaaaacgcggtggatgtaagtgagttacattgctcaaattaatggacacaaaacatgtacatagtatatgcatgctatgcccaatatataccaactccaaccgggaaatagtatcttaattcagcatacagtaagctgaactgtatggattcaactattcatagtacggcaggccctacacaatttaattacgttgacactggccggtcttatacctaatacctccctgaccaacagatgcgaaaagaatctaaattaagcacgctgatttcattaataaaacgtctctaccattaagaattgacgactagctagctagtatatatgtgtgtatatatattaatagtactgctggaattatggagtattatatatatataaacgaagatcactagacgccgcaccgagacagatttacatattccatcacaaaaagtcgtatcttgcgcctatccttttccagcgaaggaaaagaaagaaaaaacaaatcaaaagggaggtgagaccggttgaaagctgaaaccctcctcacttccacgcctctctttcctttccacacataagctagctccccatactctcacaccccatgtcttctggaggaggaggaggaggaggaggagatcgccatggcccctaccaccagcacgggcacctcggccgcggcgaaggcgctgattacgtgtacagcagcagcgacatggagagcttcttcttcagccaacccgggggcgtcggcatcggcgggggtggtggtggcgtcgtcggcgccggcggtgccgacgagatcatgccgtactccagcatcacggactacctgcaggggttattggacccctccgggctagctcggcacctcgacgtggcgtgcccgtcgtctcaggacacggtggtcaagcaggagctgtcggtggatgtgacgagccacgacagccagggcaccggcggcgtcgccggagaaggcgtcgcgcaggccacgccgaactcgtcggcgtccttctcgtccagcgacggagaggcggagggcggcaaatcgtcacgccggtgcaagaagggtcaggcgaaggcggaggaggaggacgacaaggatgaggaggatggagagaactccaagaaaccgtatgttaaatttccattgattctactctatactttgtctgattcttgtcttgatttcttgcttgattaattcttttttgatgcgtgtcttgagatggggatactttcttggggctagatctggttggtcatactgttgcggagttgcaaaatttgacctgaaattttctttcgtttatgctttctctctactgcatgcatggtgtgaacattagggtttgctagaattttggttccttagggttctttttgggctg

SEQ ID NO: 82056 - DNA, 9556 bp, Oryza sativa
tcccagagggcggtaggcgaccacttccgtcaattttcaaaatggaaaattatttttgtaaaacttttaataaaaaaaattaaaaataaaaaaaattccagaagcgcacactccctagcatatccctaacacccaattcaaatatcagaatccttttgatggtcgaacattttctgtgcaaggctgcaagctgtgcaaaattttgaaccattttgatggatattccttttgtttgcaaggtattaaaaacagggtgccttcaggtggtcaggtttatagttggtgtggaagaaatcttcagctgatcacaagtgctctttagttttctctctctctttttttttatcatgtcctggacaactttatataagtcttagtctgaaggaaaatacagtgaagattcttctgaaatattgatgtttttggatagcttaacagccctgaaaggatatgtctctatacttgtgtttgacattgccgaaatattggcttctccttttgctgtggaatgaaacagggctatgactctttcttcgtgttgttgttgtaatcagtagaaccaagaaaaaacactatcaaattatatcagttgtgtgcctgtactttgtcttgcctagaatttctgctgaagtattgttcacctggaagcttgatatgtagcaagagcaattttaccgtacttaagaaggtaccatgaggtatcactttttctactgtaaatttggtacctcttggtacctagttaccatgagataccaaattttacactaaatttttagtacctcatgatatctactcaatgaccgtaaaattgcttatgcagaagaacaactgaagtcctgatgcctcctaagctcaccatagcaatccgacaggctacccttcatgacccttacatctctctctctctctctctctctctctcacagtttgtagcatctgtgttcatctgtctatttttatattttaggatggaaggagtaagtgttttgccttagctttaatttcagctagttatcctttcagaggagttggggaattgtcccatagcttgacgtttcttttctttgttcgcactgaaaccttttggagctgtgtgcttgtcagcagatactggagatgcaaatcatttccattatccaaaaaatactaggacctgctagcaaccctgtcctacttctagctctactggtgtgtgcacaagcacaatgaacataatttcagacattccatagttaaatgcattgaattatcctcgccaaaaaaaataaagacagtacatccttacatgatacagtgatctgctatggcccataaaagagaaggcaaaggagcacaagtgttgcaagctactagtaagacactgacagttagtcatggggcctggtcgaatgtcatttgctatggtaggcatcagaggcatcaggagctctgttcatctttcaacaagctgggctcttacataatgaaccaggagctctgttcttttttaacaagctgagctctagatcgatcatcaaccaggagcccagttcttttttttaacaagacgagtttttacaggatggccagcttgttttgttttgttctcttttttttttcaaaagaagaaaacgggtggccaccttttgtatattataagcacgcactgcagttataatatgtaactaaaaaactaaataaataattattaaaaaatcatgaccgtcaaggccttgagctgatagtgtgccatcaattcatacaaaagtagatgaaaatatggaataaaaagatcagttcatgataatgaaaataaaactattgatttaacatgcaatggtgtataggtgagtattcattatccaaaatagtatgggtaagtattgaaattgaactccactttaattgttttttgtagatggaaggctagccttgacagcatacggagtttactaggattgccaattagtaacctctgaacttgctagttgacaaaagaaacacaaattcagaacaaaagaaataaaaacaaggatcctttgattcgaggtctttgagacagaactcatcgatggccattgccggtggatgaaggtggacaccttgggtggccatgcaatcttccttggtttagagtgcttcaagttttcaggttgcgtgtgtagtgtgccttcaggttatagttgaccaaaaggcctggggctcaatgacccggcccatggcacgaggttttggcccggcccaagcacagcttgcccgattggtgtcaggtctgtactggtccggctcgacctttgggccgtgcctgggcctctagctcggcacggcggaggcaaatagatgagggagccaaaatagacttactccagccatataaggcatgaccaaagacacgagggatgcatagggatacaaaatagactttttttaaggagcacagtgaactttcatgccttcaggctgacccaatacggcccgagtcttattgggccatgcctgagctattggtgcagcacgttggcgggcatggcctaacccagtgtgtaggtcgggccatgctggcccgattgatatcgggcctgtgcctagtcgtgcctgggctaggcgggccatttggccatctatacttcaggtggttaggtcaataattggtccggaagaaatggctagtatctgacaagtgtgctttacttttgttttattatggcatgcatttagtctgaaggtaaatgcagtgaacatcctgctgaaatactgatgtattttggacagcttaacagccctgaaaggatctgtctctataccacctgtgttttacatttcctaaatcttgcttctccttttgctatgcaataaaacagggatatggttctttcttctttttgttgtaatcagtatagccaacaaaaacatgatcagatcatacagttgtgtgccagtactgatgttcatctggaagctccgcatgcagtgaactgtccagaactgcaggatgaaagcatatctgcaactgctgatgattccatgacattactactccatcaaatgcatgcagtattgttcaattgggcacctactgggctagaaaagaaactgaatcatagtgttgtcaaattacatcgaaaaccatgatcgtcaaacccaaaaaaaaaaattgcaaacatcatttaggccatatacaacaatattgagcttcctaaccaaaattcttttaattttttttccaaaatgaaattgttatcgaaagacaactgcgtcatgtcgaaagatgtggttcactcagtgagttgatagaatagtaaaagcaatatattaattggtaattttttttgggatccccccattacatggccctagggggctatttatagtcttagtacaggctcataccctctagagttttagttagtataggagaatttacagggaaacccttatgaaagggacattagtgtgggtacacagtgtcttttgtatttatgggccaccaggcgatctccttgggccggcccactgatggcgaaaggccccaatgggccatagggcctcccaagcccatagtcgaaggcacctccaacccgggtgaggacctctcactttgccttatggccttcgcccttagtggtgacttggtcgaatggcgagcttgggggcgaacccatcggtcttcgtcgcttggcttcgcccaagcgcttcaccctattgcttcgccccgagcgcactcctttggactcagtcgacgcctagtggattcggtggtttcagcaggtccggtcgaagggcctcgtgacatgccaacaatagagatatatctagcgggtaaagggtagtactcctactatcgaagcattattatcggcgaagactgttgtcccatgtcctagggcagtcccactagttgcaaccgctcctcggcatgcttgtggtctctgcagaaggataggggcgacgccgagtgggtgacatggaaactcctggctactctgtagcaacacactgcatggctggaatggcttcagcatccatgtatggaagattacatctcacagacaattctttgccattcagctggcatgtcaacactgccattgccgttcaatccagggcctgccacagcgatgttctgttgaagtaacagaagaactcctgatgcctcctaagctcaccatagcaatctcctgtgccagctctcatcacccttacatctctctctctctctctctctctctctctctctctctctctcagtttctagcatctgagttcagttgtctattcttatatggagcagagaggggagaagtgtatcgtatatgaatgcacaaattgtttctatggatgtagttattcaggcttgcagctgatcgaatttaatgtgcatgtacaagtgcatttgctcgatcaaccatacccaactcttcagttaaacacccatgatgcaagtgaacgaagtaaatagattgctcatgatgaccatgatgcaagtttaagtatgtcttagtctgaatgaaaatgcattgaacatcctgctgaagtgttgatgttttgaacgtcctgaaaggatgatcagtttctgtacatgtatttgtcattgcctaaaccttgcttctccttttgctttggaataaaaatgggttatggctctttttccttcatgtaattagtagtacaaccatgaaaaatcatgatcaaatcatagctagttgtgtccatatacgttgtcttccccggagtttcttttgaagtatatttcttcagctggaagcaccctattccgtaatctgtccagcaggaaggctaattaaggaccaaaagagaatgcatatctgcaactccaagcagtattgttcaattcaaagcgagtcatattatcgtcaaattacatcgagaaaccatgaccatcaaacaaagattgtgaacggattggcaaaacatcatttagctcaacgcaacaataccgagctctctcaactaaaatctttttctttttccccaagataagttctgaaaccactatgttggaagttgataccaggatgccatttcctagatggtgtagcatgtgcgagaacgagatgaagcgtgagcctccacaaagacaagtagtcctgccaactgtaataacagttcttcagccatgtcagcactgccattggaggtcagttcagcacttggcactgaagaactgtacaactgtaacagaagaactcctgatgcctcctaagcataccatagaaacccacatgctcttgttcgtatgtccttagttggcctagtgagctaggtgtggtgacaactccatttggttggctaatcttggagatatgttcagcaattgttgccagtttgatctcttgctctgatggtatccaaaggcatgaacatctacatcctactttccctgtctcaaccataaactgaactaagttcatcaaatgattattcagttataagctttgatcgaatggagacctactctcaactctatgcagtggcaattgcttaactgcccatatagcactctgaactctgttcctgaaagccagagtttataacgccttgcatccaaagaaatacaactcattttctttcactaactcaactacacttcaaaaacagagaacagaccagtgaattatgcttgaccattccaaacaacgacagaccatttgcaggtaaataccttgatcatttggtatgatcagcatttctaccagattagatataatcccggctttccatggctcgatcctacggctacccaaagtcatggccatatctagctacctcctactccctgtctcaacttctacactgaactgagcttcagatgattaatcaaccattcatagcatcgactgaatggagatatatatatcctttgcatacatacacgttcaaggtagtttcccaatgaattactttgctactggactatagacgcacaatatataattacagaatcaaatgatacatcctttatataatagcaaggtctctcgggctctcttttggtctatatgtatacatgttagctgatagctagcatgcagtaacaaacgaacagttagataaggagaccacttctgtgaccctgctatcgtaggcctaggaggcattgggagctctcgtcttaggaacatatcactcataagagccccactgcgatgctctctactggtaatagaaaacaatctgaaccattaatcttatttcatcgaatggtctatatctatttgtactattaccccagttggtggtagtagaaacatgtatgggcattattatccaaagatgtgtcgaggggtataatcatcatttagcagtgattaaaccttttttttctccgttttcttgttctgatggaatatgagtgatgctagtggaatggatgaccagatcgatctagacgaaaaaaaatgtaaatgataaaattactcctaatcactgaattagtaaattattaacttacccttaataacaaacggttcagagccctggagcatcactccagaggtagaaggacaggcctcaaccagatatctgttagatttaattgggtaattgatacatttaaatcaattaaatcaaataaattccaaggctcattatgctaggaattcatgtgaattcattctcttatgggatatcaatgggatgaagagttttgagaattaatccatttgattagggaattggtaacttatatcaattagtcctaattgatggatggttgatggttgtgtagtggatgatggttcatggctagttgatgacaattagttgctctattcctcttcctattacattggtgatggttgtgtagtggaggatggttgatggctaattgatgagaattagttactctattcatcttcctattccatgactcttactcttcatcttccattcctcttataaaatgagaatggatttgatctcccgcgtaagaggaagacacacttttatccattttccaaagctgttgctgctacggtaatcccattccaacgagtgtgtgcacacgcgttgggagagtaggcctccgaaaccacgcgttgctgtgacgtttgcacagacgggcgggcgatcaggtttttgggagctcaaggcgcgactactcactgttcgtcaacatctacttcaccttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgttattatgtgattgttgatgcttattctacgttaagcatgctcatgttgattacattcaccactatcactggatcaaatcctattgtaaatatcatgtttattatcttgttattttggattaaaatatgccgaattatgaccaaatttccaacaatatcaacatgtgcaagtcccttcctttgtcattttgaatgattgttcataattcaggtggatttgaggaagaactagagtgactcattggctatggtaggccttggaggcatctggagttgttgggttcctttgaaacaagtagaaatatgtacggtacggacagacggagttatcatcgtcattggtactttcatggatatggaaatcttgttttacctggttggagttcatcttagtttccatatgaccaaatgataaagctagctacttgtagctgacagaagagccgcatctggtagaattccctgttttcatccctctctaagaaaaaaaatcaattcctactatgtctatggagaataaccaagattggaagttattatgaatcacattcagttatatccttataataaatttgactagagttgtctatgagtcatgttaagaaaatgagagtaattgtagaatattgggtctccatccgatgatccagatctgcccatctatttgcttcaactctaaactgaactgatcagctgactagaaacatttctagctagggtagaagtgaaagtagatatatgtacaaatccaagcaatgcatggtaggttcgtagcaaaccgggcttacttcaattgggttctgaataattgcttgaaaccaaccaagcagtacatcttatgcgatattgcaatctcctacggctaattggcccataaaagagcaggcgaagaatcagacaaagagatgcaatctgatcaagttggatcgatggaccttatggtgcagattagctagtgccttcgcaatcgttaggattggaaagcatcatgaactctcatattgaaacgctagctagctagctatcggcctagctagttgaaaggagcctacgttttttagtctgactcctatgtggctaagttactgttcctcggttggtcaatcagaaccatagtcacaggaaacaggatcggtggcagtattcctcaaactgggaatacggaggcatcttcgtccccaccttataacaacgtctcgtaagtagcgtgtcacattcctcgacccgataactttgtgactatgatctaatcatctgaactgattgctgacaacctgggtgtgctaataggtattcttctctcatttcattatgtagcaatttacaattaatcaggaaatacaagtaaatgtttatccagcatatctgcaattgatctgtaccacttgtccagctacttcttgcagtgttgttcaattaaaagtgagtcatactattttcaaattacatcgagaaaccatgatcatgaaaccaaaattttgaacggactggcaaaaaaacatcattgagctcaacacaacaatactgtctctcttagccgaaatccttgaattcagaaaccactatgctggtaaaaacccttcaaagctgacatcacgatgccattcccgatttcggagtagcatgtgtgagaacaggaggaagcatgagcctcagcaaacaccactactcctaccgactgtaacaactctttaccactcaacagccatgtcaacactgccattgcaacctactgcagcacttgccaccatagaaccgtccttgtgtaacagaacaactcttgattcctcctaagcctaccatagcaacccactggcctcatgcctcttcggttggcttcagcaattgctgccacattttgatctctggctctgatggtacccaaaggcttggacatgtctatgtcctactttcccggtttcaatcataaactgaactgttgatcagcaattattcagtcatagctttgatcgaacggagacttgcataaaactctatgcaatgccaattgctcaataaattgaaacatagatgctaaataattaggaggaatcaattactactccctccgttttataatgtaaatcattctaacattatctaaattcatgttgatgttaatggatctagacatatatatccatctagattcattaccatccatatgaatatgaaaaatgctagaaagacttacattgtgaaacggaggatgtacatcctagcaaaatatcactagaatatatatagcaatggcct

SEQ ID NO: 82057 - DNA, 2241 bp, Oryza sativa
attcctgcagcccttgcagtcaacctcgatttcatcgatcatcggatcgggagaaaggaaagaagtcaagactgctccttttattttcgttaggagtcattctttccaatttctaggacctctgtgtaatttgaccattttaagggtctttctataaatgtatcgatgctattaatctcatcgctctttctatgagaaatgtgattctcgctgatgtatgttatacgagtactatgtaatcttttatattggataaatgcatgagtctaaaaggaaccataaacgagcaaaaagaatgctgccgtacagtacaggtgccactgccacatgtgtcgatgatccggacaaaatcagttgcaacaaaatgccacgtgtacaacgatgcgtggcacgtgtcactgaccagtgggcccaaccgcggtgatagcgtgaccctagtccatcaacgccttttttttattagtgcctggctcaccgattagggccattctgacacttgtttaaaatgtgctaatcaactcctcgctaatgacgtttttggtagtaaatcacgtcaaattcttggacggttagcgtacttcgcattcacgcgcctctcgtgttgaattttttttcttttacaaccgaaactgatgcagtgacagtaaactgtggaagaaacggagtgtcagtttcacatcacatgtggagtgcttaattagttgttttatactatgtactactccctccgttttataatataaaacttcttaacattacccatacatacatatatatatatatatatatatatatatatatatatatatatatatatatatatatatatatgttaataaatatagacacacttatatatttagagtaattaatatatatattaatgcgggtaatgctaaaagtttatatattatgaaacagaggaagtactcaaattatgccatgttgctgtaatctcacttgatagttactcgaagtttggccatatgcttagctactttgagctgatctttataatactcaatgtacatttggcaacatttaatttggtcttccagagttggttctggattaatgaccttgcaggtcaccaaaaggcgcactaatttccatcatgtctaaagtgatcaacttggagatatggccatcatcaagcccccacatatgatccacgcagaataaaattgttctacataccaataattttcattcagatttagttccattttgattctgatttagtgcgcctaagtttgtttacacagctaaatacggagacatgtcgacactatatctcaaataaccgtttcttcatcactgaagtagtgtgaaaagattgcgtttttaaagattgcaatttttttcctctcctgttttgtgcccttgatattatgtcgttttcatcagtagtttagagcaagtttaatagtatatccaactattggcttcaattcatctatagccaacctaatagctcattcatacaatatttacatactacactattaatacctggtcctacttgttatacacaccctgcgtcttgaagtccgtattacagctggctataaatttatagcccgctgctattctctcttcttatttatcttattaaaatatgtttgcagttggcttatagccaggtattgtacctgcttttagagcacccataatggtaaaataagatgctctctataaaacatgtacatctcagcaatagattagattaatagtaaaccacctcaatagtatgtctacatgtgtatctatagctctctaatccattgcctcgtttttatctatagactatctctaggttagtatatagctttgttctctctcttcatttagtctcttccaagtaggataatatgctgacatggatatcttatggatatcttatagagagcctataaataaccattgcgggcgcccttatcacgcttctagcttcatttaagccgtccaaaacccttaactgcgatggcgcacaacacaacaaatcatcttttcgaggattttgcgaagaatcgatacaaaaaagcaacgttgacgtgagcgagaaaattcagaaactttcagaggaaaaaagaagaagaaaggtttcaactttcaagaggtagtagtagtagtagtgcagagatatctgaagaaaagtgcagagaaaaaagaagcagccgaggtaatataaaagttggagagaaacaggtgaagctgcaatattccgccacatcttcttct

SEQ ID NO: 82058 - DNA, 5728 bp, Oryza sativa
caatgaacaagctttcgaagaaatgcgtccattcaataagatgatttttttttctctacagctaattcaggccgacaacaatgttgaaatgatttttgtaagcaggaaatcaatgtcagcaagctgaattgacagcccgctcctcccgtttacagaactcaccaacaagtaagagtattcataattctttcttctatgtttaaattggagtttcgctctctctcttatatatgtaacacatgaaaatttgaaactattcctatgctgaatgaaaaagatatcaatgttatacatgatgccattgtatccttatatttactttttctatgtgctcggaaaaatgatctgtcaattttatattgttgcgcattgttgaggcacgaagcctaaaacaattttaaagtcattgttgttggcaggcttgccaggtaaaaaagatagaaaccacacgtcatgacttcaatttagtttgtataggcagtaataagtcccataaaagacaatactaagaatttttttgggtaaaaatgcatgttttttccacataaagttccctgtaatagtaatatgatcgaatttgatatggattttcacttgcaacttttcttctttttgcagcaaacttatttgcaaagcactcaattcactactttgcaattgcttcacaagttaaattcgtgctttgaaatttatacaactcattcataaatagcccaccatccagctgcaatagtttcgatgttgaaatgcttcaatataacattggaacactggggaaactttgattggaggttggaaagtgtgaggaaaaaatttttatggcatcaacatttaatcctacatgtgctaatgacggattaattaggcttaaaaattcgtctcgcggtttccatgcaagctataaaattagttttttcattcatgtccgaaaacatcttccgacatccggtcaaatatccgatgtgacatccataaattttcttttcacgaactaaacatgcccctaatcaggaaaaggttagcgcaaaaggtatgcgtgttgtgaaacaaatatgtaggagataagtcacggacgaacgacatcacagatccgcatggtgacctcggcctgatgagacgatcgacgacgacttttgatgatggtggcgcaacaacggcgtgcgggcaccgggcagcggcgctccgactggcaatctcctctagcggcttgacgatgagcgtgataaaagtagcaaagccgacaggggcgagcggtagggcgtcgccgacgagatgatctcccagttgatagtggcttctctccatcgggacggcgccatcttgcttcgtgttgagatatcgaccgacgcgggcgccgggcagaaaggggagaatatgcatggcaggcatcacggacggatggtctgcatacgcaggcgcgatcccaggccgtccggctcatatgcacgtacatctgttgatctcttgttaattggtttagcaccggtctacttctgctggtcttgctagctagtgaagcatgcatatatatatgcgtacgcatacatggccgaattcacatcacacatctaccctcccaaatgtcaggccacctctgtacgcacatgcatgcctgaatcatttaattagcttgctaattaacctgtttcctgctgcaatcaaccattaacacacaatatacaagtgattatattttataaatatgtacaaaataccatcaaacatatgcattgtgatattaaattgtagtgctgtaagagcaaaaagaaagatggagatattgcatctcctttttcgaaaacacacaacaaaggagaatgcttctaaattgccttctttcccgtcgtgattgaggagcacactcaacaataaaatgttgaagaagatgtctcgccaccaccagtgcctcagctttaaaaagttaagttgtatggtaatctttttaaacttttataaccatataagcttcttcgctagttttatatgttttaagaagctatatattaatatatcatgatacacttttgatgatttggtatattatattatttacatttgcattgtatatattaccgtcactgcgtatgcccgccgtgacgccatctgcaagaacgccggcattgcatgtactcaggaccgttgcatgtacacccgtgcatggatggaattgaatctccatcagctagaagtagcacaaggcggtggcggccagccggacgcggcagagagatccattgcgtgccctcaacttcatcagctcgggctaatcatggtaattagtaagcttagtttgtaaactaatttactaattcatagatacatcccggcacgtatctattaaggtacgcggtctatatatgtttttatagattgattatattttctcgtttttatcatattatctagatgctttgcatgcagtagatgtgatcctgctattgatctggtggtaaattaatttcctgcttttatctacatgcgtctattttatttgatgaaaattagagaaaatcgtgtgagagaaatcactaaaattgatgggaaaccctggactagagacgtatctaattcggttgggccgaatcggtcgtctcgcccaccctcccatctctctatttctgatgacgccacgccaggaacacagcgacatattctcagttcatatagtcggacttggagacatgtccatcgttcgccgtcatcactgttgggtgcgccgtctcagaaaaagccctgttgggtgaagattgacgatgacgggaggagcagtagggccacgctggagatcaaaacgcggcggcgagctcggtattcacggcgacgaaggtcttcccggggtcttcggtttcggcgagatggctgccgggctttctcttgtccttgcagagccgagggaggtggtggcgcggagcggcgacgaccgaggcggcagctaggggcggctggagcggctaccggcgacggagagagggcgctcgcggggaaaaggtttccggcgacggcggagagagggagaggtggcgcccgaaagaggagagggagggggctctatatatagccatgggagggagagatcgggcccaagacgaacatggcgacgccgggaaaagctaaggttttcgccgggaaaaaaaaaaggaatgacttgatccgcgaaattggaaaggatttccatagaaacttttggggatttattggggaaattgtagaggggattgagaggattccattcccgcaactaatttgggatgaggagcaacgaggaggccggatttggtgagaggtggtggcggcagtgcacgcgcacgggctctggacggctggctggaggttgaagatgcactgtagtgaaagggagaagaaacagacttccggctgggcttctattcctcggcccgattgaaggaggactcaggctagactttggaaagaaaaggccgaccagacagaggaaggaaggacagccaaggactgaaagagaacttttcctatttcggcccgaaaaggaaaagaggatttgatttatttttccaattaaattaatcaccgaaatgatatttgaattgttaaaaataattccaatgctctaataatttcaataaaaattctaaaaataattagacactcaaaatatataaaaataattaaaaccagatcatttaatgattaatttattatttaaataattacttaaatgtttcctaatttattaaaattagtaattgagctctgaaaaatccgagaaaattccagagagtataattgatcatggagaatttaataaaaattaaatccaaccattctttacacttagaaaattttatttcccatatttaacttcacttgtaaattaataaacatttaatataaaatttattaataatttattaaataatttataaatcctgaaacggaaattcaggttgtgacaaattccccacaatgtgtgtatgtatagagtgaggaaaggaataaatttaccgcaggtccctcaacttaacagcgcgattttttgagatcccttaaccataaaatcagaaatgtatacccctaatctcactcaaaccgttcaaagaaggtcccatgctagtatatatgggtggtttcgctgatgtggcatcctagtctgcaaaataaaaaataaaaagttatgagacccacatgtaagtgagaagggaaaaaatgtgggacccacatatcttctttctctctttttttttctcctctcttctcctttctttcctctctcatcttttggttcttctgtttgccacagaagaggggggagcggcagcgagcgaggacgagcgaccagagcaggcgggcgagcgcgtggcgaccggcggagtggagtggggtgacagcggtagcgggcgagcgcgcatccagagcagtgtggcagcagcgagcaggagctggcgagtgagcgcggggaggggggtcggcaggctcagcgtctcccccggtggtgaaacaccaaaaactgtcgcggctgccattgatgccatgtcgagctccaccccgttgatctctttctagggtaagtttctcgcataacctaccgcgtcacaacgtgttccccgtggttagtagtctttactctcaacaatggtggtgattccctttcacttccatagtggtcttctttggtcggcccactcatttcactctcaagctctctgagaagattcaagatgtttcatatgtgtccggatagcccaaagtctcgatagttagctctaggtcttccagtcaataggcagttcaaaatgttgacctatttgggaatctccggatctatgattattttcaactccccaaagcatttcgtctcttgctacgtccttcctcgtctctgggtacctaggtatccaccgcaagcctttcctctataagggacaggcttactgaaactagcactagcaacgcgtcttgtccttagtcaaatccaattcaataaagaacaagaaaatgtaggtgaacaaagaaagaaggcaactgcatttgtcgggaacacgagcttcttttcgtgtagtgtgttgacctttgaccatcgcgttccgcgccaaccagagcaccttcgtcgtcatcgatttctttgttggattcgcacaaccgcgatctacttacaggacattgtgccctcgctggattccatcgagttgccgtcatgccatacgcctgccttacgagctgacctccggcctaccttaggcacagcggtgtcaggcaccggagtcgcgcgccaagttcctcggcaactctgccgctccagcgcccacccgccagccggccacctcacgccgtcgtcgctactcgaggccccgccccgccggcaccggatgaagataagagaaaggggagagagagataagggaggcagagagaggaggaagaaggaaaggagagagagcatgacatgtgggccccataaattattgaccctacattttttttctcacttacacgtgggtcctatatatttatttattttattttatttgttgactaggatgccacgttaacaaaatcgggcgaaaatatagtcaatactaccatgtgacctcctttgaacggtttaagtaagtttaggggtacacatttctagttttgtggttaagagacaaaaaattatcgtgttaagctaacgaacctcggtgaacttatttcgtgaggaaatatggtgaaactcatctaaaaaaaagactaaccgttgtataacgtgaac

SEQ ID NO: 82059 - DNA, 7765 bp, Oryza sativa
acgcgggggagaggcggcgacgtgggagggggacgcgggagcggcgcggcgtgggcgcgggaagagcggaggaggcggcgacgtggcggattcggcggcggttgccgtcggaggcgggtggctggaggaaggggacgacctgacaggtgggccccacctgtcagcgtcccggagagaggaggaaggagaacgggccggcccacaaggggaggccgagcgcgggcgacgggtggagtggactgggccgacggcccaatagagaaaaaggaaggaaaaaaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaacggtgccatctgcagactagcttggtaactgttgttgtacgagaactcagcatacggcaagcttttgtcccatgctccaccaaagtcaagcgcacatgctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccaggtagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtctttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctttacccatgcaacattgcagtagctcttcctgctcaaggcatccgcaaccacattagccttgccgggatgataatgtattcccatatcataatctttgatcagctccaaccatcttcgctgtctgagattcaaatcaggttgagtaaagatgtactttagacttttgtgatctgtatatacctcacaacggttactgatgagatagtgccgccaaatctttaaagcatgaacgactgcggccaattccaggtcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccaagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccatgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgaccaaaggtctatcttagagaacacagtagctcctttcagctgatcgaacagatcatcaatccttggcaaagggtacttgttcttaatagtgacctcattgagtgcgcggtagtccacgcacatcctcttggttttgtctttcttttccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtccggaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggaggttgaactcatgcaaatactctataactgttctggttccttgttgcagggaacggaactctctcttcttttgtgccacaattccctcgggaacctgtgctttattgaaactatgacgaaactctgtccaagtaaactctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctagcagtttggactgaggaggtggagaaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattggtcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggtggcgactctgaagcttggagcggcgcttgcgaacgagggataggactgacatctaaagtagacaagggataggaaccaatttatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataaacccccaataaattcccgactgactgtcgaataaactccaactaaaatttttctaaagccctaggctgagctaattttttttttttttttaaaaaaaaaatccgacccgaaagaacgaccaagatttttcccgcaaaccaaagaggcaaaactccaaattttcccgaaacaattccaggtgcaaaaagggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcggctccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttggaagcagtaaaacagctgtagtaattaatcaatattaaccaaacactgtccaacgctacaccacgttgcaacaggcccaaccaacctcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaactggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaccaacatctagtcattttgatacccaggttatcaatggcataaggtaaacaataaatggctgagtattaggacccatcccacatgatattgtaaaagaatgcacatttaatagaaatgcgggatatttgtaaattgggtacaatatgatcaaacgtattgcatgacttgcctttctctcgcactgatgagatcacagcaacgtcttcgagaaaccgtggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgatttacttatgatttttagaagataaactgtgtttttactaataaagaaaagtccttaattaattattgcgcaattattgccccagggctgacgtcagcgaggggagggggcggcgccgacatgcgggccccactggtcagcgacactaagagagggagagggggcggctggcaagcgggccccactggcagcggcacaaggggagagggaggggtggtccaccggctggtgggccccaccgggcagcggcacagggcgggagaggggcgtggct

SEQ ID NO: 82060 - DNA, 14427 bp, Oryza sativa
gtcctatatggttgctgaatcagcaaggaacccacgtgggccctacatgtcaggatgccacatcaacaccctccctcttccccctcctcttccttcctcctctctctcactcttctcttctcttctttaggtaagccggccgacgctgctgggaggaggccattggggtgaggcgggagaggaggcgatggcgggcgacgaggcggcggcggctacgacacgggagaaggcaagggcggcgcccggtcgtgaatggcgttgatggtgctgtgtcgtcggtggcggcgaagcgatcccgcgcgggcgggtgccgcgacgttgggcgatgaggagaacggcggagcaggcgggcgaagcgaggcaaggcgggtggagtggggcgatgtcgcgggtgggagaagcagtgcaacggcgggcggaagggcgacatgtcgaaagccggtgggacagtggcggggggagtggggcaacagcaggagcggggcggcaacgggcggaaaggtagcaatccgccgtcggccatggcgcgaacaccgtcgaggtcgaagggcggtgcagaggatggcagagatgggggcgagggtcgcaatggtgaggtgtgcgccctcctaatcctcgaaactgtcgtcgtcatctggcggcttgttaccgcgggctggggctagcaggcagtctcgggcggacgaggagcggagggccgcgctgccgtgggcggttcacggtcatgggctgcgtcatgtcggtggcgtcgggcgccgcgtgcggggtgtgtgggggagtgcggcgtgcgtgtgtttgttgcatcaacggcggaggtggaggtggaggggtgaggtgcgggatcgcggtgacgccgctgctgccggtggcagctcctccctcgctagccaccgcccttgcccgccgtactcatctgctctctgccagccgcccgtggagaggggaggagagaggaagagaggtggtgaggggaggggaagaagaggctgatatgtgggacccatgtggatcccacgttgagtcagctgccacatcggacaaaaccgctaagtgacctagttagcactggttttataagttgaggaacgcgttgtatctggttttgcggttcaaggacgattttgtaattcgacgacaagttgagggacctttggtgtacttgttcgtaaaagaaaagaaacaccggcccagtattgataagaagcccagacggaccaacaggccaagcccatcttatcccaagaaaaaaaaggggaaaaattactcctttctaagcgaaggcctaggctaaagaacagagaagagacctgctcttgcgatccttctcactctcttcctccccgagtcgacggccggccaccgacttgggggaaaccaagccaccgccgccgcagccgccgtaccccaccctccctcccggcggccgcgggccatagccgcgttctcccccgcgcgtctgcctgcggcgtggaggcgtggggggcgacggcgatggggtccatgacgatcggcgccaagtacaagaccacgctcaaggaccccggcaccaccggcgtcctgcgcatggtgcgtcgcgatcccccctctgttcctccctccctctctctctcccgcatagcgtcgcctctctccctccagctccgattggtcgggtttaacccttgcggccgtgccctactggatacacactccgcgggaggtgcggtgggtgtgctgattctgtggagggatgtcgcttgacgggagggttttgatcgggtgttggtcgcggtagtgtttgattgggtatgctagggcttctgatgctttcggaggggtttgtggtggaaaggaatcgaaccgatctgcggtagtcggatgtataagagggatgagcttctggagacattggtttagctagcttggtggttagttatttatgttgggttcatgtagtggagcgttttgtgcctagtttctgtggatcagatgcaatgagttgcatatctgtttgattcgctgatgagttttgcgtagttgcgttgtaaattttgcttgagtatttctacctgcttaatttcatgcacagcttgctgggtctaaatggcatctatcgtttgatacttttaattgtagaacgaggataagttcaccttcactccccatgatccacggtcagcgatgaagctcaatgttgatttccggagcatcaaaggtaatttcatttggtctatttatagttgggtacagtgggagtactatgaccgtcccagtggtttagtaaataacaaactgaccaattcgtgattgccatttgtcagaccaggctccatatttcttatatctgattccttttgtggataatttgaaatatgttttctgcaaaggcattaattaacgggaaatcaagataatatatagctattctaaggtagaccatgcatagtaaaacagatggattgatttgatgcttgtgaccaacttgtctgatgtcaactttgtactttctgtgcacatgcacttctgattcaggccacaagttcaacaaagtagatggtagcaaaccagctccaccattactgaatctttcaaaagactctgacaaggtataggcaattctaccttaaactttatcttgttgaatttctattcatgatctacatttgtttctgtcattgagaaaaattgaaatttctatgtgttttttctttagggtggaggctacatgtttgagtttgacaatgttactaaccgcgacctatctcgtgactttgtaggtaaagtgaatggaacctaaaatagcttcttttatttcagtttgatgtcaaatgtaggttatgaaagttagaaataacagtattttgttatttgcctgagtattgattattgtgtaagcatcaagtgggaaattgtccacttagtgtaaaccaatccaccagctgagtcctttttaccgattgacttgaagattctgaatttgagtccaacagtacatttataccctgacacagcatacaaataaccaatggctttctcttttcagctaaagttttaggtaagcaacaaggtacgataccgcctaaaccaaatgtgccccctgaaaattcagttacttcaactggtgaagaacagcttagtgctgcagaaatgcaacgtcggatgaaattgctgcaagaagataggtaatgtgattatgtggaacatcactattgtattttttagttacagcaacatgatgtagttatgataatccagtgcaaggccagtggttacttgttttttgcaaaaatatgatctcagatgaaacttcccttaaaactcttatgcgtctataatgtaaaaaaatttgccaacactataatggacaattcaaaatgtaagctatccactgaaaatctcaaattgtatgcggaacacagacagtaatatccaggcttaggaatataaccttggcaacagccttgagcgggaataactaaacaagtatttggtttattcagattttgttaggttaaggcagcattagatttttcatgtcttaactgcatctattggtctgtttcatgagctttgctgcaattaaacggtagatacctgccagattggcaaaacgaaataatagagataatatatgccttctatccagtttattttatattgaattatagttggcttgaaatctgtggcattggaatagcattgtgcatccatttccatttaatggcttttgcttgtcatctgatgttagtgtgatataaatatatatatttttgatttcttctttttgagaacatggttatgcagctatattgattaagttttactatatggatgaaattgtagttctcatatatcttacaagagaaagtgatgcaaaattatgcaaactgtcgcacccacaaaaatttacatggtgtattacaatcttgagcttttttttgggtcttcacagtgaattgcagaagttacatatgaagtttgttcttggcaatattctgcaagaatctgaattttgggcaacaagaaaggtaaaattcactcactcaagcaaaatatgtttcttcctgatatgcttgtttaatttattctcatgaaactatcatgtctttatgaacttttacagaatttacttgaggacgaagcaaataaaggatcaaaacaaaggccaggtttcaaaagtgccatgctagctgatgttaggccatcggctgatggtcgggtacgttatttattttgtgtaaattatggtttattatgttctagtctgttgtatcttatcttgccagacattcactttggtgatagctggtgatattgatgttatttctttctttttcctactcctctcacagacaaataaggttacttttagtctcactaccgagataattcatcaggtacgttcatttgactttgatgattctttaggacaggccatcttagtattgttttactgtttcctcaactgttgtaggtgcagttctatgctataagaaataagttatatctacagatctactttgtgggatggaatttcagaattactagaatctttctcattgcacaatagactctacacctatttggcagggctccaactcctgtattcttgcatatattgattcaagctaaaacaaagtggttcaagcttcttagcttttatatctaaacaggcttgcaatttgctgtatttttagtccccatatagaatggtttgatccctacttaagccattttttattcatgaaactatatgattttgttgtctggagtatacatccagcatgtcagctagatcaggccaaagggcttgtacggttgtaccacttgaaagcattcttgcatccatgcctaggcttacaagtctgtaatgctcctaaatcagggctttgtctaggtcattgggcttggctatgtttgctcaatataatacttgcttatgtttggcatgcattatataatgggtatgacttcaaattgttgaacaattcaaatgttctgaatataccttaatgttctgcagatatttgcagaaaagccagctgtgcatcgagcgtttttagattttgttccaaaaaaggcaagatcttacccatttgtattataccttcattctttgtttcgcatgtactttagaaatttcggtatgatggtgttgagtttatactatttctgtattgatgtaaatggattttttttttgcgtccttttcccttgatcctccatgcaatcatctccctcaaaacagatgtcagaaaaagatttttggacaaaatattttagagctgagtatcttcttaggacaaaaaatactgtggcagcaactgctgaggctgctgaagatgaagagttagccatttttctgaagaatgacgatatactagcaaaggaggcaaggttgaaggtacagttttcgatgtcttgaaatactgcttatattattccaattcatttgtgctattgcttgggagttggatttcttcattcctcttaagcggttctgttcttccctgcagataaaacgagtcgatccaacattagatatggaggcagatgctggagatgactacatccatcttccggtgcgtctgtattctctacttctgttgcatatgcaacttgatgaagacgaaagtgatatatctttattgagcaaggatatctgttctttttatcgaaatcatgagttgcttatcctgttttgataatattttgttgggcatgtaggaccatggcattattcgtgatggcagtaaagagacgattgataatgatggtgaattggccaggagaacactttcgcaggatctgaatcgccatgctgctgttgtgcttgaaggaagatcttcaggtaaaagttttggatctgtcagaaatatttcatcctttctacgatcatttgatactaaataattgtgcaaatattttcatctgttataagagaactgccctcaggtatttgagggtgcttttatttgtttgcaactgaatagacatttttttcgtgctaccctgttgattgaagtcttctgactattctttggaactgagtcttaaagaattaatttcctgataataattatataaacaactaccctaagctactagccacttgtaatttcactgtgctgttcctgtactttctccacagtggagttcatacgttgatgctatgctgcattttcttgctctgcatatgcctgttaacttttgcatctttaacatatatgcgcagtccagtatgtgactaaattggatgggtgcctgtgtgtttttgcagacgtggaattaactgatacgaagactgttgctgaagcaattgcaaggtccaagaaaggttacaaattatgtttcaacgtgttttttttggtagtaacacttctgtatttatgctgatgaaatattattagctgcagaaccaccttcaagttctatttctgatgataccaatcatgagaggttggtaaaagtggcccgcatgactgagatagaggatctacaagctccacggagcctcccatacgcaccactttgtataaaggtaaaaaatatttcatggcttcatcgtagatcgatgaatcggaataatatattttaacttgtagattatcatctcttatttgtcttattaggatcctcgagaatattttgattcccaacaagcaaatgctctgagatctttaggtggcaacaatgatggaagacatgctcgtaattgcaggctgagtacagatgatgcatttgatcatttgttgggccaaatatcttctataaaagttaatgggttgaactatccggttattcagtctgatgtggctcttaaggtaaatgattttacacagtacactaatatggatatttaattatgttaagccatctttgtggagtaggccatatctccctgaaataggcaacctccttaagctggtacattattgctaatagtctactacctccagtgaaaaaagtgatgtttcaggatgcagtcaaacatcatactttgcatattgggcatttttttactatgcattttataagtattgtacaataatttgattgttctaaaatttataattcattggtcaaagtcatgttttgtaaactaccaatgtcatgggtagtggccgagaggttgaggccctagtgtccctagggaacggttcccttgtcttacggtagctcacttggatagtctagactggatccttccctccatctatataaggatggattgtatcgttattctaattaagcaatgaatcagaattagtctcccccaaccctaagtccctctctcatccctttcagccgtcgccgcctagctatcctcccagtggtatttaccctctatgccctaacccataacaaccaatgtcccaaaagcacttttgtggcttaggaaattattgctaaacataattgttggatactaagatcaaggggaaatatagaacaagggtttagaaactagtttgaatagcacaaacttttgaaataactgtcttgttagttttcttacatgtactagaccagaagttgatgatgaaagctgcatttgaggaccatgttgatatccaaattacttgtgactggagggtaattcttgaaacttgtttggattttgggtgatgtagcatttcagattgtacaaacattttaagaaatttactatgttgaccaacaaagttttagttaactgtgcagtatgtagctatgagaaagcctctgcacatctgatttttccatccacacatgttctgcatgacgttgcactactgttactgtggcttctctattcttaagctattaaattgcatgagcaggaaaacctaactacctgcatggtatgggcttaggttctgaatgaattgaatgaaggaatttcacgttcaagaagacttaatcttaagaatcctcaagatagtctgcttggtcaaatccctcgacgcacacgagatgaacttatggatgtgagatgctgacttcattttctgtactgaatattttctgcatttatttgttttatgttttttagttcctgtattacagaattacttattgtaaactctgtttcttagcactgggcagctatccaggaattattgcagcatttttggtcatcatatccaataacaacttcagttctttataataaggtatattatcagtcccagacttttctgcaccattacgtaatttatgtgtagcatttggatggtaatcagtatcagtagattactgggtcacaataaatttggttcctatagtgattttgtcaatgtagttttcctttcctagagtgaaaggaaaattttgcccattaattatgagcggtaagttaactaaatattaagtctggcactcagaagaaaaaaagggttcccaaagtgaacagtttcaattgtggattcaggtggtagcagcatggttatctgttcactgttgcgaatttatttgtaaaagtaaatgcaacatcatgagaaattcatcatagcctagtttttatgtttgttttggctgtacaacagctctttttgttttttctgcatattgcactgaattctgtaagaaaaaaaatattactgaaagcagactaagtaattttatacttcattcatctgaaaatataaggcttattttgagttgatacatgaaatcaagtagggtatgaaactgaggaagagaagataaaatgactactctattgctacttaaatgaaatatctttgaaacaggatagggaatgttaatgagatgttctgagaaatgtaggagaatatgtaaaggcaaataaggaaaaccaccaataacttccaatgcatgccttatattttgcaacaaattttgaaaaattctgccttataaaaagaaacaaaaggggaatgcagtcatgtgggtggaatagctgtacaaccaagactaagccttgaactatatttgcaagattaagaattcagtgtttatgtttttgtacttctgtggcaggttcaaagaattaaggatgcaatgacccagatatatcaaaagttgcaggtaatctccatcacaattgcctctttatcttcttcgagttcatcatgtggagtaccttagtttttaccttttgagcatgagttactgataagatgatagctagctggaattgctcttccttaaactatagtttccctcaaacatgttacagaaatgggtttgtattgaaattgacttcaaactttcttatgatgttatggaactgtaccttgttttggtgatgaaattctcactggacccctattcatatgcataacttccacctgcaggatataaaggaatcagcacaacctgatgtgagacacgaaatatctcaactagtaaagcccatgacccaggttcttatctatatccttttttgtcccatttccaattttccatatgcaaaatagatttatttcagcttcattatgacgactcaatcatgctactgtactgcatgagtttccacattcttttcgagctaccctttgtttagcatttctttatgctcattgtgttgcagcttatctgtattagcattgcttgacagttgatattttaactactactacctattaactgttcagcggtgctcacttgctgtctttgtacacgtatcagcatgtcttctttcatttgcatattgatgatcttcttcaactgctgaaatgccatcaatctggttatatttactttccaggctttggatgctgccttcaaccatgacttggagcagcagcaaaaatcatcgaaatccgggaataagcccaatgggttttaactttagccgagaagactagcttcggcgacggattagggattgatttactgctagagcaagagggctacttgcagttctggaggggttacctccttgagccttgattctcatgtatatttacctgagctttatagtggtgggcataacgtgcttactaaacgccccaatttttcagtgcctgattcattccaggcatactctgggatggtttgtgttcatcacagttccaggtagaaccaaaattttgtgtacactttggaaagaaggaaaaaaaatgagcacgcgttgatgctgcgttccttacccgtcattctgcattgttcgtgcaagttgtagacgacaattttgatatggtcgagtttatgcatggacaatggttcactcttgctgtgttgcaagcttgcagtatggcaaacagaatgaaactgcaggattgttgctagttttctggtgaccgctggttaaagcatgtaacgttcaccgtgagcaaaaggcatctccgaccggagcgatctgcagtccacgggaagaaggcccaaagagaaaaccaaaagaaatggaaaaagaaggccgaaaaaaacgaaatgaaaaggaaaaaaaaaataattgcacgcccagtgggactcgaacccacaatcgcctgattagaagtcagacgccttatccattaggccatgggcgctttgttgctgtggggtccagctttaactaaatgtaagaattcgttcttctgttcctttgcttcgacagagagataatttggagtatgaattaatcatctaatgtctaaaagcaattaacatgatatgaattaatgagagaagaaaaaataatattaactaaggaagaatgaactatataggtatacaagatattataaaaaatgataaagatatattttaaaatattatgtgaattatgtgggatgatttaatatgcttgcataaaattctaaaatttaataaattatagaattataaataatatagcatgcttgcatgatgtttaagatgtaataattgttggtgaatgataatgtgacatctttgcatattgagttttaagattgagtgggttaaacgttatagtaagataggattagaaaactaacaagtgaggtggatcttgttttaaggaaaaatggaatttccttagtcaacgatagtgggcctgttcggtagcctattttcgcaactgtttgggctgtgccgcacaacccagccgttcggctgcagtggtctaggctgtgttgcatagcccagtcgttcggttgtggaaacggctgcaacccactccccgcaaaaaaaaagttggtttctcgcgaaaaaaaagaaagtacctatacatctttcgaaagatttttataatcgtatcacacagatttttaatctttatattaaaatctgatagatataataaaaagcaaaaagcaattaagaaacaccataatggacactaaattaccatatcctcaagaaaaagaccaaatcaaatataaaatttaaaatttacatgcgaagattcaaaaattacagtgtaacttacaaaagttatagtgtaagtttcataaattacactgtaacttacaagaaaatgcactgtaagtttgagttagaaaatcgagtgagagataagaaaaaaatctttcgagtgagatatagcgaaatccaaaaaaaatgacgcccctcttctagttcccatctcccagtcctatcgcgtagcccacactccaccctatcgcgccttctcttccatcgccacggcccacactctgccgagcgcgtctcgatcccctccgccttctctcccgtcctcctcctgccgagccacgccgtgccttcccgatctcctccacgttctctcccatcctcatccctccgagccgtgccgtgccttccggtcgcgcccgacgccaccccttcccatccccttccttttttcctctcaccactcccgatatgatcgattaaatccaataggatgtgaagttcatcttgattcagctgtgggggttgaggggaggggaagctcgacagtcggctggagttaacctcattagggtgtggttgttgaggggatagagtgcagccaagggaaacatcccgtcgggcaagacccacgctgtgtcgctggcgacgtcttctcccccagatccgtccaggtccggcagttaggaggtaagaatcatctcccttttgtgatttttgatcttgcatttttaggggtatttgtgtatggcaccattcgccatgtcaactcggccgaagggcaccttgtgcaggcatacgaactgctgatttgattcttggacatttgtaggaccgcaaccagaagcgctggcacataacctgagacgatatggcaccacggagcggttggcacttgtaaggtcacaagagcgacttgtacgtaggaatcctcaatctgaacaaacgatttccctccgccggtcgacatcgtcatggtctccacctgaagccgcatgatacaatctgcgtacaactcctgcacggcagaactaactcaaggcaagcattgctttctcatattagttatcagtgcgaaaaatgttttgcatacctgcaacttgatgttagtactgtgtttaagatctcaaaaactcctaagttggactacatgtaatgcaaaattacacatagatggctggtggtcgcacctattgggacaaagccctcacaaagatattcctcgacttatgcattgctgagaagacaaagcgcaatcacaacaagaagggtcgtaccaacataggttggcagaatttatatcgcaatttcagagaacaatcaggcaagaactatgacagtaaacagcttcaaaacaaatttagcacctttaagagacaatacaagctatggaagagcctaaagaataagagcggaggtgggtgggacaacaattctagcaccataaggtgcgatgatgattggtgggaagaccgtattgaggtaactacatgtgaatattgattttactacaaaactaatattgagtttttgttattgtctcgtcaaacttacattgtccatatctgacttgtaggagaatagggatgccagacagttccgtggaaagccgcttgaacatgaggatgagctgactactcattttggttgcatggacaccgaagaaggtacaatgttgtgcgtaggtggtattggcaagagaacaccaagcagtggaagcgatgacaaccttactccgatgtctaacgacaatgtcggcttgtctagtgctggccgtgtggcttaaagggcagggaaggagcaggtggttgaccgcccaccacccaagaagagtaaaaatatggagtactatgtagggtgcgtatcagagagtatgctcgaaagaagcaggaatgaaagcagtgtgctcaggggagagcaagatgagataaaagaattgctgcaacttgtagaagaggatggtgtggctcaaggatctgagttgtatttcatagctactgacctatttaggtcagctgcacgatgggcagcttttaggtgtatttaccctgcagagaatcgtaaagcatggctccgatggacttgggacaatgctaggaaaaagtgataccagtccatgcttagttgtcgcacacggtgtttgattgtatatacccatcgccaacacgacgtggcattatgtaatcggttgtttgaccttggcatactcttatgttatgcattatgaccttatttgctttgctactttatcatataaatttgtatcagtcggctagtcatttcatatagatctacttgtcctttctttattcttttttttacttgaaaattgaataaccatgttgcatcctcacctactgtagaacaatggaaaaatgcactacactgattttgtacatgcatacattttgtaacggaaaaagtacgaattaccccgctgaactatcgcagtcgactgaattacccccgaactcagaaaccagacatagctcaccttaaactattaataccgaacgaattacccccctcgacactgttcaaagtggttttggcttgagcttgcacacgtggtgctaacgtggcaatccagtcagaaaaagactccttgggcccacttgtcatatctctccctccccctctctctcctaggtccctctctctctctgcccggcccctctctctccctctcagataggcggctgcagccggcggacgggctcgggcatgcagctgtggacggcggcacggggggaggacgcggcagcggcgggtggcgccctctcgtgctccgtgtcaacagcgatgggggcggcagcacagcgcgggaggacgcggcggcggcgggcaacgccctgtcgagctccgtgtcaacggcgccgcgtccacccccgatggctgcggctgtgtctgcaccatgacgtgcgcgttaacggctcctcgttgtcgaactccatcccctcaaatgggtcaacgccgtcgtagacgacggcccgcgccacatacgccgccgccgccgccgaccttgccgagccgttcccggcggcgtcagcctccatctccgcagcgtagtcgacgttgtcgttgtcgttgtcggcggcggcggtggcggcggcggtggtccgacgagggggtggaggaggtgggggcatggtggggggggggggg

SEQ ID NO: 82061 - DNA, 11038 bp, Oryza sativa
  unsure (1)..(11038): unsure at all n locations
cgatcgatttgtgagtaatttttctctaacagcagagtgatctcctaaaaggttaatgttgctttcggagcagagtgtgaaccatcagaatagtcggaggaatgatggcaaagtttcagctgtttcttggggggggggggggccaataacggacatgatacaaaaattcagacaatttttattttcatttcaaaccattttcgtaacttgtggagatgcttccctctttggtatgacaacacaattctgttgctctgagctaaatagctaatagcatggtattgcatttgggcagtgccaaatcctaggctaattttggcataccaaaacttgcttctaggtttcgctattatttaggagtctgattttggtaagggttacttaattattggcttcagtccaaataattgaaagtgctattgtagttgtccaaaaatttagtagggaacattttggttgtgatccaaaatgccccttaatttaccaaaaagtgattaaatttttcatttcgaatcaaaggggcagctaagtccctgtttagaagagctcttgatattaattttccttatcccaactcctaatcttcaaggaattatatcctcaaataatcaggaccagatgtacaactatttggctatcagatttataccagatcctcaaggacaggattaaaaggaattggccataattggatgaatgaaatttttagaactatagataatgtgaggaactaatattgtaaaacagatggtttagactgaaatttattacaaaacttaaatatcatggcattgaaaaacacagatttaacgccttggcatgtacctcactagctaaatgtaggagctataagtagttgttgcctcacatctataacactaccttgcactatactcccttggtaaaaaaacacttttggatttgaatatggacgtagcatatgtccagattcaaatccagaaaatgttccttttttttaacagatagagtatatgcttgcgggtggcacccttgtcatgcactggtgcattggcacacccttgcatgagagaaaatataagaagaggtatagatggagtgctaactccaagagtgttacatttatttagggataaggtgagaggagaataaaggaaagaaggagagggtgagccactcttatacaagaagtaaggaaagagaaatagtggtttaaaatgaataaaataaaattatttgcacctaaatctaacatattacatctactgctaagcgagataacagccatcgtcatctccaagagaggtgccacatttggttacccaaatctccatttaaccatccatgccaaaagatttccacctattattgtgccttcgaatatgttgtttcttcatcgccattcaaccattcgtctccctattgttttcctaccttccccgtagtaaaccaagacataggtgaacttaggatatctagttgtgtctctaggacaatgttgccctgccctctttccaccaataccttggacctccttcaattctctagtgatgaagacttttgcctcgatggtgttccctctggctacaaagatcaattctcctccctctttccgtcattgctgcctgtagaacttcgagaggaggtgggcgaggtcagagttgagcaggcgcctgggaaggatgcactgaagtcaagctacatggtgttgagaaggagtcttccaagcttgagaccaacacgtacgcagatcaggactgaacctagagacggtagagcagctcgtttcggtagggaggtagcaatgctgataaggagaggccgagagggagaaggcgcgtgacgcagttcagcttagcgaggaagtagtggtgcttctcggctcgacaaaaaggcagtaatgttcatgtgggatgagtggcagcaacgaccaggggcggatccagcacgggtgcggcggggtctcgagactccactactaccgtgaagactatgagagaccccacgaaggccccactaaaaatttttatcatatgtagatggaaggggggactgtaactttatctagtttgctcagaccctactgctatttctttttggatccgccactggcaacgacgcaggtgggagagctgattctgcttctactactggcatgagacagagtgcaagagttagttatcgaggatagctagtcatacggcatgtcaaatttggtcaaccgctcctctcgtttagccagccggataagataaaattgtaaatagccactctgttgaaacccatccttttacatgtttactcttttctaatagagagtgatatagccaatctcttagagatgctcttaaacttgctatatgagcaaggtcaggcccaatacaatgcaaggccattcatatcaatatccaatttttttaaaaaaaatagaatagattatataatatgttatacatatgtatatgaaaaataaaaaagaagaccgtattcaacacatcataataaacaaataaataagtaatatatgatattatacatttcaaatattagtatattagctctaaaaaaattgcccctttacattttcgttatacaaccttagaatcctagctctgacgcttatatgagcatatacttagagcaattactataaggttcagatgctacgtacctctattaagagtaccacataatattagatgatgaggtggaggagagaagtgaggaagaagaatgagtcaccccttattcaaggggcaacctccacataaacaccaaaaaaaagtgcaaagagagagtgagatagtgtgagagtgaaccaacaaaaaaatatattagggtttgggtattagagacaatatcattactaaaaaaacgattttttatggtgttggtctatgattttcgctggcggaaaaataccaaaaccgccagcaaaattgtaacgagggagtaaggggcatcgacggctagcgaaaatggatctttgacggtgcccgcgttataccagccgccaacaaaaatatgtctattttcactggcggtcacttaagtgcgccgccagcgaacatggataattttcgctggcggttgtgttatacaaaccggtagggaaaatacagttattttttctggcggcccacttaagcaaccgccagcgaaaatagattttcgttggcggtagaaggaccgcttgcatagatggaccaccatctattaatatggaccacgcggcccaccaccaccaccaccaccaccaccagtccaccacccacccgccccctctctccagctcccctccctcccttctctccctcgcaactctcctccctctcttctccaccgtcgccatccatcctcaccaaccagcctctcctcttctctacccccaccagcactctctcctcctcccaccccacagtaggcggcggcggtttcggcgtggcgatgacgacgcgaggtgggcacgcggcggcgacagtaggcgcggctctcgggcgcctgcgggcagcggctcgcggggaggccggatccgccgccgccggaccacggggagggcggcactgacctcgacaccattgaccgtgctcccgctgctagatttgattttttttttctttttctttttctttttgcatgttgttctagatgatgcgcatgttttgatctgtgtaaatgatgtttgatctgtgttgatgatgattttgtatttcgtgtttaaatttggaaataagcagcgaatctagatgtggatttgaaatttgaaatcaatgaatcaatgggcggctgcatgggtatttacgttggcggctgtgcagctgcatgggtttttttttgggctcaatataaattttcactggcggccgatttaacactgtcttaagcaaacggcagcgaaaatggatttttgctggcggctggcttaagacgaccgccaacgaaaatggatttttgctggcggtcaataaccgctagcgaagatcttgatcttcactggcctttactttgtggcggctgcaaattccaccagcaaaaatctaaaatagccgccacgaaaaatagttttcgtagtaatgtatattatacaaattatctcttaattaataagtatatgacatggctaaaaaggtggcagtcatccctactataaaacttactcttaaaggttactctctccttttctcttctctctcagagttgctgcgtatctgttgcccttgccctaactaatagtagcagcagtaggcatcatctctagctagctagggagacaagcgattatgttaccaacctgaatgtccccggcggccctcccctttcccatccgatcaaaccaaagtgctccagtaattcctgacaataaagcgtaaagccactaataagaaacactccaatgcaagtagtaggcccagatttcctgaagaagcacacaccaatattcaagagaaagatgcatagtactctttaatttgtaaatcaagtattggtggcccctcttattacactgacatatctatatatgttttaggcttagaccatgcagattatcttcatatttttttagttggctttattcttagtccttgatactttcgtaggagaagcaatactatgctccgtgaagctacacttttaaaattggtagccagcgatcttttattctattttggatggcgtagtttctataaaataatgttataaattctacatgttttatattcagtattttagttggatatcatcagagtgagatggagtttgttccatgaccacgtggtttttatgtatctcttctcttgactcgttgaccgtgtgtctgttgatagagttcggggatgtaaattatttcccttattaagaataaattttaggtttaaacacagatactaagtaagcagatgaaaattaaaataagagaagaaaatgtaggtagagaaattatcatattttagaataaatttaaatgttaccaaaattatattgtagggcggataaaatatgaagcatgtatttagagcaagtttaatagtatagccaactgctagctacaaatcatctatagctaatgtaataactaattcatacattagttgcttactatactattaatatctggtcctacctatcatacacacattacgtcttggagtccgtactgcagctgggctacagatctgtagcctgctgctcctcccttttcctttatctttttaaaatatgtttataactggtttatagtctgctattgtatctgctcttaaatacgtatgtattcgtgtacaatagtatacttaagtaggtggagagagagacgacagagcacgcggaatgatagcccgatgatcatgcgcggccaaagcgagcgaatcgatccgagagaaagcagaatgaaataggcaggcagcatacagcagcaaaggcaacaacaatatatatactgtatgagagaaaaagaagggaaaaagattgtgggcgcggcgtacgagaggaggagaggcctgacgccgggaaacaggtcctcctgccggcgggacgacgtaccagtgcactgcagcgcggcaggcagagcgcgtagccaacgcccgcccaacagtggtgttgtgcctggctactgctggctttgctggattttccaccttttggtccttttacaaaaacttattctataaatgaatccaaaaaaacatattctaaaaatgatcatttttgcggtgccaacaatggtcatgatagcgccaatgacattggcactgtccccttcatccctcggtgaaagctaactcactaatgtgaagggaatagcgtaaatgttgttagcgtcgatgacctatttgaaaaataaataaaaaaggacatatttgtaaaaaatggacctatttgaaataattttttttattacaaataggtccttggcacagaatgacagtcactgaggacttatttgtaaatttttattataaacaggtcctttttcaaaaaattacaaattggtcctctgaattagcttccactgaggggctatggggatggtgccaacatcattggcgctatcatgttaggacaaggcgctacgatgttggtgtcacaaaaaggatcatttctaaaatatttttttaaaagataattatcactgtatgagtactaattactcgtatcacaaaatcacttcaatttttttcatattctaccctcaaccgtctttccactcttacctattgtcatggtcgacatcacatatcaatgcaggaggtccgaaacacaccgtgacgcggttggctggaagattgcggcggcaggtgcgtcacaggaagctgagtagcgtgtgtcggacggctacagtacaaggcttgcagattgataagattagcttgagtccgaattttattagcaatcatgttgagatttgtaagcatatttaaaggcaacatctatctatctattaattattatatactaaaaagtccattaaacttcctacaaacgctcttaagccatcatgtgtactcctacaaatacttctaaaccgccacatggcactttaacaaaccagtgggcctaataattttatctattataattttattgaaaaaaacccagtccccccctcccctctcctctcctcccaccatgggtcactaaaagtccattaaacttcctacaaacgctcttaaactgtcacgtgtactcctacaaatactcctaaaccgccacatgacactttaacaaaacaatgtgtctaataattttatctattataattttattgaaaaaaacccatacccccctctcctctcctcccaccatgcgcccaccctttcactagacgtgcttcctccctcccctcctatccaatctcttctttttttatttagttattaaaatttttgaacaataataaatcttaaataaccaaaattttcctatagttatttgttgttgtccattaacaattaaaaaaatataaggtgttctttaacctataagaaatataaaatttttatcgtatcctaaactttgcatatcacttagaattgttatgtaaattagggaaaaattgataatgtagattatacgatcaatttacaaaatatgcataaataaattaagttagatctattattataacaaaaataagaatacgtccatccgtacatgcttcatcttcccctcctatccaatctctctttttttttcctttagttattaaagctcctaaacaataataaatcttaaataaccatatttttttccatattacgttagatcttagtcacaaaataatctaattgtgattaacatcccaaaacataatacctccgttctaaaataccagtatgtttgttgatgaccaaatttggtagctccatgagttggattcgaagttggaaacgaagccgattttggaaaaaagcctgttcgggaaggctaactacgaacggcatcggctgccgctcaaatcggctacgttgatattggctgagtactgggcatgatgtaatcaaaccgacgccgccaatcttgggaaagtggccccgcaatcgtcattgggtgggattaaagctagtcattgggtgggattaaagaccttcatagctattgccacacaaggataggagtcctaagagaggcaattgtatctattaattaggacatttttcttgtttccttagagatattttggtaagggcccacctaaagggatcgttcgtattttaaattatgttagagataagagtcgtgtccagaaaggacttaccatgtactttgggtataaatatagcccgaccccatgtaatcaaacaacgtcagttcaatacacttcagcgcatcgccacccttttacttttcattgttcttttcgacgagtttttgctttcgagttgggctgcatcaggttcgatctccgacaaaaaggtatatcttgtcatggcggcttgcgctctcaggatcagtgcttacatcttcatgacactctaatcacatcttcgcaagctttcgagttatcatatttattgcataatctagatcgatctcgttatctgagcttcatcggctagcctctatcatggaaaatggccgataggctcagccttcgactttgatttaaattatgcggtatatctgccatcttgaatgagctttcatcggttcgattagatcttctgccactcttcacgcttaatgttgcatcggttaggttcgatctattaagtactgtcctgaggccttttatctaatctattctttgactgctaatagagatagtgtcggggtttcagctgatcttacctgatttagtcgttttatcttccttcttggttctaaatcgtctagatttaccccttatatgaagatcccatcctcttgaagtagatcaagctccctagtctctagattaggtcaagcttcctatatttcatttgtgctggtatcttggtataaggtggtatcggagtattagccgatacagattgggttcgctccatcggctatgctatgagcacgcacaatctcttctttggagcatgtttagatatggagcgatttatattgtctcggtgccaacaccgatctatcccagtcgctcgatctaagcatgccccatctaatggattacatgccgctgatatctacagccaatcgagtacaccgaacaatctccaagtttttacttgcctacgccgatccaacttaagttgcatcggcgtggcccccaacaatatgtcatcggcagacctgtcgataggctatcgttgatggatttaactctttgttgtttcatgtcttgttggttgcaagatcaaaccatctggcacgctcaggacccgaaggcaaatttcccggacctgcactgtaattaagcagatctcctaggcaacaatgttaaaataacattacctttattaaacaaaataatgttgattaaataatacataaaaatattttgacatcatttatatctgtaataattaaagtaatcaacaataccataaaataaaatactcttattatgattagcattccaaanactataactgaagttctaaaatataaatgtatctgaataatgcaaataggtgtatcatgacaaatattttgcaaataaaatcttaatattgaaagtggatacattctagaaagaaaggatcaaatgtgttgttgaaaaccgtatcgttatcttataattaagaagaataggggggcatatttgtcggcattttcctctttagtctttggagttcaaacctaactaatcttagtataaagtatataatatccagagtactcgacccatatagggtttttcttatgtatcaattctatgtccacttttcttatgtatcaattatatgtcacactcaaacatatgtatcatttctacttataattaaactgctattcactaatcgttgagtcaggaatattgatgaggtgattgtttattaaattgactatatattcgagattcaataaacctatatatgttgtcaagtggtaaagacgaaagtcaacttgcaatatagattaaacacaaacagaataggtcaatctcatgaaataaaataaagctgcatcgtaactttttgaaatcgaaaaaaaaacatgtatccataacatacaccctacatataatcaaagataaccacggctaatctcattggcatataacctatgtatttattgattcattaaagcatataaccaattggagaaattattagattaaaaactcatccttaacaaatcagaaaaaatattcgagttattttacctatagtagcaagctatcgtagggtgctcaactttgtagctaacgaggaagggaaattactatgttacccgcttattaaataagggttaatttgatccgtgccattgccaatatgcctatttagataaatgccattacattcgtctattcgtaattgtgccactcaaattttacaaaattggaaccatgtcatcgtcgtcacgttttccatctcccccctcatctgcaaatgggactcacccatccgattcatctttctttcgccctcacttatcttcatccttccccatctctctatcacggcgaggagtgaacaacgcgggcaggacgggagggggtcggcgacgggcgtacattaagtaaacggtggttgaatggaacaattgtactttagagtcacttatattttgggaaaaattgactcggtttatggtataaataaagacatctatggtatacaagaaaaattgttatttaatttaaaatcaaataaaaataagaaatgctaaatattagaaaagaaagatacatagtataaatgatatatagtttaatttgtagaaaccaactcaattgttgtgacaccatatactttctcataaattcaaaactacacagtttgatttaattttagtttagaattttttatgttgcgtgcgtaactataagaaaatcataactaacttcaaagtaatccctagcaaattggaatatagtcaaaaagtatttcaataaaaatcacccacaaataaattaacattggtaatgaaattttaaacagattaaataaaatacctacgtatgtgcgtgggctaccttcctagttagatggaataaagcaagccaattcaatctgattctctcatctctcattctctgctttctcaagctacccaagccagggccaccaatgtcacattcttatccaattcattcatacgccagggctcataacacctatacaccatttaataaggagacataatagtttttcttcttaaatcataatatgtactaaaaatatataattataattattttaggacggagctagttgaaatctgcgttgtactgtgtaatttaaaaaaaaaagaaatactcaatccgatcctaccaaacccaaaccaaacctgcttcttcagttcttctatcctcttgcaccttatgacaacaagagcatatattggtagtttatctaacccaaccaaatatttacccctatattatactctagcttgatacagtacttcttaccgtccttaattttccaaagccgaattattttga

SEQ ID NO: 82062 - DNA, 24436 bp, Oryza sativa
attttatttacaatattagttaaaacagattttgctagatttggttatttgttcctaatggtagttgttgacaaaatgataatcgtaatttgatattcgtaactcattcaccatttgcatttcagattccttgagttacaaactgctggtgtggcgccatgcaaagtcatagaggtacatacctgcctaccttctttttgacatttcctgatgttacttgccgtcttggcctaccatggcccattgctgtggaaggcatatatcatgatatcggttcatactcagcaatcccttattgtctaaagttggacagtttttgcaaacatatttgcatttcttttagaaacacagtacaaacgcagacactcacaacacgcgcactgcgcacactcacccctatgatcacacacacgcacactctatccctatgattacctttggaagactagaccaacatatctcgagattgatgaagtcatcacggaggcacggacgccttgctgtcaacgggtacgttgcctactactgaaagaataatttgtcctaaatacgagaaccgggtgggttggttccaccacaaggattttttttttttttgctgtcaataagatggctgcgtgctttattaatatgtgtccaatgatgcctatcacgtgtggtcaaaattaagctgaaagccatactcttttgaactctgagtactagattacctcattacttgactcttccctgatgatgataaatcagggtcaatcagcaatctggtagcattatgatattatcaacttggtgtaattttcttccctttcttgattattccgcgagaaaaatgatgaatctgctagctttatgcgacagattttcaatcaacaaactcatcagtctaaattcttttggtttttttatatcaagcacggtgatcactaatcagatatcactttcagggggttgcttgcttccatgctgtggttcaaaggattcggtgttaggttacaggtaagatgcgttggttggcctgaattcttcgcgcgtgcgcttctgacagcgtcatctgggcatgggattggatcagatttccacagtcaccatttcactcatgccgattattataatccgtaacggtttattaataaccaaaaaagtaatttgtgaataaaaattttatatatgtattctactattcttagcgatttaaaagcaaatactggaaaataaactaagatgaaaaaaaatcccaaaatcaactctaaaataaagttttataattcatttttcgctgcggcttataagctgaagggtaaacgatagagttgttcacgctttcaacctgaagaaatcattcatggcattgatgcttttccttccgtccatgcgtaaacgatagagttgttcacgctttcaacctgaagaaaatattttcttagcttcctgatcattcatggcattgatgctttcccttcagtccatgcgtaagatagaaggggatctgtgcacgggtgttgtgtcaagttaggtgcaagactgaagacttgcaggacagtgaccccttgtctcacattctgaatttctgatgagtgaagtgcatctggtacaagagtggtttgttaaagtactaatcaagttgtgccattttgtaattcttttcgtaatatgatcacaaacctttacacttggcaaccccagtttgaccaatttgccaattgggttaaaggacggagattaattgtaaacgttaacaacgtaaagttcaagcttgaaattactttgagtttgtcaatatatttcaaattagttacatacagctattgcttttggagctttggtagttattaacagtatatatcactaataaaaaggtcaaaaggtcgatttaatacaattcatcgaatcaaattatgtttgtgtataaaaaccatgttatcaaatcatatcactaggcaccatttaagtacatactctgttttgcatgttatcacaagataacctagcttgtagagtttgtacttctagaagtgtgatctttgtgtttccaaaagcgagatcccatgcacactattgtcatatatttgtacctaaaaattgaccttaaattgggtggattgccaacgccaagtgggttaagaaaaaaaaggaaatgtgaacatgtatactcttttggttgctttccgtttaacttgagcagttcagataacattagggcgaaaatgcactgaggatcacattgatatggatgaaacatctggaaaagtaatctctatggtagtgtttggtttggggaccaagtgggatgggttagacctatccctttttttaggatgggatggttccggttgtgtgtttggtttgtggtataggatggttatagttttttgtttggtagaagggattgaggtgggatgggatggacagtgtttcacggaccgttagaatgggggacggaggagcaggtcggcgcgagcgaaggagaggcagcgccgcagcggagccgagcgggaggcggcgggagctgacgacgagcggcggcggccggtcgcggaggcggtcgcggacgaggcggaggcgggcgcggagacgaggcgaggagcggtcgagcggcggcggccggtcgcggatgaggcggcggacgtggcagagagcaggcgggggagggatgggtggccgtggcggagtcgagtgggaggcggcgggagctaacgacgagcggcggcggccggtcgcggacgaggcggaggcgggcgcggagacgaggcgaggagcagtcgagcggcgggggccggtcgcggatgaggcggcggatgaggcggcggacgcggcggagagaacaggcggaggaggacggagcggcgccgggagagggagcaggcggaggagggacgggcggccgtggcggcgccgcggcggagctgagcgggaggcggcgggagctgatgacgagcggcggcggccggtcgcggagacggttgcggatgaggcggcggccggtcgcggacgcagaggaggacggagcggcgccgggggagggagcaggcggaggaggacggagcggcgccgggggagggagcaggcggaggagggacgggcggccgtggcggcgccgcggcggagccgagcgggagcagacgccgttctctccgtcgaagtgggatggattggtccggccgattttggcggaccgtttcgtcccggatctgggaggaatattcctctccagggaccatcccatcccactcacctctcaaccaaacacctctaaaagtgggttcatcccatcccatcccatcccatcctctcaaccaaacactacctatgctatcgcggcaattgttcaaagtcccgaagaaaaaccagatttactaacggattatctcatctaattgttggcttttctataactttgacgtgtggtcttttttctttagttaactgatgttgcattgtggtagttagaaatgcttcatatgaaagccttttctcgttaaaaaaaaaactagtggcagtggtggtcgtgattatttttttttccgattacacggaagatgcacattactagccgagtgtgtctctcaagatgttgaagaggccaatggcaaacttctaacgtcacaacgaattattgaaagccacccatcttctcgatatgatgttttaataaaatactcctaaaggtgtttcacaaaaaaaaaaactcctaaatttttgttaatattgcacaagagtctttccacaccacttttatctaatgtagaaaggcttaagatgatcaaatgggcgtgaatatgaggtatgagcttatgttaagattgttcttgcaaaaataaatgttaagattgtgtttttcaaacactatcattctatcaagttcttccctgtaagaaaggtggtgtttgatgcgaacagaaagaaaacccactcattcgttccatgcagcaagtatgattactttttatactatagcgagcgcccaggtttatatctattttacaaaacgattttgctaaaacatatggcgaagaatttttgggagaatatcagtccatttcttgtctgtttgatctgatgtgggcctcatttttcggcctaacctagcaaatgggcctttagcaagttaggcccagtataacttctgtcagaaaaaaatgggcatttgcaaatttaccaccggttttttaatattgtaaagatgccactcgaatgacagttctagtggcatttttgcaattttctagtggtaaatttgaattgcctaaaaaaagggtcaacttggcaggcctacagatagttggaccttttgaagcaccctaacgaggggccgcctaatgggagccccccccatccccctatacactgctctcttccttcctccaccccttcttctcttcctaatacaccataaatttaaaaaaaataaaaaacacaaagttgaaaaaacttatgtatagaaatactatataaaaaaatttgaattcaaattcaaattaaaaacaggtatgtaaactttgggtctataaactaatatttgaattcaaattcaaatttgaattggatatgtaaacttttgatttataaactttggatctaaaacttttaggtgtataaactttagatgtatagaaatactatatataaaaaatatttgaattcaaattcaaatttgaatcggatataattcaaattcaaatttgaatcgggtatgtaaacttttgacttataaactttgggtctataaactttaggtgtataaactttagatgtatagaaatactatatataaaaaatatttgaattcaaatttaaatttgaatcggatatataaatttttgatttataaactttaggtctttaaactttagatgtgtaaacttaaggtgtacaaattttagttgcataaatttactaaaataggaaagtaatgcggtgccaaaaaaggaaaccacgtggaggagaggggggcgccctaggggtgatcgccccttagcaatctcgccctaatgactacttcctctgttttctattataaaactttctatcattgccaacattcatatatatgtcaatgaatctagacatatatgtttgcctagattcattaacatctatagggatatggacaatgctagaatgtcttataacctgaaaatgaaaaggaggtagtataaaaaaatctaaactatttaagagagattttatttatgagaaaaggtgcaacagccaaaagcttctcaaacaggtgttccgacaatgcaatggcttgtgtggtttggttccaaaacttagccctgctaaaacatttataacttcaatagtaacttatacgtattcgaattgaagtcaatgtgtgccagattaatataacttgagaaaccttgccttactatgccaaaacttaagcttttcacattaccaatattttgtaggctaccaatccaacatgccctaaatacacttcctgcaatgcaactctcagtgtatttttcaattgatatgattgtgttttctattcaaagtcatacaagaaatacagttccttgattggtatatatgctaaagacggatgagcgacatacacaatctacccctccatttaaaaatatattaacttttcactacacttatctagatttgtagctaaaaattgttatatctagattcatagctaaaaattgctatattttaggatagagggagtagcaaacaatatatggcacgtgctaaaatgtgtactccctccgtccaacaaaagataaaccctgggttttcgtgtctaacatttgattgtccgtcttatatgaaaattttttataattagtattttcattgttgttagatgataaaacatgattaatactttatgcgtgacttttcattttaatttttttaaataagacagacggttaaacgttagacacggaaactcagggtttgtctcttttttttggacggagggagtacttgataccatttatattaagggttaattagatacataccattaaaaatttaccagttttaaagtatgccattactatttacgtatttataacgatgacattgttgtttatttgtaatctcaatgataccattaagatacgtattaacgaaaacactctcatcttctacctccctctcttccctcatcctgtcatctttctctgctcatgctgctgctgctgctctagatcgattgaagatggatggcaaggacgcttgctgcttctgctagctcgacaggaggccaaaaatggctgtgtgctgcaccggcggaaaggggacccacggcgacgagcggcggtgcttacgatgcaaagacctagatctagagccgctgcggacggagcggcttgccattgtggacgacgacggcggcgcctgggcgccgaagacctgatggaggctcgatctgcggctgctggttgccacgggctgcttgctgcttgcttgaagatgaaggggcgaatgagcttgctggggctagtttgctgcttggagaccacgacgaagaaaaagactcaaatcccatcgctggtgatgcctccctattgctccccgactgggtcgagccgtgcgcatctgccgtgggaattcggagcgccagacagcactgcgcaggccgttgtgccaaatgaccttgtcagatgcagtgatggggaagatgaacagtggagagaggagaggaagaaggaagatgggggtaattctgcccaaaaagtttaggaaatataataaaggggcaagtagtggcatatactcactccgtcctataatataagggattttttttacttgtactgtttggccactcgtcttattaaaaaaaaattgaaattattatttatttttttgacttactttattatccaaagtactttaaacacaatttttcattttttatatttgcacaaattttttgaataagacgaatggtcaaacaatgcaaataaaaactcaaaatcctttatattatggggcgaagggagtaccaaataaccacgaaattataatgctatggttacaaatagttgaatactaatggtatattttaaaaccaacaaatttataatagcatgaacccttatattaaaccctagttgtccatagctaatcttgtgatgattctaaagagttcatgaatgcgtctttacttaacataacatgggccaacttttatttggagtgtctctacgtgggcctaaaacaatagtggtttcaggccgaaaccacattgtcattaattaagcgtatcgattgttgttttgcctctaaaaaatcgtactcctagtatatctttttctgacgataaacagaatgcggttacccttggtacccactaaaactaaaactcaacgtgcaagcatgccacatcatcacctactaataattactattctagcccatttaaaatcccatgcaagcatgccacatcttcactcactagcaattactagtctagcctattttaaatctcatacaagcatgacatatcatctataatattatattatagagatcaacaagtatgtgtcaaatcatcttcctcacattattttctcagcatttcatctttcatcatttcgacaatatttaacatatactcatccgtgaatcccgcagcaaagcacggggtatcacctagtataatagatgattctccgtgttttgcttggagaattattaagtaatctttaatatatttctttaaagagtaaacatgatattatttattaacaacaaataaaactgtttatcaagccatatttgaagataaataaatttaatatagattgcaaataaaatattaggctattggccaatataagcatcgcaataagcgaaatataggaaaaatgatgaaaagtatattagtaatactaatcataaaacaaactaaataatactccacgctttgatgcagaatatatggatgaatatatgttaagtattataaaagtgatgatagattcgttaaaatattatgaacatgatatgagaggtgatgattagatatgtttgcatgttaatttgtagaattcaataaattaagatgatattgcattcttgcatgagttttttgataaataattattactagtggatgataaattgatgatgtggtatatttacatattgagctttaaatttagtggcttgtaatttttataaaaggtatagataaatatggaagtttatgcactagtgaagacagattgtgccagcgaatgcaggttttcgatcataaaggtcctccaagaaaaaggtttttataaactcgattacctaaagattataattaagcttactcagcatatcaaaaggaagtacaatacgtgcttccaagaacactactacataaacgatttttctgtataagaatcctatagtttgcagagggaccgtatctggtcccatttaagaaaattgacttgcatttttgcagattttttttaagaattaatattattttaatggaaaatcgcaaaagtagaggccatccagggaaatcgcgaatttagaggcctgtcgaactggtgtagttcgataggcccctatcgaacggtgagcgttcgactggaccctgtcgatgtgcctatcgaacagagggagttcgacagggcccaccacccggcgccgcgcggcctgtcgaacagggagcgttcgataggtccctccaccgcccctatcgaacaatgggctttcgacaggcccttttaaaccgcgtgcgcctaggccgcgttgcttcttcgtttttctctagaccacatcgccagccgccgccgagagtcgccactgtgtcgctgtcggcgccggagggagtaaggggaggggctagcaggccggagaggaggcgccggccgggaggaaagggttggcgacggcctccaccagtgaagttaaggtatacattactaatccctaagtacgaggcatatgaaagtttaataaaaaatggcttgtgatttgttaattgtttcgcattgttcaatgttagtacatatgatttgttagcatttgtcattgctaaatattagtagagatatttaagtaatcgtatggttaaattagttgttagttaatacatgttattaatttgttgtgtgctaaaataggtagaaggtactatattttatttggattattaaagtagttgtttgtcaataatagttgtaagttagtacatggcaatgtagtataaattgtaatagggtaattatcgaaggcttaaatgattaaacgttagacaatttgtcatgttttatcaggatgtcaggtgaaatgcccattcgtctgtattacggtgatgctcctatacaaatatgtgatagcggggtggatttgactgtatatgacttccatgatactagtctgaatgcactcgagcatatgggtttgaacgacgtgttagggtggttgtataatatgtttgggggtagatccagtgctcgataaatttgtcttaaaagccgtgtgatcaataagggttcaacatggatggcagtggagagtagtggaggttgcatcaactgggagttggaggaagtttgttagtaaagtaagggagaaacggtatagcctagtaaagtaagggagaaacggtatagcctggcaatactaatgcagaagacaacatgtgttgatcgatcgggggagtcaagtcatgccatggtggaagaaactccattggaaggtgcacaagcgaaaaatgtttggcggattgagcaggtcgaggggaagaagtagtagagggtaatacacaagcagaggtcattgttcgtgacaataatcgtgaggccgacgactcggacgacgaagaaccggattcgcctatgcgtgttgacgtagcggaggagaatgaggcagtagtggatcagatggcagtggaaaatgaggaatacattgcacttgtagtggaaggagaagatacaacactgtgggacaacgaaaccaacatacccgatgattagatgaccatatcgatgagtcgtatgaatattaacgatggtttagatgcccactggtgttatgatagtaagcaggtgcaagttggacatatgtttcatgacaaaggtcacttacaagatgcggtgaagaggtggacatttgaccagaagcgtgagtttggggtgaaggtttcaactaggacgacgtacgacgtgaagtgcacacaggctggatatccttggagagtgcatggttacaagccacaacatgacaatttatgggtagcttcaagggttgagcaacatatgtgtttgttggagaatacccgtccggtacacaggaacatgactgcggcatttgtggcacaaatggatattcaaaggtggttagaaaaacatctttgtcccctttcacaataatacatgacatagagaaaaagtatggatatgagatatcgtacgacaaggcttggagggcaaaacaaaaagcactggaaatgaggtttggaacttatgaagattcttatcccaatcttcccccactattggaggtgatgcaggcaagaaacccgggcacacacatggctattctcgacgaggtgaatgaaaatggggagaatgttcttcgtcgggctttctggtcatttgggtgtatgatagaggccttcagaaattgcattcctttgctttgtgttgatggtactaggcaagtacagaggaacaattctaatcgcgatcggagtcgatgcggatagccatgtcgttgctgttgcttttgcatttgttgaaagcgagaacacatcaagctggctttggtttttgcggcacattaaattgtgtgttgttcgaaatagaccaaatgtttgtgttctgcatgaccgacacgccggttcaatatttttaatcaatgtgcaacttgttcaatactcttaataaatgtgcaactacttcaataattttaattgccttgcttattgtggaataggcggaatttgttgagcacgttcaagtagagttcgacaccctgttgcaaagactagagacgagacctccagtcgtcaggcctgacgatgtggcgagcgtccttcgcaacttccgtgcctgtgctgccgcactactttgtcgtgtctcctgcgggagcgcagcagatgtggtgcagctgtcggcctgtagggcatcaccaccactaccccgttgttccagcgtggatcacagtggtctatccacgttacgttgcgggtacgaagcagcccacacatctcacagtcgtccttcctttcagcacaccccagcactggagtacaccagggggtcagctggatcaggggtacccacatcgagcacggcacagccacgtccgcaggtattccaaactccgccttatgttcaccccacccagggagcatctgggttggcacacctcccttacatgccaacaggggacaacgtgttgaacacaccggcatggggacttcatgtcactccgcgtgcgctagatcaaggccacacacagcacacatgtaagtcattttaaacaataacacgctttagtttctaattatatgtatcattactaagtatgccatttttggtttctccctcttatgcaaacagatgatgagtactcccctcgcacagcattcattgaggacttcttttccactgagcctcctcaaggggaagcagggatggattattggcacgcagcacctcaggtcacacagccgacacaggagacaaaggccgttcaggcacccgaggtgacaccacagcagacagcaagagagaggcaccccccgatattttgacatatcccactgagcagattagacgtaggaagaagggggacctagcaagcgtgcgaagggaattgatcgcccttgacttatctatttgtattaaaatttgagacatttatgttttatccctactatttgtcaacactttattattaacttagttattatcattactgtttcataatctttttcagatgaattcattttttgcatacccttccaatgaatcaggacaaatgattcgcttcgaactttgcggcgcactataggacaggtgcataaatgcatgcacgtggtgtgctatctactttcggtgcacatgtccctttgtggtccaccccatttttcaactttatcaactgcagagttatgaaagcgaccatgcgagagctcgactagtcgtgatcacctttcagtatagactgctcgctcgtgcccgtcaagtctatccacacatcaaccctatcttcaccggtacgcttcctgcagttgttacggcactataaatacataccttgaccaaacaagagctcatcaagtcctttcctctttacatttcccattgtcttcagcatcaagttcaacacaatggaagctccattctgcgagcatttagactggcggagagatccactcgcaggtaggggtggaaacaagccgagacgagcctggcttggctcggctcgtgaaagcttggtgcaagggaagctcggcttggcttggctcgctacaaacaacgagctaaaactgcagctcggctcggctcatttatgggctcgagctggctcgcgagcctggcatcaagtaaatctcaagcaggtctaagagaaatggagcaacattttaccacatagaatgtgtaataaagtgatatttttctttaatatgtcatcacaacacataaatagataatatgacaatcaaaattattattttcaacaaataaatagttagaaaaggtgtaaaacttgtgcatatgacactattgtactgagccaagcgagctcacgagcggctcgtgagccggctcggccttggcttgtttcagaaacgagctaggaaggaggcttgggcttggctcgtttggctttcaagccgagccgaactatgtgagcccgagccaagcctgagccgagctcacgagcccaagctttttgtccacccctactcgcaggtctatttccaccatggtgccaccgtccaatcttgcccttggccgtgatcaatggtttacttcatgacatcacttactactgaaatccacggtaggagatttttccaatgcccaaacatttaccagggaactgttcaatccattgttatctctacatttgcacatgtttaatacatacatcgctaaccacatgtctacaatatctcgaattttcagacttaccatagtttatgcgacttcgttgagtgggttgatacgatgaatccacaacgtgacagggcacgcccatatccatgcagcgaaccattatcggactacctaaggaggaaggatgagtacgaacgatgaaaaactgccaaatccttacaatggcaagtaaatccactgggactccccacttgacgggagcgtccagagtgtaggtgtggagaccgttgccaggtgataaggtccgttcgacaacgaactctaggacagagatgcttcgtgtgtcctaacattgtcgacgatgattttgttgtaagtaccactaatttttcactcactctcattacttctgtcatatacctacatatgccaacggtcattaatttctgcacacaggaagaagaccgcaaatgtagctatgtaaagtggattgatacgacgataactcaacctaagacaaccacacaattcattcaagcgtggatggagtacgagcgccaggtttagtccgctagcttacactggagatcaaatccattaggtatacctgaatggtctgatcatcccaaatgcagttgtagagatcgctgccaggttgcaacgtccttctcacaagatacatatggcaggcggtacttcgtctgtcccaacatagacgacaacttcgttgtatgtcacatgcttaattattaatttacattttgcttcgcgttcccataacatttatttcccattatctaatttgattgattgttcaggggaatccaaggatgtgtgcttttacttcatggatcgacatggtcagcccgacgtatgaaggcggaagagtaactaaagctgaaacgcaaacataatataagagattgaaggatcacgaagttgcattacacacacaacgacgtagaaggggtcaatagagaagcttaacccctaatcgctctagttcggccttttgttatgttatgtttgtaacatacccaagcctgtaaacctgagaactaaatttaatttaaatgcatcatgtggttgtggagtggttttaattgtttttggatcttaatcatctcatcatatgcatcttgataggcctagagtcacaaaaacaattaatctggtaattatatgcatccaaaacttccacaaaaattctcaaaaaaaaaaaccttgatatgtcagaaatcaacccacaaattttcagagtttttcagtaaggtttgctaacttgttgatctcctttaatctctccaaaatcctgaaaagaactgcttagtagattcaaacttgctctctctgtaaaatttatttcaaaacctctttttgaagtttggtttcagccaaagtcttctactaactttcttctaacaccctgaggagtggcacaccctggatcactctctaaccctttcttctctccctccaaaaatccaatcagctgctaacttgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttccttttttttttccttcctttttctctattgggccgtcggcccagcccactccacccgtcgcccgcgctcggcctccccttgtgggccggcccgttctccttcctcctctctccgggacgctgacaggtggggcccacctgtcaggtcgtccccttcctccagccacccgcctctgacggcaaccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaataggatgggttcccggccacgaccgcctccccctccgcctataaatcgttccccgcgtcttcctctctcgttttttcgcactcgccgcgctctcccgtgccgtctaccgccctcgcgccgtcgcacccgagctccgccgctggccgccgccttcggccgcgagccgccgccgctagagtcgccgccgcgccaaaccgccgccgccgttagcttcgccgctacaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttcccctagggtgtcgccgccgcccgtccgtgcctccgcgtcgccggtcatcgccgctcgtctcttcccacgccggtcgccgccatcgcctcggtgaggaatcacctttcctccttcctttcctctcccccgtgagcgccgccgccctccgcgcgtgcgtcgtcgtcttcggctgccgccgccgccttcgcgccggtcgccgccgtctccccgcgccgccggtcaccgccggcggtcgtgcgccgtcgtcgcctcgccatggccggccggctcgagccgtgccaagccaacagccacgcccctctcccgccctgtgccgctgcccggtggggcccaccagccggtggaccacccctccctctccccttgtgccgctgccagtggggcccgcttgccagccgccccctctccctctcttagtgtcgctgaccagtggggcccgcatgtcggcgccgccccctcccctcgctgacgtcagccctggggcaataattgcgcaataattaattaaggacttttctttattagtaaaaacacagtttatcttctaaaaatcataagtaaatcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccacggtttctcgaagacgttgctgtgatctcatcagtgcgagagaaaggcaagtcatgcaatacgtttgatcatattgtacccaatttacaaatatcccgcatttctattaaatgtgcattcttttacaatatcatgtgggatgggtcctaatactcagccatttattgtttaccttatgccattgataacctgggtatcaaaatgactagatgttggttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccagttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggaggttggttgggcctgttgcaacgtggtgtagcgttggacagtgtttggttaatattgattaattactacagctgttttactgcttccaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacataactgcactgtcaactgctgctaaccaacactgtcaatacatgttcatcactccatcaaacctaaaccagagacttctaacccaatccacttcagcacatttactctccacatcacccctgaccaagaggatatctagcccagatttcttgctgcacaaaatccaccttgaatcccctccaaagatccttggcaggcaaccctctttgacagcctccaaggctattttcgaatttctttcactgacagtgggccccacaccctctgggacccacatgacagcctcccactctcccctcacagcatccaccgtcccccatgcccaatggatgcccaaggaacacaatgaaagcaccagcgacctctctctctctcactcccccactccactcttccttatatcccatgccaaagcaccagaagcaacagcacactccccacatcgcgttccaagtccaagaaaacacaccccacgcacagaatgcccagagctcggccgtcttacccggctccggcgacttagccgttgtcgccgtgcatccctggtgagttcctctctcttccctcctatggaatgtgacctacgcatcacgctgagctcacccgtaccccttttgccctaggaccaatctgtcgagcacgtggtgggcgtcaccgtcctcgccgccggccacccgaaccgccgacaccgctccggccgccgttcctcaccaccgaagcaacaccaagctccggtgagtttccgccggattcctcgtgcatgcaccctctgtggctcatctctaacacccccgtactctcgaagttgcagttcgcgccttgagttgacccggcgacgccgacgccggagttttaccgccgttggccaacaaccaccacctcctccgctccctggacctcgctgcctccgtttctctgcttggtgagcaccctggtaccatatgagagcacatgcactaaccctttgcactaaccaagcctctgcatacacatgcatgggcataccgagacacaccgccacttatcggaacttcctatggtttgtgatatgatgaaattgattaatgatatgtggtatgtgatgattttagcgggtagtctatccaatacaacggtgtcgtgcctcgtgaggtattccgggctgggttccttacggcgctaggttaaagcgtgggcccgctacctagtggcgctaccttgctagtagcgtgggtaaaacacacatcgtgctggtgcaaggctagacaataaacaatgtaacggttccgttatgacctctagatcacactcaatgtgtagagtgtggtgataccgacgggtatcggaaaaactagagcgatccatatcatgtgggcttaaaagttgtacaaactctgcagagtctaaaactaatcgattagccgtgctcacggtcatgagcggcatggtgaagtgtcatgagtataatttgtgattttgataaactcttgtgaacctggaaaatggttggaatgttttgtttgtgaacttgggtaaagttcggtgaatggtgatgagatgatggagagtggtgatgatctaccttgaggggtagatgtgtattatttattcattcacattacaagttttacttactctatactattgttataaaattccgttgcgaaacatgttgtgaactaaaattggcatttatgcaaattaacctatacacagcttatccttgaatatggccaacatgtagtatgctaggattgtttccgacttgccagtacattaatttgattaatgtactgatttcttgctttctattacttgtttatgctcggaccccgctgcaggtaatgactgtttggatgaggagtttgatgcagcttgtgatgttgcagatttctaggatggttctaactagggatttatcctagtcggtttgcctatgggcttttgggtagcacgcttaccgcatgaaccaatatttatggcttgtcaccaagtactacttagaaccttattaagattatttatgcttattgcttagaaccacttattatttggatatcatgcttgagatgatttatgtgagactatgttgcattcctgggcaactagtcccacatgaggatgggtttgaaatggttgagataaccggggaatatgcctttgttgagatcgagtctctggggtacgcttttggtcgccaccattgagtggttgacgggcgtatgacatagatgactagtgtggctattccaatggttgtgtcttctatttcatatctgatggcttagagcctatgtagtgcactcttcaagacatgtcggggtctgtgatgaggttggatggttaccgtatttatttgggctttatttgagaccccatccatctagatatttcgcgctgacatgccttggagcgttgcaccacctaggctttgggacgtcctcacaatgttgttgtatgcctcatgaatggattatgtttatctatgtgttagctaatgtttcattctctttttcatctattaagctcatttgtgcatccgctgcaatctcttcgatcccctcctattctttatccgtccttactaaataaattgcgacaaagccatgaaaccaaaaatatatacaaataatgaaactaaataatccaaatattttaaccaacaaataaatactacaatttcccataaaatatattaaataaacaaataaatactaatatttcccaccatacattatcaaaaccctaaaccctatacatgaaacattaaaataatctttccttccttacacataaaatattacaataatgaaacaaacaacatattattaaaaaaaaatgggcgagtggaccagtcgaacaaccgttgttcgacagcttagcctgtcgaactggtggtattcgacaggggcctgtcgcactgcccctgttcgacagcccaccctatcgaaatgcccctgttcgacaggccccgtcgaaatgccactgtttgacatgccctgttgaactgcagccgtttgatcgccttttcaatcacgcgccggccgttcgatatgtgccctatcgaactacacccgttcgacaggcccctatattcgcgatttcccccggttggccactacttttgcgattttccattaaaataatattagttctaaaaaaattccatttttgcatacggttgcttaaaacgttcgtatacaaaaattaattttcacaggcggacctcttaacatacccgcatgcaaaaatgagtccattttcacatacaggtctcttaaatagattttcacatgcgggctacatggagagcacttgggcccacacacttttccgcaccattttttctccttctcctctttctctgcaccacacctttttttctttctcttctctccacgccataactcctctcccactccctctcccttcccccccttctcttctccggcggccgaagcggtggtagctggagcgagtggtctgcggtgggctcgaatgggagactggcggaggagcggcgcatcgacggtggcagccttccccccacgcagatccatcggcgggctcgagtgggagaccagcggaggagcagcgcatcgacggcggcagccttcctcccacgcggatccggcagcgatggcccccctccctcatggatctagcggtcccctctctcacgtgtgtggcaggcagcaaggtggacgacgatgagcatgacaaaggtggtggtggcggcaacgacgacatcagcttggggctagggtttttgggtggtggcaggctagggtttcggctagtttggaccgcatgtgaagatgagatgttcgcatgtggttgcgctgcccacatgaaaaaaatactgttcacagacatctaggtgcatgcgggccacccaatctcatgcgaaaagtccgattgcaaaattgatttctgtactagtggtacgccacactctgttttgtttcatatcccatgaatttcagtgtatatatttttgcggaaaaattcaatgaattttttgagagaaaggttcaacttatatgatgatgaccctatcgaaatagacacgctactaaaagagaacgtgctggttaactcaaatggacgacgcactacagatggtcctgattcttttatatgttttccccattgaattcgatcggctggcgaagtgaggtcggttcggtgtggtggaggcctcatgctaccacttttggatagaggtaactgagatggtggatggtggataaggatcgtatcgggttcaggtgtaaccgtgtaagtctagactggcgaatcattgggccgatagtggtgatgcctatgggttaccataacccccggacgttgtcgaggtgcctccctcctgcttctcttgacataaatctctatgggcaaccatatctaggttcctatatgagcagcgacggtatatttggcctcataacctccatggagacattgtttttgaagactttgtcttgtggtgcggtgttggcattggcggtgattggccacgtatagcagcggtgaggttggtgctaggttccccgtcttacaggcttgtgttttgtgaggttagcacgtgctttctgggcgtacgctccggtgcacggacaacctcgacaggcttctattgttgtaattaaaaattttcttgtaatcttaataccattggatagtctcttcttatgccatcccagctaaaaaacatgaaattttaagcgaaattaatttgaatataatatttctagattgatatccttcttgaataattttgaatttgtttgtttttagattgatatccttatagaataattttgaatttgtttgtttttagattgatatctttctagaataattttgaattttacccaagttcatgggttaggcgcccggtttaattagggtgttggacaaacttttattcgaagtttgaaaagatattattactgttcataaatgctctcacatagggctattgcaaccacccactcgggagctagggaggaaaatggtctgaaacgatcgcaaaatagcctcaaccatttccataaccttatttttcttggaaacaaaatcaaatacggtaaagtcggaaacaaaaactatatcggaattattggaaaaccagaaacgaaacaatacatacggaaacatgtcggtgcagatcgtaaaccggtaacaaatacggaaacattaaactatgaaaacatatatttaactttacataagtatgttatatgtataaataaattcaaacttatactatataaattataaattaacttcattttaaccatgcactcaagttagggatttgattaaagagtccgtcaatctctaaattatgggtcaagtagagacatgccctataaatcatatttagaaatacggtaattaccatattataagaaacggtaatttccataagaatacgtaaatacagaaacgatcggtataacagcaaaaccatttccgtttccatatggctcgcccttaccggaaacaaacgtcggttggccgggaattaccattaccgttttcaccccccccccccacccccccggttttcacccctatcgggagtagttgtggttctctgaatgaatgaagcttcggttatattctgttagtcttaaaatatatcaatctcgattaaatataaattcagatttatagtatatttaatctatattgatatattcaaagatggagggactagttctgaaaaatacaccagtactgaaatgtgaactgaaaacacagactgtgaatgcagcctctttggacttatcatttgcagggttgcgtgcctttcggtcgctgccagagatagtatgtctgactgatgtcacattgtgtacgtaaaagcaatgcaacgaggacagacaaggactgcgccatcatgttgccactttcttgacacaacagaatgggaagctcattcaccgtacaatctctcataaaaagtcttattactaactgaactcatggcatgacattacagctacagaagactggtggcaactggcaactgaacatcaaacaagtccaactatcatatctactgatgaattgatctcaacttccattgcgcagcccagcgaaaagaaaaaaaaacttccattgcgcagtgaaatttcaggttaattagaaacaattagtagtgatcactcagttctgacaaaatccctttgctagagcagaagacacaactttcacaatgtaatcattttgatgattacatttctctttgcctctcaattcctgatgcaaggcactttccataattcttacaatttcccttacaattttgccataccacaggatcacataaagaaaatttgtttggcaaagagaactcgatgcttatgtttctagatgcagacaatgacatatgtttcacatccattcccatttttacctattctacatttctttttgccatccatcctaacatcctatgctaacatcaaggatagacaagcctcttagattcagaaggggagctgatattttgctgtttctgggctcctgccacccattctttgagccaatccaaacaccgaatccaagtgtctgcactcatcaaccatgtcctatgcataattttgccgccaaatgtactcctgagtcttatttctcaatgacatgtgttgttaattctggagttaggtctctttattacgcacaaaatcttcgtctctgtgtaaggagagtcaatgcaggaaaacagtgagatggaatatgcatatgatacgccaatccatg

SEQ ID NO: 82063 - DNA, 3967 bp, Oryza sativa
ggaactcattgttttcatccattgctgcagaaacagaaaaatgaaaaaagaagagcgagagagaaagcattcagttaccaagatatgaaagcctggtttcaaattcatatacaagttgacaacttaaatgattgaaagggttggaactgaagccaatgttacctgtagtattgtggttcgtctcttttacctgaagatcgctgtacgttgagtcagaaaagaggacagtctccagactagatgatgatgatgatggtactgatatagggagctacaaaaataaacgatagtttgaataatccatatggttccatagcttttaagaaatggaaacaatctgtacgcagatggcacgaatataacagaaagccagttatgattatcatctaagccttttttactaatatagcatatcctgtacgaacactcgtatctctaggcactggtagctttatgacagtgaggagggacctgacattcaaaagctgatttctagaattagtaaaattaagaattatattcgtggaaaaatcacagttaaggagcataggttagtaattgccaatcccagtgactgaccggtatgatttcctaacttcagtccatgttgttagagtatacagtttcataatttatattacaagcgttcgcaaaaaaataatttatattacaaaagaagatactggctttgaacaacttcaatacgttgcctcatgatgtccaaatatagctttgatggaacaaaggttatcttagtagtaacttttcatcagccctttaagtttgacaatgtggataatatgcaaagaacacgaaatcttctctgacagataacaatatgataatgtgaacctacgctgcccctatatccgtcggatacaacactggagcggagctgtcatggttaagcccctttggttggtccctaatgcatgtaagactagccacctcatttatcaaaacaggttcacattgttttatttctatgtttgttgtaacctacacaactaatcaaagcatttgcttctgaaaaacagaagaaatctgaatatctgatgacagaggatattgagaaaatattagcaagtatcaggaacagaaataattcatcaggcaatttataatggaaataaaaaaagttaatcaccatagatctagagccacaggacaaaaatgatggtggcagtacaccggtggtttctgcatcatattcatcctgtaaaaaactgacttcagcgattccaaagtttccccctgatacttcagaagtagagcaaactgcaaacgaataactaattaaaattgaacatgtaaatttgatggtgttgagaagaaaaaaatactgatatatctactaactaatgaatagtattaacatgataaactgtgtttgtgctgaacatgcccgtatctccaactgtttatgaaggggcagttctatgttctacatacataataaaactggaattatgaaaaaataaactgtagcacattcggccttgaaaaactacaatgcatttgcttgtattaaacttattttgtttctgaagcacacagtaattcaataaacttgatatttttttattcggtaagatctaatttttgtgctcagcagtcagcacaaaacaataaccaacaggatattctctaataatttcatttacagataagttctgtttgtaccttgcaataagtgttaagcaaacacagcataacagggctaaaattcttatttatgtgagtaaactgcatctgagagcataccagtgtattaaataaactcaaggtgttgtgttcaggtcggcattaaccctatgcactatataattcaagggataagtagccaggtatgcatctttcactggctatttctggtgtgctcacaatacaaactagttaaatcaacatcgccacacttcttgttttagtaacatggccagcacagaggattgatggactcatgcatcccaggaagcggatgcacttggagagtcactggtgctaaaagcatagaattaaaaacagcttttgcagtgcggcaggttcaggtgtatgctgagcagaaattcttcaaaatcagccagagcaaacaaaatcaagaatagtataaatacggactttaccattttgatgacttagaagtgttgaccccaccgctgttctatcgagtgcaatctcttgagactgtgagtcttccaatatttcggtggtcttgcaaaatgaatgaagctcctgcgtccctaaatagtcggtgcttaacattttattcatccttaatgcaggcatttgcaaaaagcatgttgaaagtactgcagttccagtaggaaaagtccaactgttgaaacatttgatatcactaaagacattagtggagaaaagtgaagctggtaaaatatctacagactaatgatctactggaagaacatactttacccatatgttctcaataaattagagccagccaccattttttttctccaaaatctaccactaaaataaaacactcactccagtgaattcaccaatcgaacaaccctttcaaaatctttaaaccctcctagcaagcaacaactttaacaccaactaaaatcccttccttgctttcccctcccttttttatactttcccatgaaacaaattttcgttcgaacttgtcaggacagtaattaagatcagaaactaagctacagcaggaacgcagcctacagaattccccaaacacatgccacatcccaaaagctcgctactccttttccaccgagcagcccgaaaaccttcacacaaacacaattcctctctatacctcggcccaaattttgagcttacaagtatttctcacgggtacaaaaagctcaaccacccaacaactagctgaaacatactcaagcagccaaacatgtaccaccctacacagagcgaagcatccccccagatcaaattacacaaaacccacaagaatcacagagagtcgagcccgagcaggaaatcgagctccggaaatcccccgtccaaagcagagctcgagcgacgcgaggagagagagagagaggaggcacgtacccgagatgcacccagctcctcgccgccgttccctcgcggagcacgatctctcctcccctctcgctcagcctcaagtctcgcacaaacgcacccactgggagagagaggaagatggagagggagagcacaggtaggggacagctcgatcgcttgctaatcccgtaccacatatactaatctacgcgaccggtccgcgtctgcggagtcaaggtctccccacacgttccaccgcggtcactgacgtgtgggcccaagaggatccggccccgcgagggcgtagcagcgggtagcagtttacgtagctttcgcatttttgcgggtgggttgcggctgctttgcctatcgcccaccattcgttccgctaacccgtccgtccccgcgtagcaagttgatcgctcactgacaggtgggtccgcgaacatgtggcccccggggtcagttggatgggttaatcggaggacggttggtgcggggcatcaggggccgaggtgtacacgtggacggcgaggatgggtagctcatcatgccaccagcggagtccacctgttaagtttaatattggcgattagtccccactttatctaatcgggctactaatcgtactcgtcgttctggttagtcactggcaaggttgggccggtagattccgggcccggctgtaagcgacgtcggatcggtgacgacctggaggccctgggaattcatggagttggtggggtacacgtggacggcgcttgatcttttgctcctcctttgcggctgcgtccactggctacccgacgcgtggaacgggaagccgggggccggagcgcgtgcggccatcgcgcgccaggtttgcggctctgcgcggagagagagggggagcagcggcgccggcgcggcgcgcacgtgcggcggagcaaagaaa

SEQ ID NO: 82064 - DNA, 885 bp, Oryza sativa
ctaggctccgtcgcagtacagcatctccaccaccgccaatcaccgaagcgcgccaccgctcatccgtgtccaccatcgatctttgccgccgctgcaagatgagatgatataagactgagggtaatctaaaaattctgaacgttcacaattgcattgggaattgcatccgaatatagaggattgattggcgtgagagagcgtacataccgtagcgggaacaccgatcctctccaactccggctgctcttcggggacgagccgccgccgccgccgccgagccagaggcggttagggtttggcaaagatgtcagatgggctattccgtctctctcggacaggccagattctctaaaggcataccctccttcctttcctgggcccgtttggcacgttacggctttctagttttggaggccgaataagttcacaataggtccctccatttatcgcattttcgtcctcaatccggaaaaccggatacaacacaattacaaaatcatgcaaacaatccagaaaaccagatacaacacatccttaacttacaaagccatgcaaatgagatccctcagtagtattgacccgggcttggctaatatggaacctacatagatcttttaacaaggttttcatcctatatagcattgacgtgacacttacgtgacaatttgatccagaaaaataaaaaaatcatgggcccacatattagttacacacacaaaacaataaaaacaatggtgaggcccatgtggcctcacatgtcatcctcgctactctctgcttctctctatcctctcttttccttgcaaggagaaggccagagcaagccaccagcggggtgggcgatgggcgggagcacagggcaacggcgagcgagctccttcgtcc

SEQ ID NO: 82065 - DNA, 3695 bp, Oryza sativa
agcccatgccgcatggggggctaatgcgcgatcgatcgatcgccagggctgatcgccctgcgatcggatcccaccccccgctcccctataggctactcccacttctcccctttctccccctttcttctctactactactacagtacaccacaaaaaagtttttaaaaaacaaaaaatttagaaaattttatgtataaaaattttgaattcaaattcaaatttgcatcgggtatgtaaacttttaacttataaattttggatctataaactttaggtgtataaactttagatgtatagaaatactatatatagaaaatatttgaattcaaattcaaatttgaatcggatataattcaaattcaaatttgaatcgggtatataaactttaggtccataaactttaggtgtacaaactttagatgtatagaaatactatatatgaaaaatatttgaattcaaattcaaatttgaatcagatattggaattcaaattcaaatttgaatcggatatataatctttaggtctataaagtttaggtgtatacactttatatgtatagaaatactatatataaaaaatatttaaattcaaattcaaatttgaatcggatatatatacttttgatttataaacttttggtctctaaactttatatgtgtaaacttgaggtgtataaactttaggtgcataaatttactaaaatagaaaagtaatacggtgccaaaaaaggaaaccaggtggagggagggggggtgggaaagggcgagtgaggatcgctcgcccgcccagtagcatttccgcatgccgcatggtggatgtgaaagaaatagaggaaatatatcccatgctactttgattttttttatgctgttactttggttttgaaatgcagggaggggatatgagatttgggggtgaagagtagatcagaaggttgcaagctccacgctatatgcaataggaaaaaaatacgaattacctcccgaactatcacggtcaacctaattacccctctaaaccataaaaccagacattttatacctcaaacttttcaaaccagacgaataaccccctagtggaatccagagtggttttgatcctacgtggcatacacgtggtggtctagtcagtgaaaaattaattaaaaataagtgggctccaccggtcagctcctctttctcttctcccacctcatttcccttccatctctatctctctctcgctctctccctctcacggaaagccaaaacagaggacgaggcggtggaccggtgtcacggcggcagtaggggcaacagggcgttgggggagatagcggcagcagcggcggcatgagtgaaggccgtcaggtcggggtggcgggcggcgacactgctgcatgcgtcccctgggttccatcgccgtactctttgcccagggagagtggacggcgccagtgcggtcgtcgaggccggatctcagccagtggggcagaaagagtgctagcgtggggctggaacgacctcgacggcgagggccctagaggtcgcgatcgaagctcgcgtgaaggcagcgatgagcccaccgccgtctcgagcttggtgagggcgttggaggcaacgaccagcagtggagctcaatgttgcttagggaggtcggcggagcaagaggttgcgtggaggcagctgcagtggcggcggagacggagctcgcgagaaggaagcgacgagcctgtcgcagtcttgagctccctcgaggacgagcggcgcaccggcagctacgagcctcctcgcggtggaggccgaggatgagacgcgcgccagcggtggccggcccatcaagctcaccattcaggccccgttatgatgcgcgccagtggcggccggcgtcggatttgcgcgagaaggtggcaatggtggggaatactatggtgggggagaggtgtggcacagtcgacgaccgtggaggcgagcccgttgaccagtgtgactacggatgcagatgccgacaccgacccggccgcgctagcgcggcggcgcgaggcggacggggaggaggcggaagataggcgaaagccggaggaggcggtagcagaggaggaggccgttctcgcattcgccgctcgccatttcctccgcccccagattctgtccctgcggcctcccgccgcagcgccgtgccttgccatagcctcccggccactcgccacactcgcctcgtccacctagccatgcctgccactgctcgccatcgaccggagcccaattcagagtgagcaatgtctggttttcgggtccaggggagtattcggtcgaccgagatagttcgtgggagggggtggggggtaatttatactttttcccatgcaataagcatatggattactaccaagtactctttcatttcttattatagatggcttgttaatttctatcatgacgtttgatcatttatattattctaaaatttataatgttctattattaaagaaactttaagtataacttatactttgcatatttacactattttttttaataaaacgaatgtctaaacattatttcaaaaatcaatgacgttatttattaaaaaacataggtaatatgttccctcacaatttccattctaattctttatgaaatctttccaacctccaaatttgactaggactcataatcctactaggatttcctcacatgacacttccagttcgttcttcaaaattttcagatttggactcttttcatgattgactaggacttctactaggattctcttacattcatatcttccggtctgttcttcaaacttttgaaatttcgactccctctaaatttgacttattttccatacacgcaccatactgaatccgaagaacattctcttccctctacgcccacacctctcccagtcccatccttatccagttatcctaaccttcaacactctaggtgggatctgtgagctcgccggaattcgttggaactagagaaggatgtggagcatatcaatcggtggagtgggtggagtaagattttttatcaaatgtatcatttagcaaattcgctttttattttacgcctacagtaacattttttccatgccacattctttttttaggaacggtttaatataagtgaatcataatagaggaatttacgccaaactaactagtactacaagaccactccacaagaaaacttctcatgcaaaaaaacgacagtatcctactcacactcgtcatacaaatgcaacgtttcccaatggccgatcgaatgctcgaattcaccaacacctgcctagtagtctccagtgatcgatccaatcagctgcagcgaggaggcagccgtagcttcatcgtcatgcccttctgaaccgcctcaagacaaggccgagcaggctgccgtacacgacgacgcagtagcctacgaagaacctctccccctgcgctatccccgccgccacctgcgacgccgtcctgctcctggccgccgcgtcccccgcagccggctccgccatcgtggccgccgaactctgaggtaccttcaggatctcctccttagtgccgccgccgccgccgcagcgggctgtgctggcgagctttcgccggctgcagttgtgctccgccgacgaccgggcgctccgagcgacgagccttgccacgctctgcatgatttgtttcctggcttcacgggtttgggttcggttgtgaatt

SEQ ID NO: 82066 - DNA, 1445 bp, Oryza sativa
ctgtcccgtggatgcgatcatctagtctaggcgaactcgagctcggtacccctactcctgtttggggatttgaatccgtcgggtgtagtatagatctgacgatcaggttgtctcatatgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctggtacatattccatagatataagttatcccctatgactagtcggataaccatgccgtatgggtatggggtacccataatatccacaacaagggaggacggcctcacctggcacgttcagcacggcctcgacgcggcggcggtggtggctaggtcacctcctccacactgtccaggtcgaagaacctagactcagcgttgtccacagggccggcgttgttgtcgtcatcctccgccgccttatcccttgcccgtgccgctgttgacgcaaaaaacacacactggcctgggagatctgcttagttccagtgcatatccaaaggacgatgagatgcgggtctgccagtcagtttgactctgcaactgacaaaatatacaaatagcatatcaatgagccgatcggctgacaagccgatggagtaattctagcccatgcctatgtcagccgatagcgatagggttttgagctatcgactatatatccaatgtagaatctgacacttgatgtaaacaacaatataaaggcaatcggttgatgataatataatatagcaataatatagtccagtagaaaccattcggctaataatgatatggtaaataagcatcgatccgaaggttaaagcatacatcggctggaggtccgatagcattaaatccacaagattagataatcagtaaaatctttgttgccatcggctaaatccaatatgtatgcaatccttgtaagctgatgcaacgtctagataactcattggctgaaaccccgatgaaacacttattggcagtcaaaaagcaggctagggattatggttttaaacacgacttagtagatcaaacttaacttatgcagcactaagtatgaatagaaacataatatctagacaatcaagcctttgactaatttttgggtggtagatgtcttagctaatctaatctagtaaaacaatttagccggtaccgacaggaaccctaaagcgagaaacaactgatagagctaaattgagatactaagactagattaactaagacatatgataaataggcagacaaatatatcatccaaaccggagcaatccaagaggtcgaacgtactgatgcagtcttgaacgacgccgacgtagactagacaattgccttgggccgccgaaacatgg

SEQ ID NO: 82067 - DNA, 11724 bp, Oryza sativa
ttcgaacgaatccgagggagagagagagggaaaagagggggaaacgggagagggaatcacgggggtgattttccccctctttaatgcgcgcggggacggcgggatgcggcggaatccgcggcggcggcggcgctagggcacgggcgagcggcggctgcggcgggaggaaggcgatgacaggtgggccccacccgtcagcgagagtggcgggcgggcccgcctgtcagcggcgcgcgcgcgggggaggagccgatgggccggagggagaggagagagagagggagggaagtgggccgagccggcccaagaaaggaagggggggaaagaagacttcttttagggtttttctttttataaatcctttttaactttgtttatttcttaacaattattatttgtgctctgaaaattccactaaaatttgagggctccttttagaccaaggagaatttgacaaaaattctccgggccacttttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtctcctcttcttgtctgacttcttccgctctggactgcttggctcgatctcctgttgcagatgaaatcttctcttcacccgacttgtcccgggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaagataccatgcttgtcatttgcttctaactcgccaccaactgcctcatattagctttcctggtctccgggtgatagctacttctgctattcgattcgagggtcgataactttgcctttgaattatgtttctcaacagagccaacttatcccacttgacatgctttgacgcctttccagatgactttactgctggacttgttattgtttgatcgttaccctgccaaatctgaagcttcgctgttacatgtgattttactctgacctctgtagactatcttcgaacatatcacttggttcataactgggaatagctcccacgaacaagcaactcggattcactttctttacatttggttcgcttcccactattctcttcatgttgtcatcatttagcattcaacctattcctttgcaccttccgcatggatgggttctttctcgatggatcgattgctagggaagtgcgttgagcgatactagtgcaagtgcttttattctagtagcatctgatacaaagcccaaggttgaaccgagctttagattccactgttcaggttttacttcttgacttcttggtcatgtcacaaaagtttccatccttgtcccccatagaagtacttctacctgtggtcatctctcttactcgtgaattcacctgctttaatgacagggcaactattgtagggttgtttgctatcgggagtcttcctcgagtgacacaaatcatggttctcgttatcttttatcaatcacctttcgacctttctcaaccaggtactcttcgctccgggtgttgaggatgtttctggggcaatgaggtgcttgggcgtgctgcctttccgtgaaaccttgatgtggttcgtcaaaaactgtactgactaccttcagggaaatacattgcttgctatctgtatccatgccactagggtttaattgccgatgatcacctttagtgcttcttcgagatgggaagcatccaaattgttcttctaccataccacctttgccccttttctgatacctgatagactaattaccaaccatcgactactatgtcctcaaatgtggatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggccttttaacccaactcagtttaattggttttcttttccatcaacaggttggttattaactcaaggttagaacatagttcctctgaaatgagaccctaggtctcctttatcagtaagcaattatacacataatcacatacccgcatcttccaaaagaatcctcatggaacttgtctgtattacacatttctccctcattacatgaatacgaggcactgccttaaacaaaaaagggacggtgcttaacatcggtacattgtatcctcaacatgaatcatccataagcatagcaaacccactgtttatagacatgaatatatttatgtattacatgattgctgcaaactttcgattacaccatgataagtagcggactgaaaaccacaaacatggctgctcattttgattctggagagatatagctggcattgttctagtgactgcatcatccttgattggttctgtgatgatgtgataggactgcatattgctatcattcacaggagaagcttccttctgattgctgtttgaagcggatgatggtcttctgcttggtatcgccctccggaggttgattgccctttgcttggcctggagtaggtcggggagagacacaacttcttccatcaacgacaattctttgctgaggctgtcggtgcagagaatggttgctatgatttattgcagagtcaggtgcagcaggaggagcattggtgcattgtttctgctatgggttctgattaacacgaggcctcacgggtacggcgtttgctccagtgaccacaatacgattggaatgtctgcttcgtgtaaattggcggtaatgtggaggtcgattttgccttggttgcaggcagtccctcgagtaatgccctggttctttgcaattgtagcaaatcaacgtcttctttgctgagctatccgtctgaggacgatcattctgacttggagttggagttggtggttggaaatccttgctaacattggcatcagtggtaccatagttgctatcaccattggagtctttctcagagtcaaaattgctagggttgtcattctgggtgccttcattgatactatcgtcgatatcttggtgaatgctgttgacattgcacgcttgatctaagtgatcatgaatggggcaagaaccatggtggttggtggtattatcagcattagtagtgctattgttgttgtctgcattgcgttcatcttcttggggcaggaactcttgatacacaacagaagatccggtgatctgaagtggctcagtgcgctgtctttggttaccacctggaaatactgggttgttgaccatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcgttcctgcgggaacatgtgatctcctgaatacagatgaaaactcgttccaggtaatggtatgtccttctggccgtgatgcttcgtagcgatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggttcagttttgagaaattctgataacttgcactgttgctggactgtaggcacttgaacgttggttgcccctgctgggttgttccaattctgtaatagttgaaaggctgttgccaacatgttggtttggttaaccactatttggattagctctggtgaggtttcgttgatgcttttctcattcccattggcttgggttcttgagtcatcggatccatcattcccatagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggtcacatcacaacccaccgatgcaaaccacgcgctacacacacaagcaaggaaacacacgactgacaacactatcctagaggacggcttaggttctgcgactggttcccaagatcttcattcttgcttcacatctggcttcactgcttcctttgctgcgctgacggatccaacagtcttccggagcttcggcaaacaactgacgacatcttcttcttcgcaaagctgaccatctagtactagttgaaatttgaagaaggaagaaaagagtaaaccttttgcaaataacattaggggaaggagaaaaagaggaactttcgcaaatagttttatttataaaatatgtccttaggttttatccacttggcttatcctacagtcgagatggctctgataccagcttgtcgcgaccggaaaaatttccttttcccgaacgctagtgtattaatccccgtcccaggaaaagccggggtacaccacacaaacatgataaaaaaggcacatctttattatatcgataatatttacattattacaaaggcgcttaaggcctgacaaacaaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcacaattaatgcaaaggagtacaaggggataataatataggggttaagttttgcagtaaacggcatttaaaggtcacttagttgcccaaagccattttacaaagacgatcttagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgtcgagcaaattttaagaatttgaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttatccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaaagatatgagaattcccaaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccgacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgggagagggggcgcgcggaccgggttaacgggaagtggggcccacgcgtcagcctctcggtccacggtggaccgggagcacgcggctggcggcggtcggcgccgtgggtcccacgcgtcagccgcacccgcgggcgcgggcggctgacggccgggcccacctggcagccgcggggcgcgcccgaaggcggcctcgccggcacggccgacgggagcggcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagtggagaaaggcggcggcgcggttcgggatgccgagggcgacggtgctccggcggtcggcgggcgaagcggagcggcggacggggtcgacggcgacgcggcgacgcggaaggaggtgacgccgagtcgggaggaggaccggagcgacgacggtggcgaaacggagctcggcggcgacggcggagagagaggtgcacgacgcgagcacgaatccgacggcgagagcgagcggcgagcggcggaaacggaagagcgaagcacgggggacgattttatagcgccgagagggagagagggcggccggggaggaaggaaaccggccgcggagttctcgggctccattgatgacgccggcgaggattgcgggcgcgattcgaacgaatccgagggagagagagagggaaaagagggggaaacgggagagggaatcacgggggtgattttccccctctttaatgcgcgcggggacggcgggatgcggcggaatccgcggcggcggcggcgctagggcacgggcgagcggcggctgcggcgggaggaaggcgatgacaggtgggccccacccgtcagcgagagtggcgggcgggcccgcctgtcagcggcgcgcgcgcgggggaggagccgatgggccggagggagaggagagagagagggagggaagtgggccgagccggcccaagaaaggaagggggggaaagaagacttcttttagggtttttctttttataaatcctttttaactttgtttatttcttaacaattattatttgtgctctgaaaattccactaaaatttgagggctccttttagaccaaggagaatttgacaaaaattctccaggccacttttgaatttttcttgtacgtattttagtgtttgccaatttcttttcgaattttaattaattctattattccttttagagaatgaattttaattttgggatgaatttatcaggacgtgacactcaggagggggaaacctccggcgttggtagcacggagggtgcgctgttgctcaccttccgtcctggcccgtcgcagcggtagacgagcagttagtaggcttgcgcgtgtgtttttcctcgtttgtcttcttgagtcgtgtggggcatggttatgccggtgtgtggcgtaattatgtcggagcctgtcttattttttatttgcctaagcaacttgaacattaatgaaccaatttaatagaagtaataaattcaagaattatagtagtcgagggtggttagttttaattgtcagctttctctgtttgccggttctgtgtggggttttcagatggtgacgaccaggagaaatgttaacaccggtgaaggcaaccaacccgaaggcagcaaccccaaccaccaaggcaatccacctccaccaccaccaccagacaccaatgccattctcacccaaatcctcgctcagcaggccaacatgatgaccgctttcctccaccacctccaaaatccgccacaacagaatgctccaccaccacctccccaacactctaaactcgccgagttcctccgcatccgcccacccaccttctctagctccaacaatcccgtggatgcgttggattggttgcatgccgtggggaagaagctggacactgtgcagtgcagtgatgaagagaaagtcatcttcgccgcccatcagctgcagggacccgcatctctatggtgggaccacttccaggctacgcagccagagggacagccgattacttgggctcgcttcaccgccgctttccggagaacccatgtgcccgccggagtcgtggctctcaagaagagggaattccgagagttgaagcaaggcaaccgctccgtgatggagtatttgcatgagttcaacaatctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaggccaagcacaaggagctggagtcgcacaagcgccgcttggcgaacttccgcaatcagcagggtgctaaccagagggtccgctacaccaatccctatccagggggatcctcctcgcagcagcaacaacagcagcagcaacctcgttccgcgcctcgacctcaattcgtggtgcgcgtcccacagccgcagcagcaacagaatcaacaagggactcgtgcgccccgtcctcctacgccagctgtgcagcccgttcaaggccgcagggacgctcaaggtcagcagcgtctatgcttcaactgcttcgagcccgggcactttgcggataaatgcccgaagccaaggcgtcagcaaggccaagcgcctccccgctccaacaacggagggaaggatgtcattcggggccgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggcggggttatgacagcaaagtattatagccctgccgttcctatagaaattcaggggattccttttccctcggatctgattctgctagacaccaagaacttggatgtgatccttgggatgaattggttggctcaattccaaggagtagtggattgcgcgagacgcacggtcactctgtaccgaggaccggaacaaccggttgtcttctttgcacccccaacctctgtcagaagttcagaactgcatcagataggactgtcagaaatccccatcgtcagggagttcggagatgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaaggaaaggggtatatacgtccgagtacttccccctggggtgcttctgtgatttttgtagagaagaaagacaagacgaagaggatgtgcgttgactacagagctctcaatgaagtcaccatcaaaaacaagtaccctcttcctcggatcgatgatctgttcgatcagcttaaaggtgccactgtattctccaagattgatcttcgttccgggtaccaccaattacgtatccgcgaggaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcaacaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcactgaatggaagcaacccaagacagtcacccaaatccgcagtttcttgggtttggcaggatattaccggagattcatcgagaacttctccaaaatcgctcgacccatgacacagttgttgaagaaagaagagaaatttgtgtggagcccgcaatgcgagaaggcgttccaaactctcaaggagaagctggtttcctcgccagtgttaatcttgccggatactcgcaaggatttcatggtgtactgtgatgcttcgcgccaaggattggggtgcgtgctcatgcaggacggtcatgtggtagcctatgcctcacgccaactacgacctcatgaaggcaactaccctacgcatgacttggagttagcagcggtggttcatgctctaaaaatctggcggcactatctcattgggaaccgctgtgaaatatataccgatcataagagcttgaaatacatcttcactcagtcggacctgaatcttcgacaaaggagatggttagaactcatcaaggattatgatgtgggaattcattatcatccgggtaaggctaacgtggttgcctgtcacgtcctgataaattcatcccgaattaaaaatcattcgctaaaaggaataatagaattaattaaaattcgaaaagaaattggcaaacactaaaatgcgtacaagaaaaattcgaatgtggcccggggaattttttgttaaattctccttggtctaaaaggagccctcaaattttacttgaatttttagagcaccggaaataattattaagcaacaaaaacaattatcaaagtttattaaaaagaaaaatctaaaaataatcctccttttcttttgggccaattttggcccaaagacctccctctctcccctcggcccgcggccaaagtctccctttcctccctctttttctctccctctccttctctccctccttctcttgggctcccctttccctcggcccagcttcctcctccctctctctcccgggctgcctctttcccccccccctcccctcccggcctgcccggcccaggccgcctccccctcctctcctcctgggccgcctctcggcccaagctgagccgcccctccctttcacgcacgtgcgttgcacgagcgct

SEQ ID NO: 82068 - DNA, 1195 bp, Oryza sativa
caccaagtaatcaaatactcaagcatcaaactactttcctcaatgagcgcaagtatgtaaatcccctccaatccattacacccacatatacaactaaaatattactacttcaaagggtaggttatcatggcaccaccattcgaaatggacccatcaagccttctttttcccattgcccattgcttccctatgttgcagaatggcatgcttcctttgttttctctcccagatgtagagcctctgttcatctgcagacaagaatacgagagggactcatcaaagtcgatcatgagtcctggaatcattctcacgagaagaggggaaaaatggtcagatggatactttctccgtagctatgctggatggatgctgacccacattgctttctttacctctacgcaaagatggcatgctcgattcatcacttattatctactatctcctgtacattgcagagcaaaggccgtgacagcgacgaagaaggctgggcgctggcgatggagcagattatgatggtcgctttgctggcagttattattcactcgactgctactttacatccatcacaaacatagtgatggtttactttttcttttttacctttgctttgctagaagatatctggaaggatggccattgcagcccatgttatgcagtacttgtgatgttgatgtaaggcattcatccagtgagtattgtggaaaaatgagagagatttgctattgtcacaggctcccagcatatggccaacaaatctgaaagagggcagtgcagagaaggcctgaatataagttgcttcattgtcctcagccttcaacagattatggccacagtgttaatattaccatatgcgaacggtatacggcagatagatgatagttggcgaattagatgaatataattattacataagaagattgcagttatctcgcaagcgattgcaagatagtactgcagtgagactcttttctcagcctgctgattgcaaattactcaacaaaaagagctttgttataattattattcttttgtacaaaagaatccacatgatccaagtgtataaacccctgatctctcctaaacatggtgttccccacggtacacatgtgcttcctttgtcatcgtcattgtagcagcactgtaccatttgctgcatctgctataagctgtaaaagtttgtgcgtctatgttcatt

SEQ ID NO: 82069 - DNA, 641 bp, Oryza sativa
  unsure (1)..(641): unsure at all n locations
aggcaaacagcaagaaaaggacttattttttcctggtttctcaatttcatatctcacaaaacggattgagtttgatcctaaattttacatggttctataacatcacctccctgaacttttatacggttgttttgaccacgtagatggtttccattattccatcccggtaaaacttaaaaccagaacatattgacagaaacagtctaatctcataaaaataaggaaatatgctattgagtagtgaatggcagtgtagtaagagggaggacgaatcgaatacaaaccggtgaggtgatgatctggggatcgtccctgctacgcctgaacaaatacacacacctatagtcatactgatctctcgctaacacggtgccgaagatgctgatagggtaacccacgtcagattcgacaaccttgattgaaatgatattcatggaggtctccaaatggcgataatcagaggaagtgagcgagtgaatcggtggcccaagcccagccttagcttgtaaatcagagacatgagacttcaatcagacaaaagaatatgtatgggttttacacacttnaaataatccaatcaccaatgtgatgaatggatagagaggccgcatacgaatggttagtgnattagatcatattca

SEQ ID NO: 82070 - DNA, 5477 bp, Oryza sativa
ctacacccaccgaacccatggataccccctgagccccccttcaattttttttaccaaggttgataaaatagggggtgttaatagcattttagtatagtttaatactgatattatgtgtttataccggtgtactcgatatgtttagtctctcaactttttattgctggatccgcccatgcctccatagaaagtgcaacgtacgttttgatcgatggagaggcaaattttgagacgtactggttcgtactgatcatccacgcctctccggctatggttcgtcctcgtcggcgaggcgtcgccgtcgcatgcatgcgtgcgttcgtgcctccacgcggtagctataggaggtggagtaggccggtttgatgcggtagagcgctggagaaagataaaaaggattttcgcagatggccaaaattgctctgtgcaggtggacacaagcgtcgtctacaagtagagatttacgaaaatcatcgattttcacacgaggttttcgcaggtagacggtcggtccgtctggaaagatggattttcacgggccgatgtttgagggcaaaaatttgactcatatgtttggtgaaatggacatatcagtttataaaaattgtttatctagtagttgtcgaagtaatccatggcgccatcggctatttgctgctctagttatccactaagcgcttgattccgagtttgttggatcatggcgcatgtatagctcagacgcatgctgtgttcatgcgggagtttgtttcttttttccgttttcttgggagtgcgtgtgccctgcatgttcttcgatcgtaggatggcgcgatcacctcgggagacatggctagggcgccgggttagtaggaacgcatggtgcacacctcggtcgtgggatggcacgatccagtcagaggtgggagacgtgtgtatgtttgttatttaagttccctaatgcatctgaaaatcgttgccaagttcatcacaacacaaaacctcgctttctcgcttgctctgttttgatcggcatttcatcgaacaccttcgggagtttgccaacaactggtatcagagcctcgttggctcgctggtgccatggcggagcgttcactgccacatcattctcgcacacctccgcacgtttcgacgccaccaggctcgcgctctcctctttctcgcccattgtgtaccccgccacgccgttgtcctgctaagtccccgccgcgccgtgggcgcgggcgtggcgagcgacagcccttggctgctcagccgcgggtcgtcagggagtcgagcgttgccgttcactactcggttctgacgaggaccaactacgaggaaagggcgctcctcatgaccgtgaatttgcatgctcaggggctctggcatgccatggaaccgtacgaagacgaggagaccgagtaccgcgatgatcggctggtgctggccgtgatcctgcgtgcggtgccggcggagatgctccgcttcctctccaccaagcgcacggcgtagtctgcgtgggaggggatcaagacagtctgcgtcggcactcggcgcgtgcgtgaggcgaatgagcagctacttcgccaggagtttgccgatgcacggttcaaggatgacgagaacattgacgacttctccatgcgcctcaccggaatcacaaacagcattcgcactctcggaggcgatctccccgaggtagatgttgtcaacaagctgctaaacgttgtccctaagcatctctcacagatagccatctcgatcgagacgctcctcgacatcagcgacctgtccatagaggaggtcaccggccgactccgcgccgccgagaaacgcaaggccaagccaaaggagatcgtcgacagcggcggccatctcatgctcacagaggagcagtggctggcacggctcaagcaccgcgagcagagtggtgagagcagcggcactgcacccggcgcggccacgaacaacggcggcaagaaacgcgggaatcggcgcggttgcgtgcgcggccaggaacaccctggcgacaagtgtcgcaattgcggcaaaatgggccactaggccaaggattaccgctcaaaggccaagaaggctgaggcccacattgtagcggaggacgacgacgagccgacgctgctcatggcgcgcacgtgtctggttgagcggcgacgctcgccagccgaacccgcaccggaaatcacaacggtgttcctggaggaggcaaaggtgctggcgcatctcgatgacgaccctgatcccactaatctcgatgacgaccctgatcccgctgatttgtggtacctttacaccggcgccacgaaccacatgaccggagtccgctccgtcttctccgagctcgacacggcggtgaccggcttcgtcaagttcggtgacggctctgtcgtcacgatcgcaggctgcagcacgatcctcttcacctacaagaacggcgaacatcgcaggctgactggggtctacttcatcccacgcctcaccgccaacctcatcagcgtcggccagctcaacaagaacgactgcgagtccctagtgcacgacggcttcatgcgcatccgcgaccaggatcggcggttgctggcgaggatcccacgctcaaggaatcggcatcgtgccatcacacgaccgaggtgtgcgccatgcgttcctactaacccggcgccccagccatgtctcctgaggtgattgcgccatcccacgatcaaagaacatgcagggcacacgcactccctagaaaacaaaaaaacgaaacaaactccctcatgaacacaacatgcgtcagagctatacatgcgccatgagaccatgatccaacaaactcagaatcaagcgcttagtggataactagagcagcaaatagccgatggcgccatggattacttcgacattctcccccctaattcttgccgccgtcgccactgagctcagcaatgccaataccgttgcatagctcctggaatcaaacacggctgagtggcttcgtcagtacgtccttcagttgctcctccgtgcgaacgtagttgatgacgatcttcccgttctccacgcactcccggatgaaatggtatcgagtgtcaatgtgcttgctccggtcatggaaaacggggttcttggtcattgcaatgctggacttgttgtccaccttgatctccggcgctccgatctctgagtcgagcaagtcactcaagagtcgagcaagccagacagcttggcaggcggcggccgtggtagcgatgtactctgcctcgcacgatgacagcgccaccaccttctgtttcgtcgattgccaagtgatcagacttgttgtgaggaagaagagaatgccgctcgtgctccggcgtgtgtccagatcaccggccatgtcgctgtcgctgaagccatgcagcttcagcaatcctccttttcccctggcgtagtgcgcaccatggtgtcgtgttctggcaatataccgcaacacatgcttcaccgccgctagatgatcctcgtgtggctcctccatgaaccggctaaggtagccggcggcgtgagcaatgtccgggctcgtgttcaccagataacgcagcccaccgatggtgctgtagtagctcgtcaagttcaccggcggacttgaactagctttactcaatttttttgaggcagagtacatcgccgccacggccgccgcctaccaagctgtctggctctcttgactcttgagtgacttgctcgactcggagatcggagcgccggagatcaatgtggacaacaagtccatcattgcaatgaccaagaaccccgttttccatgaccggagcaagcacattgacacccgataccatttcatccgggagtgcgtggagaacgggaatatcgtcatcaactacgttcgcacggaggagcagctgacggacatactgacgaagccactcggccgtgtttgattccaggagctgtgcaacggtatcgacattgctgagctcagtggcgatggcggcaagaattaggggggagaatgtcgaagtaatccatggcgccatcggctatttgttgctctagttatccactaagcggttgattccgagtttgttggatcatggcgcatgtatagctctgacgcatgctgtgttcatgcgggagtttgtttcgtttttccgttttctagggagtgtgtgtgccctgcatgttcttcgatcgtgggatggtgcgatcacctcgggagatatggctggggtgcctggttagtaggaacgcatggcgcacacctcagtcttgggatgccacgatctagtcagaggtgggagacgtgtgtatgtttgttatttaagttccctaatgcatcagaaaatcgctgccaagttcattgcaacataaaacctcgctttctcgcttgctctgttttctcgcttgctctgttttgatcggcatttcgtcgaaccccttcggaagttcgccaacagtagtgatatatgagatgtgtagtgcattccacgagatccatatgtgcattttatcacgagatcgacgaccacgcggcggccgggggccttggctcgatctcgccgtcgtcgtccactccgagaacgaccgaatgattgcgtccgtcctgctcagctcgcgctccaatcttcttttgtctcagctttgtctggcccttcttttttttttcttttgcctttttgaactgatgtttgtcttactcttaaccctctgcatgcgctaggcgattatacgattgatccatccaaattatgcaacagatcacagcaatgtaactagaaaggttttaagcgcgctcaaataaaggtgtaaggttgtgtaatggattaaccattcgtgtttgtctataagtgggttggtgagtcagcccatttacacctctatacttaaatctaattgtatgacacgtatatttgttataaaaaaatattttcaatcattacaataacattgaaattatattgcgcgagtggccgtctagggttattgggtggtggctccgttattgcaaacaccaaacagagatgtatatatttagaagaagctttattttcaagttggatgaactatttttaactctcaagagctcatgtccttatatctttttcccatagtccaagcagtcataaataaatatgaaaaagaattgatgtgtcttaatatgagtattaacaagaatttttttgccagaaaaaaaatgtattacctattaactaaatttagccaagtcatttaaaaaaaataatagtttttgaatttctcttatgtatgctttgattataaccgtctacaccataagtcctaagaagaataccctaagtcctaagaagaaaaaaaaatgtattacctattaactaaatttagccaatcatttaaaaaaaataatagtttttgaatttctcttatgtatgctttgattataaccgtctacaccataagtcctaagaagaataccctaagtcctaagaagaataaactttcgttcccagaagttagttttt

SEQ ID NO: 82071 - DNA, 2215 bp, Oryza sativa
  unsure (1)..(2215): unsure at all n locations
acttttgtttatgactagactgagccacaaactaagccttacccactagacatgtgaaagtacggtagtgctttgcaacagaggcccgaagaccggtccttatatggccgaggtgctaccatcaaaaccatgcaccccgaacccagcctaaaaccatttttggggattttgaatggagggggcggtgtgaagccaattccacaatgatccaacaattccacagtgtccaggtgatatgaatatttcccaaagtctatagttgtaaaccacctaatgttacctaattaaattgcgaagcatctatctaaatttaaactagggatactacgagtagagtgtccactagttgaggttttgtttaatctagggtgaacaaggtaataataataacaataacaataataatatggtcacaacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaggcttttactctaataaattccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgggtttattgcgtcagccgagggagagggcgcgcggaccgggtccacgggagtggggcccacgcgtcagcctctcggtccacggtggaccgggagcacgcggctggcggcggccggcgccgtgggtcccatgcgtcagccgcacccgcgggcgcgggcggctgacgcccgggcccacctggcagccgcggggcgcgcccaaagggggcctcgccggcacggtcgacgggagacggcgcgcccgcgccccgatggtcaccgccggcgaccaccagcgcgtcggatcggcgcccgagagagaggagggaagggggaagcgaacggagcggtccacggctcaccccggtcgacggcgacgacgggaacggcggccgaaacgcaggaaggcgtcggcgcggctcggtacgacgaggacgacggcgctccgacagtcggcgggcgaaacggaggcgcggacgaggtcgacggggacgcggcgaagccgaagaaggtgacgccgagtcgggaggaggtccggagcgacgacggcggcgaaccgaagctcggcggcgacggcggagagaatatgcgacggcgcgagcgcgattccgacggggagagcgagtggcgaacgtcggaaacggaggaggagggcacgggagtggcttaattagggttgggagtcagggaaggcggccggggtgttggtaaccggcgcggaggttccggccgccattgattgcgccggcgtggtttgcggttacgattccgggcgtttttgagggagagtgagagggacaatcggggggatagatagagggattcgtggggtttatttcccccttctttattgcgcgcggggccgccgggagacgccgagtttcgcgtcggcggcggcgctagggccggggcgaccggcgggcccggcgcgagttgggggttgccagttgggccccccccgtcagcgggggtgttggccgggcccgcttgttagcggcgcgcgcgcgggggggacccgttgggccgcgggggaaagtagatagagagaggaagggagaggtttggcccgagccggcccaggagggggtggggggccgggggtcttcttttggggtttttttctttttttngcccttttcccctttgtttttttcttttcgnttnttntttgtgctctgccccttcccttgnnttcccctccgcttttggcttttggttttgcggggtctcctgcgtttttggttttgggttctctgcccgccgcggngcggtttgtttgggtgttnntggagtgtcatcatcccgtgggggggggaggagaaagtgttatccctctccgccccgtggtctagtctcgactatttgtatggagtcgattattttctggattcggtgtcaggtttgcg

SEQ ID NO: 82072 - DNA, 6322 bp, Oryza sativa
  unsure (1)..(6322): unsure at all n locations
ctctctctcaatgatggtaatattcaatgaagacctactagccttgcccaccctttatttgttaaggttggggaagggaagaaatgtatcctacattttctttgtttatgcattaaatgtgttgctttcattggtaggatgtgagctaacaaaggaaaatcaaccttttgacagattttctagtctttacacacttagcttagataaatggcattaccaaaaatcggagtcgccaaacgaacaagatttgccaaccaaccaagatttgccaaccaacatattctttagacaactacacaaagttgtctataacacgtaatctacacaatcacaatatgccccaaaggggtatggacagataagcaatcagagtcatagcccagaactagcaattccaacatagttggatgttggaatatttagcagcatatgctgcaaattttgaaggatatgtgatgggtgaaaacaatcaccatgataattgtttacaatctttctcatcattttggtacatggttatcatagacctctaatccatatcaagttgtaagggataattgttccacctatggatattgcatttagtataagtgttgtatatggctctatgttctattagtgaaccatattaactttttattctcgttagtgtccatgtgacgaggactgacaaggtcagctcaaggccgaggatgttactccgtaggtcgagacatcaagtggccaagacaaatcatgatccgtgtgttctcattctttgttcctttagctgattgcagtgacacgatctatagtagatgtgattgctacctccaaatttatctatgttattcactcataaattaagaggtaatatatacaatgtcacccctaatacacaaataccaatacctataatactcccatatccttcttggagtttgtgtggaggctacctcttgatttaggagtgactcatcatctctcttctccacctcatcacccaattctatgtgtcacttttaagggtaacatatgaagcattatagcacttaccctaaccacatgtacacaccactgtttgtggagccaatgattgacttcccccataccaaaaaacaattgtttatgatagaggctgaatgagcaggacctacaattttatgggcaatagtagaaatctaattattgaccatccttgaaaataaattaaagctatagttcgagagacaaatttatctgtttgatagaagtggcattcttaatcttggaaatccaactaatgataccttaattgattattttaatgtcaagagtccatttatataaattatgaatctggaaatggttcctaataccccataggttgagtagtagaagtaaaaatatgcccaaggagagggtctcctctgattagctaagcttgttgcagcttaccaaaacgatgatcaatagcgggtccaataggatgaccaacaacgctagggctgagttctttctccaactttccaactcacctccctcacattccgcgcacatgcttttcaaactgctaaacggtgtgtgttttgtaaaaagtttctatatgaaagttgcttaaaaaatcatattgatccatttttgaaaataaaattacctaatactgaattaatcacatgctaatggaccgctcaatttttcgtgcgctagaaatgtattcccaacacacaacaacgaacccagcctaggactatgatacaatagaatcctgcatactctctctatcaaaaaaaataaatttagaattggatgtgacatattctactctgtccagatggaataaaaacaaatctaggtttttttacagtgacagattaattccatgtgcaggtgaaaggtctacacaggtagtcaacttcttttgtctttatcgttgaaaaatcaattatgagagaagcctgaaccattaaaatggggttgcgggagagcacaaggcattacaatttacaagccttgtgctgctaggtaaaacagcagagtaccccatttttcgtatggctaaggctgagtttaatgagaaggtgaaagagatgatcgggaagatacgcaaaacgaacgatatgagctattagtatatgattaattaagtattaattattttaaatttcaaaaatagattaatatgatttttttaaagcaacttttctatagaaatttttttacaaaaaacataccgtttagtagttcgggaagcgtgcacgtcagaaaacgagagaaatcttctataaaatcagtcttcatcacactctcagtgagaagcctgtttttgacaatttatgactcctgtattgtgtgcagtatatatgtatctttattatgcctatgtatgttggttgattttgtcgacttgtgtcgataagggttaggagaggatctaaaccaccggtttccttatcctaacaagaaacaaactaagagataaattcgttttttgtgtgatcggtacagaaaacagaatcctaaactaattgagataacccccgagcctcaccaatgtcgcctatataaagaaagagaaggaaggagacagacgaccaaactctctctctctctaatctcaaaccctaattaatcgcccgatcgatctaggcactggaaggggttcgtgaggcatctctgcaagaagaagaaagaagaacggcaatggcttctaactcaggtaagtagatcaattatttttccgcataagcaagaggtgattgtttatagactaaagcttaagatcatgtaattagaactccaacattgtggtatcagagcctaatttttagtccactcaatccctcataatcacatcatccctgtgattagaagccatccttataaaaatacaagattgattcggcatgagcaattttgaattagattggattaatttctttaagtattaagcccttttatactggtggtttcggccatcagtaggagaagcaaattattgaagaagctgtttaattcaagttttcgattttgattatccatcagtggagattaagagaagaaaagggattgggataaacatattgaaactcccaatttcctcgcactcagaaccctaagccgaagctaagaaggggataaactagattgaaattcccctaaatttagcaaagggaaattcccaattcccgcactcaaaattcctagaccgaaactaaggtttcggctagtactcagcaaacaagaattaggggataaacaagattgaaactccccacggttaatcatatgggaataaacaagattgaaatttcccgaaatccccataagccggatccaatcggcctaaaatccccaaatgaagaaccctaattctttggggaagaaccctaagtcacaaagtccgaattaaatccaaatggaagaaaattaggctcgggtttggtgacataccggattttgaagccccctaaaccggaagcagcatcgccgccacttcacctccttgcggccgcgtcggtcttcccgtgcgcgcgccgtcttggagtgtccctccaccgtccctcgccagggacgggaagcgccggcttggcggctgccttcggactccgccccctcccctccccgccgacgagctccggccgcgtcgacgttcaccgtcgcctccgcgccgcctcgccggatgtaacatcccggcctagggcttaataggattaatagaatactcatatcaacaagttgcaacttcttttccggaagctttttccggaagccaatctccgaagaactccagggttaagcgtgcttggcctggagcaatttgggatgggtgaccgaccgggaaattctttccgggtgcacacgagtgaggacaaagtgtgcagaaaagatatgtgttggtctgtgagggcagtctatgacctatgaaagctatcagatgtaagcgggcccggcctgggggaaggcgggacgttacaaaatggtatcagagccgactctcgcggtttcacggatatgtgttggtctgtgagggcagtctatgacctatgaaagctatcagatgtaagcgggtccggcctggggggaggcgggacgttacaaaatggtatcagagccgactctcgcggtttcacgggcgcgtgtcgcaattgcgcaggcatggtgcgcatggctggtgtagaccgggagtggttacatagcatggcacatgcgttggcactggacacatggacgtgaccaagagaggacgttcctggcctggggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacacgagtgaggacaaagtgtgcagaaaagatatgtgttgccctgtgagggcagtctatgacctatgaaagctatcagatgtaagcggtcccggcctgggggaaggcgggacaccttgtcacgcccagaaattcccgaatagaattccaagtcttacaaacatcataaaagtctttacataaatgcagcggaaagaaagaaagacaacaggagctaagccttgactagaactgcagcgggaaagaaagaaagacaacaggagctaagccttgactagaactgcagcgggaacaccactccacaggcatcctcgacggcacggacgaagcctactcctcggagaaaccttcatccgacatatactcgcactctgggggttgggaaaagtagagcaagactgagtactacccactgtactcagcaagtcatgccggaatagaggcatgatgcagggaatcatcaaagaagagctaaagtggttcatttgcataaagcgagcatttaagaacagagcatgatgcagggaatcatcaaagaagagctaaagtggttcatttgcataaagcgagcatttaagaacagaagttgaaagatttaaacagttgtaataattaattacaactgtacccacaagacacagccccacaacacgtttccgtgcgccgacatgccaccacgacataccggaaagaggctgtgacaggaccattcgcataaccccctctaaccaagcacaccacacctcaggtttcacccccactcctcgcaaggcaacgggcagtcccctctcgtgcctaggtgaatccggaagccgcataggccgtcgcagggcccatccaaactccatcacgcccacccttgcctggatgcgtcggctagaggaaagctacgttacaagcccagccgttgcccacgctggcttgtggtaagtacgataagttcttccagggcatcccgcgaaccggtccttaactgccatgggtgcgaccagcaaaaccatgcacccacggcccaccatgtgatttattttaattaaccaacaccaaagcggtgttactaaaccaacaaaaccattagaaccaacagtctaaacattaatatgattttccccattgtgaactagttgaactaagcatggctaagcaattcctagtccaaactctaatcaggttataaccccaagttgacaaagaaacatggtacaacaatagcatggctatgacaataggtaaacatcccatagtaacattataaaacgatgcagtatttgaaggaaaacaatagagcatttgcaatataggatcaacatgttcaagtgacaagcatgacttgccttgctctgctgctggaggaacctcggcgactatttcgaagtacaccggagcgtcggaggaaccggaatcggaggggacggcggcgtccggcgacggggagcgacggagggaggtcgacacgcggcggacggcgaccgggacgaccgtcgcacgatgggaatggcgctccggcggcggacctcgacgaaggaggggtggacggggtggatctcggccacgcgaacccgacggcggcgacagcgcggtgcggcgacgagcctagcggcggctagtggcggccggagtatcggaaacggcggcggcgggtggttgcacggcgcggaagcgatgggaggctcgggagagttcggcgaaatggggaaaaagcgagagagggcgacggagaagcttaaatagggaaggggagggcccgacgtggcccggagaggcgggattccaccggccaacgtnagggagtgggggaagagaaaaaggtntntnnttcaaattacnttaattataatggtgttataaattaatatcttatttaaaaaaaatgttttattaggaaagaccatttagat

SEQ ID NO: 82073 - DNA, 21453 bp, Oryza sativa
taattcgctccgagctcaatcgtctcttctcttctccgattgtttctccattttatcaatttcaacaaaatcaagggaacagcaaggctaattaagctaaaaacacactgatcgatttcccactagatcatgccgtcagagttcgcggagagcagcctcgccggctgccgcctgctcctggtagtagggcagcacggtgtacacggtctgcaagacggtgaggacgaggagcacgaaggcgacgacgagcgagacgatcgcccacgggttgccggcgtggttgcggacgaggctggcgcgccactggttccaccgcttctccctgtacgcgttcacctccccgtgcacgccgtgcagcgcgctccgccggtccagctccgcctcgctcgccagccggttgaacatctccgccaccgcctcgtcgctgcccagcccgttggacaccacgccgctcgcgcccagcagccgcgcgtcgtcgccggacttgatcacgttgtccatgaagaacacgtacgccgtcacctcgttggcgccggcgccgtgcagctgctcgaatgccatcaggctgaacagcttgtgctccgtcgtgtcgtccacggcgaggcgcgggatgcggagcgcgccgtggcggaagctgatgtcgtggaggctgcgcgtccggctgggacggaaccggacgcccgcctggtcgagctccgtcgccgacggcacgaactcctctcgcctccccgtatggcacggccttggcggcgagccatggagcaggctccggtggcagacgtcgagcgggtggagcgccaggccgccgccgcctctcatcgccggcgggtcagggatcatcgacacgaagctgagcaccatgttgttgatcgcgtcgtcgctctgcaaccaaacgccggcgagttaatcagcaactaatcgaacactcgagttgatcagagcagcagcataccacgacgcacgcaccgcttcaggggcggcgccgccgtggacgaaggcgacgatccgctggagcacgaggagcggcagctggttctcgatcatgagcatgtcgcggcggacgtacgggaacacgtacagctcgccgtggcggctgaacacggggtcgttcgccgcgtagcctccgcccacgccctcgccgtcaccgtcgccctgcgccgcctcggccgccgcgcgcatcacctcgagcaggaagcacccatccaagaccatcatcttcaagaacccgtcgcggtcgtccctccacttggtggcgcccagcccctggtacgcgtcctgcagctccaccaccacctcctccatcgacgccacgaggctacccagccgcagccgccgcccatcgccgccgccgccgccgcggcggagcaggtgcaggagcgccctctccttgtgctcctcggccggccggagctcggggacgccgtggtggaaggggccgagcgacaccagctgcggtgcgccgtaggaggtgcgatgcttgatgtacgccggcacgcggtacaccgactgcctccgccaccgcctcgcctcctcctccgatgggttgccgccggcgtcgagcaggtgctcgacgtgggacacccattggctcgtcgtcttcaccctctgctgctcctcgccttccatttggtgagatttcttgatgttgcttgtcgcgtcaaaggttgggggaaattttgagtaataatatactactactctaaatcccccgcaaaaaaaaaaatatactactctaaatcgagattacagagcaaacaatattttttaggcaccgtccagccattgctactgccataacgtggtctactttgtcactcgaacaacaaaaaattcatttactttcggcaatgttcgacaagtcaaaatttaaaaggggcttaatgacttgttaatacatacggtcattgtgtatgtgagaaagtacaacattacatcgctgtcctcgtatctacagggaagtggccatttgggtccactcccatgcaatgttttcactttcgttttccaccgaaattttgaaattttggaactattctttttgcacgagtcacttatactttcatcatccccctcttcaactcaattaggtacaaaggaccccccacaagtccactactcaatttttcttctaacttcctccccacacatccagttttcactcattacttttctcgtttgctcaatttctcatgacccgtgtgagcctccacaccgtggtggtatcatgggaaccatagaacaaggatgcagcatgacgctcgctccctggggcagttatctatcagccatgattccaatttcgaacagcacaacaacaacctggtccaacatgtttcaggccctgaagactccaaagtccaaagcagcaaactgatactcctgtaccatgtaagagagttccatctctcatggcagacgttcgagagggtggagcgctaggccgctgctgccgctcatcgctggtgggtcagggatcattgacacgaagctcagtaccatcactactacaaaacatcaaatagataccgctattacagatgctagagtaggtaaaaccggtacctatagctcctttccctatccatgcgtctatcaacccgccaaaatccaaagaatcagcacctttatcctcaaataggtgccagtttttaaaaagaaccggcacctattactggtgtcagagaaagatgccggtttttattgaaaatccggcaccttttagtatccatcccatcggaatagtaggcgtagggcccacctaagaaccggcatctttgtggttaaagaaataggtgccggttttttttaaaaaaaccgacaccgaggcgagccacacggggagcccccacattcttatccatccatcagagtcaactgactcgtatctctctctctctctcacgcgcgcgcgtctcttcgcctctctcgaactctctctcttttttgcgcctcctctctcaccttctcctccccggcggctgagggaggtggcggccgcagtggcgggaggcgggggcagcgagaggagaggtggcagcggcagtggtgggagttggcggcagtagaggtgggaggtggcggcagcggtcggcggcaggaggagaggcggcagcggtcggcggcgggagcaccctcccctccgccaaatccagcgagaggggaggcaacgatagcggcagcggcgggaggtggcggcggtagaggcgggaggtggcgggaggagaggcagcagtggcgggcgacgccctcccctctgccagatccggtgggaggggaggcagaggcagcagcggcggggctcatcatcctcctcgcccagccccttctcctatgcaacttcgtaccacttcggcggcggtacgatctgatttcgtctctccttttttcttgcctacaacttgttgaatttgcatgcaaaattttagagagacctgataatttactggtatgtgttgaactgaaccggttgaactatttctgttgataaatttggggagactattaacgaccaaatttggtaagatatgaaccaagttcgatattggaatcgaagcggattcggcaaagattcgaagaacagagtatgcatcggctgcgaaggcatcggctggagtatgcatcggctgagatggattggataggggatggttgatgcagccgatagagccaatacagccgattccgatggggatggctccgaagctgtttctagaatcgatcaacgtgattcacaaggattgccgcgatggagataaagctctcagaaaagcaattgtatctattaattaggatattttgttagagatatatctgggcaaaagtctgcggtaaagacttatggtatattagagcctcttagagataagagtcgtgtccgacaaggacatgttttgtatctcaggtataaatatgacccgaacccaatgtaatcgataacatcagttcaataacacttttggcacatcgccacccttttttactttcattctattttgacgagttcttgctttcgggttgagctgcatcgattcgatcttcaactagaggtaaacttgtaatggcggtttgcgttctcgggatcagtgcttccatctttatgatactctaatcttatttatgtaattcgtcaagttatcatatatactttataatctctgttaattgcgttatataacttgccatcggctggtttttactactagaaagtagccgatagagttagatcttgttattaatctagattatattgtgtatctaccatctcttagagattttcattatcttgcttagatcttacagttatctttatgcttaatgctgcatcggttgagttcgatctattaagttatatctataattgtgatatctagcctgttttatgattatcaatagagatagtatcggagttttagccgatgctaactgctttagctattcttatctcatatgcttgcttgtcatgctaaatctgccctttatattaagatcttgttgcactaaagttatattaggcttcttgtttgatatatcttgcttgttttgatatcttggtatagagtggtatcgaagtattagccgatacatgctagatctatttgattggctatgctataaactaatatataatcttcgctttaatatatatttcggcttaagtgatttatactgtctcggcatggtgaccgatctatcccaatcacttagtttaagtatataccgaagtaaagactatatgttgttaatatctacagtcgatcgagtagatttggttttatcttattcattcattgctgccgatcgattcaaacatgacatcagctcaaagatatataaatgatatgtcatcggcaactagccgatcggctatcgtttatggatttaactgcggtttttcttgtctttactcttgttgattgcaggatcaaatcaacaggcactctcacgaatctaaaagcaagattttggacatgcataggagttaagcagatctttcaggccagtgtgtgtttttcgcatcaatagagacctggtaatttttttggagggctcatcttgttcctattcttgttctgaattggtgtgttcttgattgttcgaggtgaaagggagctgctcacctcgatgaatcgagccgatgcatcgagccagcttttttttttattcctcaaaccttaaaggtgccggttctaaaacctaaaaaactgacatctttacctatatagatgccggctctagaactagcattgatgaccgaagtcatcagtgccgcctccgtggtgccggttgggaaaaccggcacctagggggttcctaactggcaccgattagggtttctgtagtagtgcaagttattcaccatgtcatcggtctgcagccaaacgcatgttgattagcagctaaatcgaatattcgagtttattatatcatcgcaatagcatggtatggccgtcgacgcggtaacacaccgcttcagggcattgccaagaacggaaactaactttttagggagcttctttgaaacacgtgattgacaaaggaggattatgaaaaactaactttttagggagcttctttgaaacacgtgattgacaaaggaggattatgaaaaacgtaagattttgaaagaaatgcgagtgcaaaacacaggaaaaatataaatatatgaatggtcgtttgaatagatcgtaggaaaaccataggaaccacagaaaacacattggattttctaagaggtttaagctcttgataccttccttcaaaatatctttaggattttcgaaggacggtatataattcaatcctttgtttggaaagaccttgtaaggaaattttcaaaaggggccttagcttttacttatgcttcatcatgattctctaacagtttagcattcggatgtggtgttatgatctgacgttgatgttctaaatgcggtgtagcgtaaaggacgttggtgttccaatttgttgtcgcattgggagcgaggtctggtgcgagggtctagtactcttgttagacggtcaaacactttcgtatgctagggctgatgagcaaagggggtttgtagattttgtaagctactaattcgtaatgagctaagcctataaatcaccctaatacggaatttgggattaactaactgttgtttaaagtgttagtgatatgccctagagacaatcatagagatgattgtatcacatactatgtttacatatttgtccgacattgttccttgaaatagataactccttattggttaatgaatatgtgattctttcatgagactctttatgttgtttgttgctatttcgaaaggatccctgatcaaaaatcatatgtggaacaaatatgtttagatgatcagcacatgtattaattgatgatcatgtctcatggatcatggtatagagataccaaattaataatatagacacatgttagtgaacatgttgttggatagacccaacatgagacactgcaagagccatatgtgttgtgttatcagtgatctcatttagtgttggtattgaatccttagacctgagattatcatggttcccaacatatgtagtagcttacttagggactgctaagcgctactccgtaattgggtagttataaaagtagttttcggttatgctacgaaatatgtagtgggatatgaataatgaagatgggatttgcccctcctatggagagatatctctaggcccctcgatgttgtagattatggaagtgcatggccatgccaaaggtgattgaggagtcgatcacaagttatataatctatcaacaggttcgagtgaatgattgagctattagaggacggcacatatctagccttgagcttaatcgatatcgtgaggcaaaggggttcatacaagtatacactagaggttcagccgatatgatctttatgtatgcccggtgggtcaatacgttctgctaggggccgctgttgacgcgtggaccgaaaaggagttttcgggttacagccgagtatatatgaacctacagggtcgcacgcttaatgggccggaataaggggattggatagagatccaatatgagcttaattcggataaggatccaaataggagtcctacgggccttggaggcccgagtgatggatcctatatattcgtgaggggtgtgaccggcggaggtattgcatcacttgagaaaccctagccgtcacttccctacccgagcaaaaccctagccgcgcgcgagtgctagcacatctgtgcgtggcattccgtccctgtacgtgtggataccggtagaggcgccgctggtttgcggtgctgatcgagtgggagtatggcgaggagaacgtacgaggaggagaaggtcgagccggtgcgatcgactacttcctctacatcgacgcgcactacttcgtgagagttccttcgacttctcagcgtcttcttccgctgcgcaacgcgtcgagtggtaacgatctatgatataatacttgcatcgttcctggtttacgcgatagaaaattttgatttatgctatcgtagcctatgcgtatcccaacagtggtatttgagccgccttgtatagtttatgatctagatcattgcatataattgatacgcggatgtagtagatgagatctattatattgtatatgagttcttaggtgatcggaacatgagatgaaccgatagctgcatgggttgatgagatcaatcggtatgtgtgttggtgacttcactggaatatctagtactcaccaaggccgagcgcgattgtgttcatcggatagttcgatgtccactggaaccgcatgccaatgagaaaaatgagccaatgagattgactcggtctcggcataatttgattacgtcgttaaggttttcacatggcgaatcgtagatgagatctagcgggaccaccgtgtgcgttgccccttagatttcgcttggggtttttatatctatcttactttattgctgttatatatttgatatgacatggtaggatagactccctcagaaaaattaagtgtaatttatgctcttccaataattgcacctattacggttgtgatcataagtgatgggtttgccatagccaagtgtcactttttatcatgataaaataggatagatgtcggacatctatatgcggagattattggtttacttgacaaggttatcaaaacggttttggaccttggggcataggttgggttggacatggagatgtcactccaatagcacaagagtcacatatgatgtgattgcaaggtgttgcttacctattttgatagttgtctagctgtgatgccaaagctcactagacactaacaaaataaggatcttgactcactatgatactggagggaattttgtttcacaatacatagtgggagtatcttttgttaaattgtttaatgaaaggttaactgtaaacatggtgctgattttgcatacatatatttctattatagatcatggcagctcttgcaccatccagttttaacttgcggtctattcttgagaaagagaagttgactggaacaaacttcatggactggtatcgcaacctgagaattgttctcaagcaagagcacaaagagtttgtgcttacagagccttttccagctaacttgcccaacaatgctcctgctgctcaacgtagggagcatgaaaagcgatgcaatgattatcttgatataagctgtctcatgcttgctactatgtcccctgagcttcaaaggtaatatgaggcattggatgctcatacgataatcacgggactacgtaacatgtttgaggaccaagcaagagctgagaggtttaatacctcaaagtccttgtttgcgtgtaggcttgcagaaggtaatccagtgagcccacatgtgatcaaaatgattggttacaccgagagtctggataagcttggctttccccttagccgagagctagctactgatttgattctccagtcgctccctcccagctttgagccgttcataatgaatttcaacatgaacaatctgaacaggaccttggcagaattgcatcggatgctaaagactgctgaggaaagcattaagaaaaactccaaccatgtgatggttatgcataagcgcaagcccaacaacaagaagagtggacacatgttagtgaacatgttgttggatagacccaacatgagacactgcaagagacatatatgttgtgtcatcagtgatctcatttagtgttggtgatgaatccttagacctgagattatcatgattcccaacatatgtagtagcttacttagggactgctaaacgctactccataattgggtagttataaaagtagttttcgggtatgctatgaaacatgtagtgggatatgaataatgaagatgggatttgcccctctgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaaaatctaagcagcggaaaataagataaacggcgcagacggctccactccacaagcagcttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaataaaacagttaagtaataattaaacaatattaatccaacgctatacaacataccctgttgtataggcccaaccattctgaacaaccaccctggctgcgcagttctatctccaaaccaggaatgtaccattccaaaccaggagctaatcaaattattaccaattaaagcatcttttactatgatgagaagtgtgagactaatcacgaaagacattgttagacccacccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacataatccactgcagcgcaccttcctggatcataatcacccccttataaacaaggcatggactccccagcgacccccgtgggcttatctctgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaattaagccatcatgaaataatagtgaatcataagttatcccaatagtgtgctaatgtttctaagcagggctaagcaattatttctaatatctagttgaaccaatataaataaagctcaactagtcaaattatagtaacccaaggtatcaaggaataaagtaatcaagaacaaaagggctataacaatgaataggttaattccacccaatgacattcgaaaataaatgcaatagttgaatagaaataatagctttaaataggatcaacatgctcaaagggttgtttgggatctgtgtgacttgccttgttggccttggaactcttcaaactcttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaagatttattgcgtcagcgggctagggtttcggtggaccgggcgcacgggcggcggttcacgcgaacggactgccgagatcgatccaatccaaaacggacggccgagatcgaacggtccacgaccggctcacggcggacgaccctgatgacgtcagcggtgacgtcaccgacagcggcggcggctcggcggagcgaacggctcgggcggcgcacgctcgccggcgaacggcggcactaggacgcaaacggagggcaccaacgggtagcggacggcacggcgaactcaccggcgaccaaagcgacggcggaagaccaacggacggcgacgacgacgaagaagaagcggcggcgctcttcggcttgacgacggcgacgacgctccggcgatcttcggcgacggcgaaggggcggacgaggacggcgacgacttggcgaccacgacggcggtcttcccgagcgacggcgacgaccgagacggcggcggcgcacggctggagcgacggcggcgacggcggcgctaggttgcacggcgctagggctcttccggcgacgagaggcgaaggcgagggtggcgacgggtagaggagacaccggggaagcttttaaaggggctcggaggcggtggcaaaggcccacggcggccggcgatgagaaggaaagttcgtggcttgaaggaaggaggccgatccgaatcgaactcgattccacgaacttccaaaacgttttagccgaagcttccaaagaagaaaaggtagaggagatcccgaggatcatttcccctcttttgattcggccagagaaggaaaggagcggccgaatttggaaaggaacggcggcggcggcgcgctagggtttcggccggaggaagacgacgggcctgacaggtggaccccacctgtcagcggccgaacgcgcgcgcgcgcggcggctgcggactgggccggactgggccgaggagagagagaagagaggttttgggccgactttcggcccaaagccaaaagaagactttttaaaacctttttcaatttaaattatttcttaaatgcaattccatttattaaaaatactttcttagctcaaaaaaatcccagaaaaatctaggaattatagaattaagcaaagtatttaatgaaattttatctggccccattttatattggaatttattaattaaaattagatcttcttttctaggcttttaaaattaattctaaaaattccaattaaacaacaatttatatattttaaattttcagggtgtgacaccctcctatggagagatatctctgggcccctcgatgttgtagattatggaagtgcatgaccatgccaaaggtgattgaggagtcaatcacaagttatataatctatcaacaggttcgagtgaatgattgagctattagaggatggcacatatctagccttgagcttaatcgatattgtgaggcaaaggggttcatacaagtatatactagaggttcagccgatatgatctttatgtatgcccgatgggtcaatacgttttgctaggggccgctgttgacgcgtggaccgaaaatgagttttcggggtacagccgagtatatatgaacctacagggtcacacgcttaatgggccggaataaggggattggatagagatccaatatgagcttaattcggataaggatccgaataggagtcctacaggccttggaggcccgagtgatggatcctatatattcatgaggggtgtgaccggcggaggtattgcatcacgtgagcaaccctagccgtcacttgcctccccgagcaaaaccctagccgtgcgtgagtgctagcacatctgcgcgtggcgttccgttcctgtacgtgtggataccggtagaggcgccgctggtttgcggtgctgatcggcgtgggagtacggcgaggagaacgcacgaggaggagaaggtcgagccggtgcgatcgactacttactctacatcgacgcgcgctacttcgcgagagttccttcgacttctcagcgtcttctttcgctgcgcagcgcgtcgagtggtaacgatctatgatataatacttgcatggttcctggtttacgcgatagaaaattttgatttatgctatcgtagcctacgcgtatcccaacataacgctgttgcacttggttttgcttgaaccagagtggaagtaatcatactagtggtgcgagcagcatcgtaggtgaggacactagtttaatctcgaaggggtcatcgggatgttgacggtcgttatagaccaatttcgaccgtcaatatatctagaataaaggagaactagcaattcttgcatgcatatttgtttaagaataatctatttccacttgtttggaactttatttgtatatatgagatcttcacataaatggagaaggaataatggaaataacagtcagggaagcagttccggccaattagacgtgagtaaaaggatcagagggcccacaagtcagatgaaaccgtcctaaaatgagccaaatccatcctaactgtcataagggtccaccaggcagtctcctagccaaagcagaggtccagaggtggggcccagggttcggccgaaccaccactggcgccaaccatcttagccttccacgtggacgtccctgatcactccctaatgacggttgcagggcatttcctacaattccaaccgccacaaccgtcattggcagcctataaatgggcatcaccttgtccattccaaagtgcaccatgaaggatcaaatctaagaagctctctagtttatttacattgttctagtactagtggagtagtaatagaatatttttcttagttcttcatgtcttcaggagattttgggtatggctctagtagctttgttattcttttgtaagactttgctcattaatgaaatattcttctttatatagtttcggtcttttacttcactcatataattattggagtgccgactttagttcatatttgtctcgtaataattatgtaggtagctaactggagatatgcaatggtgttggtttaatgttcatttatatgattgctctatgtcacatgcagagatgtagagtaatatttagtaatataagcatggtgcttagattattagataccattaaatggttttatatgccacgggtctctagaggtaggctgctgatggtgacagctcaatacgggtataatactaagagaatttcctggtgtggttactcctccatattcattaccggttggatggccatgacaggatgtcgtaatgaactcggcaagtaagggtggtttctcaatacaccaggagggtatagttagaggatattggctgcatgattgtatactagcaagtgcggactaaaatgactatatactataagtacataaattattcttttcttattctttctccacttagcctaaattatattttaatgagagtagtctagtgagttccttctgtgtgtcaacttactctacccttgaattaattaacccctgcattagactttgatctatacaagtgatataaattattatcatagtattctcttatcatatcttcccttataattaaataaatacgatacattggaatactcccgggtgaaatgctaccacagtatatccgtacgcttacggattgtatatgtaaccgtaaagtacaccgagaatattttggcaccattgctaggaattatatttctagtcatgttgttaaaaaatatcaacaagggaccccaggagagagagccgtcgtcgtgggatctggcaaccgccacctcgctcgtgtcggccttccccagcaccgccatccccaggagagagagttgtcgttgaggtatccgacgaccgccacctcgaagggagccgccgctgctgctgtcggccaagggagccgccactgctacaaggagaggaggagcaggaggaggcgagagggggcaagagggaaggggaccgatacgagtggaggaggatcaaggagttgagaaagcggggtgagatgcgatcggataaggatgtcgacccgctcgggtttatttaatgggtgccggtttttttcagaaccagtacctatatttatataactaggaaggtagcccgcgcattcgcgcgggcatgtatcgcacgggtatttacgtggattcgtattttttaaaaaacttatagtgacagaatgtatatcaactggatgacacctatcacactttaaaagtactatttctctataaattttcttcaacggtgttgcttggataattgtttcaacctatctgttagctttaaactatacaatatttaatttataccggtaagaaatcaattataatctttttcattatcttgaaaggagattgacttaattagtttaaaacaaatgtcgaacaaattaagtgtatattaaaaataaggtgctctatttttaaacaactcctagaaaattattattactaataaatttgttttatttgtgccatcaagttacccctccttctaattggttcatacatgctcacacaatttgttatatacttacatatatatttgaataaagaggagtgatctaaatatcttgtttccttattatatatgtgatctatagtatttatttaaatacgtattcaacataagtcctaaagtttaaatgttgtaatagcaaatataaattttgaaccaactacttgctttcattgtgcagattatataccgcggcgctaggttattttaatctcaattaagttgggcggctataaatattggacccactgatttaagtaaaaagggatggattttattagcgtcacatggtagcatgagggcgttttaaggattggcatgtggcagcgtgagagcgttttaagaaagtttaatggacttgtagtattcaaccattaatataaaacaaaattattaaattatctaatattattaaattattaaattatggtccttcatccaataattcaataatataatccgggttaccaaattttgtaatatttattaagagaaagcggactaatctaatgatgtaacatattgcgtgtttttatagtatagaaaatcttattttaaaatgacggtctaattttttctactgatgtgcatacatattttaagggtgttatagtttttttactcgtgcatacgtacgtatgtttgtattgttttttagtaaacagtatctaaaggttttttttatagtttttcttctcgtacttacatacgtgtgtttggtttttaagtgaacagtacgttatctttttttcatcataagtacttacgctagtttttactcatatgcacgtgatactaagaggaaggaaatagatctaatctaacggtctaaaattatgggtccaccaatttaaatgaaaatcaacggtgagattataaaatgccatgtggcgacttaagagcgtttctaggaacgccacatggcggtttaggagcgtttataggaagattaatggacttttagtatataatagatagatagatagatagaagatagaagatagatagatagataggtgttagttcttttaaaaaatcaacacctatattggtactggtttttctctggaaccgacacctataatataagtataggtgtcggttcttttaaaaaaccgtcacatatagtatttgtaccggttttacatgtagaactagcacttacagtgtttaaatgtgtcggttctttattttttttcagcgtgtgaaggtgggaaaagatccataggtgctggttttaaatgaaccggcacctataagactggtccctttaaaggtttttttaagtagtgcaagttttcttttaaattttttttcttctactgaattaattagaccattcattttaaaatactagttaaatttatttatgaaatatttaacattatagttgagtagataattcgctgtaataatcagttcgataatctaaacagaacacggcctagtgtacttacgtaatggagcagtaagcaaactaagccgacggttgcagaggtggacaaccactttgacactaattttgttagtactaacaactactagtagtacaggttcatctctgcagagtcaggaccaatctgagtacctggttggtaccggtaccggacaaaaatctggttggaatctctagccagctagagtacgtacaatttagaactttccgttcctacttcctacgcgatctagcgatggttggaaaagccaagtgttagctgtctttgatcccatgtgtccgctagtttttgcgacagagaagaacagagcctaggggattcagaaatcagaccaattaatatggctcacagtcacagtctcgcggaccaaaatctagtgatttggatgtatccccactccccagctggcgttggacaaggcagaaaatgttaaaattattttatcttatacgagacgagaattgctactatcaaataaacagatttggagtaaagctatccccatattcgcatcctcttccagcttcccccttgtcaaattttctccactagtcttgagtcggatgcacctgtatattagactcaaagtgatatgcttgtccttcctctcgacaatagatgtgttcggtggagatttttggcttgtggtcagctacggaatgggagagaatggacaacagagagtagggaggttggcctgctccgtttaagcctttagcacaatatgacatagctgctcaacttgggctcgtttctaagggcgtgtgcaacatttattctggaagttagcaatagcatgagccaagtgatcctatggtagtagctgtgatagaaatctacaatatacggagtataacactgcttaagaaacgattttgggctgcgaaaacagggggctaggggttcaaacggacggtcgcatgctaagatcactatcacagataggatctaaagaggcccgcttacgaaaatatcaaagcactaataaaattggctgtcacaatcgagtcctccctctcccaccaatttcttactccaggagggcaccaccaatgctggctctggttcatctcttcctctcagtctagtcacctcacctctctacccctcacctcgcaaccaccctttctctgcacctcacctcaaatctagcggcgacaatgaagtggggctggaggaggggggctgcagatccagaggtgacggcagtggcggatccactgttggggctggttggggcgccagccccacctctaatccctgcccctgattagtcattaacaagtctaattagtcacaaccagcccctgattagtcattaacaagtctaattagaattgatgaggagactgtccatacggtagggatgcaggctgcatcactgcttctactccttgctttcatggcctaaactgatgaatacagctaagagaaaatacagcttactctaagtataccataacaatatattcacacatattattgtatattttcacatagccacaaattgaaatggagaaagttcttttgattatattcgtatctggtttttcatctttagttgatatatctctaatttgtttcaatcatactatatttttacactagcacaccctcagtttacatcctggattcgccactgggtggcgggccttggtgcggtggaagcggtggcagttaagaggagactgcggtagtgaacaattgatacgtgagcggcgcaactcaggagagatggatctttcatcgatggcacttgggaactccggagccatcatgccctgtctggttgtggcttagcaagatgtccagaagggggtggcgaggatgagcagtacccctactacggcagtagtggccttagatccgccgctggggaggtcagatctggatggcgcgggcctcctacttgacaccaacacgaggggcaattgtcggtggcatggcccaaatccgccagcgggaaggctggatctgcatgctccgctatcaatggggcaaaatgagatggtgaacacgatggtgtggcactacactgcgtgagacaacgacgaccatcttgtttacatgttgatttaaaactgcatgttggtgcttgatgtggccccaagtattatggtctaaattgcaaaaacctacaggagttttggcacatgacacataaccctgggtattatcaccataaagtttcacaaaatcacattattggtcatttgactttgatgtacgtatcacacttttatgttttgcaatcacatcttaaatttatgagttgtttatccatcatatgtgtaaataaagcttttttatttttttatattggaatatattaacttagttaatgatatggttttgtgaaactttaagaccataataaggttgtgtttgaggaggagatagagaagattggaaagatacgcaaaacgaggtgagccattagcgcatgattaattaagtattaactattttaaacttcaaaaatggattaatatgattttttaaagcaactttcgtatataatttttttgcaaaaaacacaccgtttagtagtttgtgaagcgtgcgcgcggaaaacgaaacaaacaaactcactatcaccctagaacgaactcagcctaactagggttatgtgctttgccaaaactcctatgattttgtgcaacttgtatcataatgagtgccattttatgaaacttacttttaaaaaatggtgaatcattaagacaaatatattgaccaggaatttatatataaattataggaacatatgtaatctaagtaattgatgaatgagagaaagcataatgaaaggaactttactcttctccattcgatccttgggaattttcatgagaaaaaaatggtataactttacacactccacattgacgtcttattcctactaaagtcatttgtcggacatattgcaaaccttatacatatatcgatcatattgagttagattattttcatgctttcatgattaagatctctctctctctctctctctctcacacacacacacacccatattttctcaccctctacaactagagtttagcaaaaatgtaccacccatctaccacaatatactatacttatacactgaaagtaagcatatgtcatccatccaccaaataaagtctccacatacctatgatcctccctccaaccatccatgcaaaatgagacatgagctaaaaaagatgttgaaaaaaatagaaatgctcacgtggagaaagagataaaatattctcgagcatgaaaaaaaaagaaaaaaagagagagagaaaaggccatgttttacaaataagtgcaaggaggaggattgtacaaaaaggagtcaatattcaacctttcattctttcacgcacacatattccttttccacacacatgcacatcttgatcataattgtatcattagtcctcctgtttagaagaatgaatttccaagaagccaataagcattcttggatccatttttgactttacaatatatgcgatgcaagtatgtcattcttattccctaccttgagctctacataagtcttattagaagtaggataagaaaatgcaaaatcaatgccttggtgaggaatcatacacattgagcgatccgagagaatcaattaaggagtaaagtaaagttatacttttatgagaaaaagaaaaacctcaaggaattcattaaaaggaatggaggtaacttgagtcaaggctgtttcattcttcaatcattcaagatgacatgtagacactttaaggttcacaagtacatgtatggcttggaataatttgtatgcaagtatcattacaaaaggattaatggctttgttgtaatccatgatcattactcagggaccagtaatggctaagtgtggagattttgttgactgtctttaaggtaccaaatccgatcgtcaaaccttgcataaaatcaattgaaataaaaaaaatcaaacttagtggtagtggttattactaattattttcacaagtattggtgaaatatttgtatgaaaaccacccgccaggcgaagaaacacacctccggccaatcaaacgcaaatacacggattggagggcccacaagctgaccaaatcacctcaaaataggtcaaaactatgcaccgtcataagggcccactggacaatgaccaggccaaaagagagggggaatggcggtgctagggggtcggccgaacaaggtttggctgaattacccttgcggccactcatccccgcccagtggcggatgtatcgttggggctagagccccacctccacctgacagaaccctccccctcaccaccacgcgcacgttgggcttagcccattgggtcggc

SEQ ID NO: 82074 - DNA, 23733 bp, Oryza sativa
  unsure (1)..(23733): unsure at all n locations
aaaaaaacccagtccccccctcccctctcctctcctcccaccatgggtcactaaaagtccattaaacttcctacaaacgctcttaaactgtcacgtgtactcctacaaatactcctaaaccgccacatgacactttaacaaaacaatgtgtctaataattttatctattataattttattgaaaaaaacccatacccccctctcctctcctcccaccatgcgcccaccctttcactagacgtgcttcctccctcccctcctatccaatctcttctttttttatttagttattaaaatttttgaacaataataaatcttaaataaccaaaattttcctatagttatttgttgttgtccattaacaattaaaaaaatataaggtgttctttaacctataagaaatataaaatttttatcgtatcctaaactttgcatatcacttagaattgttatgtaaattagggaaaaattgataatgtagattatacgatcaatttacaaaatatgcataaataaattaagttagatctattattataacaaaaataagaatacgtccatccgtacatgcttcatcttcccctcctatccaatctctctttttttttcctttagttattaaagctcctaaacaataataaatcttaaataaccatatttttttccatattacgttagatcttagtcacaaaataatctaattgtgattaacatcccaaaacataatacctccgttctaaaataccagtatgtttgttgatgaccaaatttggtagctccatgagtggattcgaagttggaaacgaagccgatttttgaaaaaagcctgttcgggaaggctaactacgaacggcatcggctgccgctcaaatcggctacgttgatattggctgagtactgggcatgatgtaatcaaaccgacgccggcaatcttgggaaagtggccccgcaatcgtcattgggtgggattaaagctagtcattgggtgggattaaagaccttcatagctattgccacacaaggataggagtcctaagagaggcaattgtatctattaattaggacatttttcttgtttccttagagatattttggtaagggcccacctaaagggatcgttcgtattttaaattatgttagagataagagtcgtgtccagaaaggacttaccatgtactttgggtataaatatagcccgaccccatgtaatcaaacaacgtcagttcaatacacttcagcgcatcgccacccttttacttttcattgttcttttcgacgagtttttgctttcgagttgggctgcatcaggttcgatctccgacaaaaaggtatatcttgtcatggcggcttgcgctctcaggatcagtgcttacatcttcatgacactctaatcacatcttcgcaagctttcgagttatcatatttattgcataatctagatcgatctcgttatctgagcttcatcggctagcctctatcatggaaaatggccgataggctcagccttcgactttgatttaaattatgcggtatatctgccatcttgaatgagctttcatcggttcgattagatcttctgccactcttcacgcttaatgttgcatcggttaggttcgatctattaagtactgtcctgaggccttttatctaatctattctttgactgctaatagagatagtgtcggggtttcagctgatcttacctgatttagtcgttttatcttccttcttggttctaaatcgtctagatttaccccttatatgaagatcccatcctcttgaagtagatcaagctccctagtctctagattaggtcaagcttcctatatttcatttgtgctggtatcttggtataaggtggtatcggagtattagccgatacagattgggttcgctccatcggctatgctatgagcacgcacaatctcttctttggagcatgtttagatatggagcgatttatattgtctcggtgccaacaccgatctatcccagtcgctcgatctaagcatgccccatctaatggattacatgccgctgatatctacagccaatcgagtacaccgaacaatctccaagtttttacttgcctacgccgatccaacttaagttgcatcggcgtggcccccaacaatatgtcatcggcagacctgtcgataggctatcgttgatggatttaactctttgttgtttcatgtcttgttggttgcaagatcaaaccatctggcacgctcaggacccgaaggcaaatttcccggacctgcactgtagttaagcagatctcctaggcaacaatgttaaaaaacattacctttattaaacaaaataatgttgattaaataatacataaaaatattttgacatcattatatctgtaatatttaaagtaatcaacaataccataaaataaaatactcttattatgattagcattccaaaaactattactgtagttctaaaatatcaatgtatctgaataatgcaaattaggtgtatcatgacaaatattttgtcaaaataaaatctttaatattgaaagtgaatacattctagaaagaaaggatcaaatgtgttgttgaaaaccgtatcgttatcttataattaagaagaatagggggggcatatttgtcggcattttcctctttagtctttggagttcaaacctaactaatctcagtataaagtatataatatccagagtactcgacccgtataaagtatataatattgaaagtggatacattctagaaagaaaggatcaaatgtgttgttgaaaaccgtatcgttatcttataattaagaagaataggggggcatatttgtcggcattttcctctttagtctttggagttcaaacctaactaatcttagtataaagtatataatatccagagtactcgacccatatagggtttttcttatgtatcaattctatgtccacttttcttatgtatcaattatatgtcacactcaaacatatgtatcatttctacttataattaaactgctattcactaatcgttgagtcaggaatattgatgaggtgattgtttattaaattgactatatattcgagattcaataaacctatatatgttgtcaagtggtaaagacgaaagtcaacttgcaatatagattaaacacaaacagaataggtcaatctcatgaaataaaataaagctgcatcgtaactttttgaaatcgaaaaaaaaacatgtatccataacatacaccctacatataatcaaagataaccacggctaatctcattggcatataacctatgtatttattgattcattaaagcatataaccaattggagaaattattagattaaaaactcatccttaacaaatcagaaaaaatattcgagttattttacctatagtagcaagctatcgtagggtgctcaactttgtagctaacgaggaagggaaattactatgttacccgcttattaaataagggttaatttgatccgtgccattgccaatatgcctatttagataaatgccataacattcgtctattcgtaattgtgccactcaaattttacaaaattggaaccatgtcatcgtcgtcacgttttccatctcccccctcatctgcaaatgggactcacccatccgattcatctttctttcgccctcacttatcttcatccttccccatctctctatcacggcgaggagtgaacaacgcgggcaggacgggagggggtcggcgacgggcgtacattaagtaaacggtggttgaatggaacaattgtactttagagtcacttatattttgggaaaaattgactcggtttatggtataaataaagacatctatggtatacaagaaaaattgttatttaatttaaaatcaaataaaaataagaaatgctaaatattagaaaaagaaagatacatagtataaatgatatatagtttaatttgtagaaaccaactcaattgttgtgacaccatatactttctcataaattcaaaactacacagtttgatttaattttagtttagaattttttatgttgcgtgcgtaactataagaaaatcataactaacttcaaagtaatccctagcaaattggaatatagtcaaaaagtatttcaataaaaatcacccacaaataaattaacattggtaatgaaattttaaacagattaaataaaatacctacgtatgtgcgtgggctaccttcctagttagatggaataaagcaagccaattcaatctgattctctcatctctcattctctgctttctcaagctacccaagccagggccaccaatgtcacattcttatccaattcattcatacgccagggctcataacacctatacaccatttaataaggagacataatagtttttcttcttaaatcataatatgtactaaaaatatataattataattattttaggacggagctagttgaaatctgcgttgtactgtgtaatttaaaaaaaaaagaaatactcaatccgatcctaccaaacccaaaccaaacctgcttcttcagttcttctatcctcttgcaccttatgacaacaagagcatatattggtagtttatctaacccaaccaaatatttacccctatattatactctagcttgatacagtacttcttaccgtccttaattttccaaagccgaattattttgaataacccttgcatcctctacctaccataactgctaaacatagagttagccaatgcttatcgtatcattggttcttcctcgaaaaaaaaaaagttggcaacatcggagatggtatttttttcccctaatacagccaactgccggcctctcagcaactgccatttattatacaattatgtgatcggtgggctgaacacatggggatataagtgattatttgacttcagttcttcatttattttaagcttttccgtgaattgttagttgcatgaaactcatatatagctaattcatattttttttgaaaagaagtaaatttcagaaaatcacatattctattattaaagttaacatgtggcatataactacacattactggagaagtgatctttggagggtcagacgatttccacaatagtcctggttccaacaagaaccaggactaaagaggtttattagtcctgatttattactacaacggaactaagagatttttagtcctggttcgcctcttgatagggcatgtcagacccctgtcgaggggccagggaactttagtcccggttggtaaagacattgcagatccgggactaaagttgcataactttatataccccttcttacttctccagtccgagccattgctacaaaatgaagctttgagggagggaggtgctgccaaaatttttaacaattttttttgtgttaatatacaaatttgaggtctctaaaaggttagcaacttcatcctcctctactttttgcttagcatttacatttagagctatgttttgtacatatttttccctctagaaaatgtgataaaagatgatgagagagaaagtatgtgtagggaataaagaatatagacaatttgtttattttggattttataaatacttgtttgaataattacatataataattctgaaagaataattagccgtaaatgccacccatgtcaaatctaggatttgaacccgggtgggctggttccaccacaaggaacctagccagttgagctatgctcacttcgctacatataattattgtatgaatggttaattataaaactaagttaatttaaaattaaaataagtacaacatattaaatatttgtttacaatgtaattaaaacatgaataatatgtagaatggatttaataataaagattgtatgaataattatattcaattgttgtatgattatttaatgagtttgtatttcgtggattttatatatttacgatttatatgcattttatgtagatggatcggtaacggatgtacgcggaccggcggtcaaaagagtttattgacggcgtgcattattttttgggtgtggccaatgataaaaagtgtaacggtttcataagctgtccatgcaacaagtacaaaaccagaaggagtattccactgcacgaagtattcatggcaacctgtttcagtgggggttcatgtgtagctacaattgtgaccaataaaggttttataaaatcacacctctatttgaatctcaaccaaaattatctatctggaataatattacagaaagaagcgaagagttagctaccaatcaccttaaccaagaaaaaataattaaaatttcagcgacactatattttaaatttttaatttaatgcgtgccaatatatataggaatgggtcctgtaacatcttaattagtacgtataccataatactcatgttatatataggccactgattataatattcagggtttcctttatggaaaaccaatgatatagggttttcttaaatttactctaagaatttgagtgaacttagggaccatagatatcaactttaaaatgaggttagctaatttatatttaaaaaatgagtaaacttcactccacatccgaggaatgatgtagactacgtgggattaattaattaatgctacttataaattgttaagtaaattgcacatcttttcccatcaatttacttctagtgatgaactaattatttgtgcaacgtttcgatcaagttgggcttcgatttttatttttctttttggcagctgcgaaagtagcgtaagatgtagaatgtggatgcttgaccctcgagcaacgcgtctaagcaacccccccccccccccccaccacattacttaatttctgatatgtatagtaggacgtgactacatatatgaacgttgcgttactccaatttctgatatgtatatatagtaggacaagcaactcaactgtatatgaacttcgtcgtgcattaaattaagtgatcacctcaagtcctcgaagaatattattcgctccgtcagaataaggttataagtgcagtcatgagtttccgtgtctaactttaatcgttcgtcttatttaaatattttttgaaaaacctataagaataagttacgcataaagtactattcatgttttataatctaataacaataaaaatactaatcataaaaaaatttcaaataaaatggacgatcaaagttggatatggaaactcatggttgcgcttattttgggacgaaggtagtacaatggaagtactcctagctagtaactaaatcggatcaggtttaatagtgaaggcaaataagcaaactaatgttatatgtacttactcccatcccaaaatataagtatttttttttacttcaacacggtctttgagatgctactttcatcaacaatgtctacaaaagtaagatattttaaataaaaaagttgcatattgtaatagtttgtttaatgacaaatatcaagtaacatcaaatttacattattgatcttttttatttttttgctattaataatcaaaatttgaaaagtttgacttgccactgttctaaaaatacttatattttaggatgaagggagtacttgataacatagacaacacactacgtctagcagccccaagacactttaataatttcacttcattggtttgcttttaatatattacctctctttctttcctttcacttggagctcatgtgtagagattgtatttcgtatgatggggctgctcattctctccccttaatttttttctccatctgaatttcgtcatatcaccatatgaatttactacggatatgtttggagaccacaaacagtttctctcagaatcaaaaactttcctgagtaattcggtttttatttagatttaaaaatatataattgccgaattaaaaaattctgactagctgtttctcatattaatctaaatctccttcaaacaaatcctatcttatttgttttgagcacgtagaacactaggcgttagtatatggaatggcttgccagcattaaaccgcgcgccgaggtgtcggtgccgcgcgctagcatatagctccagtcctgtgtggatcatcaagcgaatgcgtgtacgtgagaggctgtgactgtgagcaatccaaccacacgcgcaaacatagccgtacgtacgtactgatcatttaaacatgtctacttattatactaacgtataactcgtagtactcattaattcacggatcccaaatgtacattgtatactcgcgttctcaatttttcacccatcctaacacattacacacataccgatatagaaagaatactagaataccctcgttttattaaatcctaattaacacaattattctccaccttatcttcttttaatacatttatattgtactttcacaaacttcaatacaataataattacttaaaaattgagaagaaaaatatcttattttatgacgaacgaaatctgtatgacttgtctcagtgttttggattcttagaatatcaaaaattgtgggtattaattgtgtgcaactatatatagtagtaaaactataagtagttttagtatagaaaattgtgccgttaacatagtgtgtgctttcatgtgatattggtttcgatcgctactacagaaagagctataggtatcggttgggaaagccccattagtcgacacctttgaggtccccgatgaaaaaaaaagagtcagctcgatgtattggcacaagttcccccccccccccccccgcttagcctcaaaatcgacccaaaatcaatccaaaatcaatcatagcaacaacgtcatttatcatcacataaaaactccaaaatcaaacacgcaacaacatcatcatcacataaaaacaacaatacaaacaacacaaatacacaatcaacaacaccggtggatctgcccggcgctaccgacgtcccctccgccggatcttcccgccgccactgatgtcccctccgccggatccgcccgtgggtgccgccgacatcaccgccaccgctggatctgcccaccgaaaacactgctgcagccacctccgccggatctgcccgcgggagcgctgatgccaccgccaccgccgcgggagaagcttgggcgcggagggtgaggaggagggggtagaggaccatgggatctgcccgccggaaatgcctctaccggatccgctcgccggaaacgccaccaccgccgcctccgccgaattcgctgtggatccacgggagaaccttggcggaccaccggatccggcccgcgggagccgctgacaccatcgttgccgcctcctctactgccgtcaagggagagacaaaagggggagggggctgggacgagaggggaggagagggagtggccgagagggagagggatgagtgagaggaggtggcgagtgaataaggacgcccccctcacctcccacgtgtgactttagccactcgtgccccggctctttctctctcggctcgtcccatttgataagtgccggttttttttaaaaaaaaggcacccataatacattacaggtgtcggttaattaaaaaccgacactcggtaaattttttttagaaaaccgtcacctataggtaccggttttttggattttcagcctgtggaggtggggaaaacgctataggtgccggttttagctgttccgggacctgtagtgctaatatgtatgtgtgtttttgtagtagtggatatagcttttgaagaatattatataatttattgggaattgattgtcaaagtttaattacgaggaattattggtcacttaatttccattactgacaaatgaaaatgcatctcatgaaagttcaccaagtgaatactccattatacctttgagcataggactgtaaactgctaagagcatctacaacggtctctttaaatccatctctccaaatgttaatttgactaatttgctaaaaaaaaaatagagagccaaatttacctttcacaataaccgcctctccatctaccctctccaatgtgacaatgggtggcacatgtcaatcaatgtacttctttctctctcccacatcatccccccacccaccccacagtccctacccatcacctcaccggtgacgagagcggagaaagggaggacatagaatggagctcgatagacaatggtgaatgaggtgggcagtggagggtggcaggctctgacatggtcgataacaaaggcatgggtggaagtgttgacgacaacgattgtgccgactgtgcatgcagtgcaaagggcccaacaagatttagcgatggtggagccggcacggagacaatgaaggccggctcaaggaggaggagacactcatggccaccccgagcatggaggggtccgctgactgatggggtggaagaccttgacgtgccccgtctccgcccactagacctggtgacagcccgacgtggtggagtgagggcattgtggtggcagagttctagcgagggcaagtcccgtcaccatgatggcaacggagttatggcaacggagagggcgcaacaaggatggggaaggagccaacaaagaatgaagtcggggcagtggagaccgaggtagaccgatggtggggagggcccatccccatgacatagtcatgcctggcgttaacgaggagggatgtgggctagatgacggtggaaggtagggagcttctgtcgacgaccgagggccaaggggagctgggagccagtagcacatcaggggtggccacaggagcttctgccagtagtggaaaacaaagccggaaagatcaatcgttggagctctagaatggtgggtgatgacacaggaagggttgaaatcctatcatgacgccaccatggccatggtctcctgcgatttgtggtaggcgagtggtgaggcctactattgatatggcaaaatggctctctaagtttggccaatgtgcggtgaggtttggccaggttggcaaggctgttggagacatattttcaccaaaattgctaaattttggcttagagagtcattaacaactcagttcgagttgctccaaaggctcctgctcgactactttttgtttaaactaaatgttttaatgttttcgaatacgtgtaatcaaaacatttaaaccttcactcactaatacatatatggggcaaaatttgctatagaacactctagatttgtagcatttgctccataatactttagctttgtggttttgttataagacactatacctttttggaaaaattccatatattcccctaaactcttgatagaagtccgtctaccatcttgaactttaaaaccgggcatccaaccctctaaactttgtaataccattcaaattaccccctaaggtggttttgggtatttgaaagcttaaatgagtggttttgaataatttatatagcatgttcacgtatcctcaatcatcaatcatagatttatatcatacagttatatcatattagttgtcggagtatgaaacttctctagcgaggaagcgagtactccctctttgaagattcaggcaaggggcgagttttgagttcaagtgtaaatcttgtgaaagatgaacatgggggattataaaggtttgggctgcacgaatgtgtaataccctactcctgtgtgtgtggactacagatggagaacgagttacaaactgtggagcttgagcattagtggaagtatttttgctatcaagaatcgaaccctctatccgttggcctagatcctccttttatatttcaaggggagtccatagcaccaatatattgatgtcaaagtggagcctactccattcaatttagtatgttttgtcttgtcaaagtcttttgaaccgaacagggagggatgttctcccttgttggctgacgggcaaggtgccctaaaataaaagaagtgcacttgcccctgctatttcacagggctacctgggtgcgtcgtatagatgcccccaagctcccccattgtcgatgggatgtgtataagacgggttagtatatgttacttcacattaaatgcgaggcttgacgatgaactgttgtttctaccccagatacttgggggccaaggacggattgttgatggtccttaagtaccaaatccgaccaccaatccttgcataaaagcaaatgaaataaaacattagacttagtggtagtggttattactaatcatttccacaagagttgagaaatattcgtttgtaggtgaattatggacgaaaaccacctgccatgtaatgaaatacatctccaaacaattggacacgagtacaaggattggagtgcccacatgtcaatcaaaaccgactacaattgagccaatccacggtacaacatgcagagggcccaccaagaagcctcacaaccgaaggagtggccgggagatgggaccaaggggtcggccaaaccacaaggtcggccgaaccgcctttgtggtctctcacctccaccttcaacgtggacggccctaattcatcccctattatggttgtgggtggaccaacctcgtagccgctttagtaaccatcataggagggctataagaggagctctcacttcactctcacaacacacaacataagtggagtacaactcactttcatatttaggctactctctcgtagagtagaatataggaaaagagtgaggggaagctccaaaaggagtgccctagatgtcgaagttctctctaggggagttctagaggagtgccggggatgtcgacactatctatgctggagtcttgaaggagtaccggagttgtcggcactttctccgatcttgtatctcgacggatgcttcatttatataagtaagtatttgtgattcccttttgtatttacttttcttatttaagatagattctcattattacgggtttgtcacttagtatttataaagaagcaagttcttggctgagtctagagtagtaatcgataacgtaaacatggtgcctagattagatataaccttcgtttgttgtgtgctccatggaaagtgaggtgggcggcaggtggtgacagtcatgtccctcctttgtattccttcacgtttgggtacatcatagagttacagggtagactcaacttggcggaccaggggagagctagtgcccgaaataactaatagagttgtaccttgtaagggttacggataaggcatacatcctatccttagggttacgcattgtacaaatacatatactcgcaagtatacgagaaggttatgttaatcgtaagaaatttagccgaagtataaggaaaccgtccccttgagtagaaggtgttagagtcctattcagaggggatgcagactttggtatctcgtacatgtgaagtcctctccgagttgtacttggaggtcaaggcacttaggggtataagtacaagcccttcatggggtacgtgatcatcgaatcataatctcaccaccagccgtagcagaagcaatctggagggctcgaagacccagccgccgatcgatctcggcaagttgatctagatagcattactcaacggttttgttgttctctattgtaatctctgtgtttctcttcataatctcatataaactaaattaaggcttttaccttacaaggggcctgaactagtataatatttgtcacttgtcttcttgatgtcgtatcgtgtagatccttgctccgcgtaccccaataccctcaaaatacagtctacgggtatcactgtcgacataccttaacttaatattaacatagttaacccgcagtagttctctctattctaagcctctcgtttcattgttgtccttggatgaatcctattcttagactatacacatacgttctctatgattcggtacccttggaatactataaagtgaagggctatagcgcgcggtatttgtgtgcttgcagatttatatatgactgtaacaaataccaacacatatgttccatgctcaggacaggtgtgagggatgccttgaacaactcgtgatggggaccctggtccctatttctccaatattagtattatattaacatccatttgtgtaagtgagaacaacaaaaaaaatagagtcaaaatgaatgattatgtagagattttaacatatatgtgcaattcatatatcacgtaatcaaactcatccaatatatatgtaaattagataaaagccactctgcaaaaccaccttagggttctatataaacaatattatatagtttaagggttgaaagtctggtttgaaaattcaatgtgctaggtggattttcaatcaaagtttagggagtagttagaccttttttttttccttttttgttatttttttaaaaatctctaaccattattttaatacattctctttgagtggggagataaaattttccaaaaaaaaaatttacccttgtacatgaaatctaaaaatatcttacaaaattcaaaacctattccaaattgtgaaaataaaaatatttgggagggcaacataatgagaactgcaaaaaaaaagagtaaatagtgttgaacaacataatgcctagatttcatcaaacacgtcgtattccccttttccaatcattttagaataggttggtacatattactcactccatcttaaaatatactccctccaccctattttaagtacaaccgtgggtttttttttccaaatttaattgtctgtcttatttaattttttttgtaaaaaattaaaaaacataagtcacgcataaagtactattcatattttatcatctaataacaataaaaatactaatcataaaaaaattttaaataagacggacgattaaagttggacacggaaactttgaatgagacaaatccgagcatgtccagattcagtagtaaaatgtatcccatctaatattagggctgtgtttagatccaggggtgtaaagttttggcgtgtcacatcggatatacggacacatatttgaagtattaaacgtagactaataacaaaacaaattatagaatccgcctgtaaactgctagatgaatttattaaccctaattaatctatcattagcaaatgtttgctgtagcaccacattgtcagatcatggagcaattaggcttaaaagattcgtctcgcaatttacacgcaatccgtatagttagttatttttttcgtttatatttaatattccattcatgtatccaaacattcgatgtgatagggtgaaaaattttaccgggggatctaaaagggcctagattgctatattatgagacgaatggagtaataatttttgcattcagaattcattctaagatataataaattttccacctacattctatttccaactaataccaattcttttattttatttttttattaatttttttctcaatcttttatatgtaatttcatcaattttcttaatattcgtgtccggttgaacggagctaataccagtggtaccacgagtacggaggtttatgccaagcatgttcacatgtcagctgtcaaagacgagacgtgtagcttaccttatattaggacggtacgtcgtcctacgtggaatggaagcagagatggacctgtactgtacacagcacaccggagccgattagcagcaggccagtctagtgtactcccttcgtactacgaaaacgaattaaccaaatataacatattcaaatataacatattctaatacgataaatctgtacacacgtatatttagatttataatattaggatatgtcatatctggtaatagattggttttttatagaacggaggaagtaggcggtcagcgctgggcgcatggctaaattggctactcctagtagggtgggtggtccgccgccggccggcgactgctccgccggaaggataccgacacgaccggccaccgcctcaaaagccgcgcgcgcaactccccctaccagctaccagctacagtatttccccatactcgctgctgcgcaagcagttgtactatgcttcgtaggtgcagcccatagggagaatgtctcctcttttttagtcttaatattttaactgctctttgtctctcaaatgtggatcaaattctcatattctaacccatattttttttttcaaattcaaaatcagataagaatggtgccgaattatataccacttatctcattttatgtcccatattatttcctatgtattagatattaactatggagaaacacttaaagtgttaaatagatacaccaagtaaaaaattatacaatattacatttgagcttgtaaaatactccctccatctcaggaaaaactaacttttgaagattaattgtgacaagtatttatccagattcatccctaaaagttgtttcttttggagacggtgggtgtaatgattaacatatcttttattatgtttgtaatgtttgtaggtggagttataatagattgttcatatgtgtttcataacataggatatgagggcatatcctaacccatattttactgcgtttcttttttttcctcccacgttcttcctatgagtctcaggtcgagcggtcggtcggaaaatacccttcccattttcatccatactctccatcctaaaatgtaatagttcttttaactacattatctttccaaccaattacaatattttatctttaaataaatttcacaaaactacagatactttggttaaattatcacaaaactatagatttaagaagatgtatcacaaaactacagatttagtactaaatttctcagagaactacagatttaagatagggtattgcaaaactacagatttagtaccaaaattatcacaaaactataggtttagtgtcaattcaatcacaaaacttagacatttataactcaaatataacactagtgctaaggatttaaactccaatagttgtactaaatctatagttttgcgatactccaccttaaatatgtagttctctgagaattttagtgttaaatatgtagttttatgaaacatctccttaaatctgtagttttgtgataatttgactgaagtatttgtagttttgtaaaatttactcttttatcttttaatttcctcacttactttagtttcttaaccaatcatagttctttttcatttaattttatcgatttttttaaaacctagtttgagacggagatactagcttggtagtattatttggcaccgtaaaacttgtttagcgcgtcccgtttcgctgtttttttttctccttggtctttagtgtcgaccttagttttttttttttttaccttaataggaccttccggtttatttgcacctggaagatcgaagaaggccctgctgcctggtcgtacgagcacgacatgttttggtacgagtaataatctgttgttgcctgctcgtacggcgtgtgtaggagtaataatctgttaagaggtaactgttactagtaattctgtccactggattaggaccaaattaccacacctgacgaagacacaaatctcttttatacaggtttagtattaattagtactcgtaggacataatatacaaaaatacctacctctaatacttatccccgttattatagaatcatatttttttctttatttttaatccactctttattttttttctatatgtgcctcagggtggctcattctcttgtccagagcgtttaataatcttcaagtcccatttacaatgcacatattctacagaaatcgattaggtttttatctggagcaattttaatcctacttagagcttacaaacttattatagtcgtcatgataattatagttttatataaaataaccgcaaaaaatatacattcagaacaacatcaatatttctcacacgatgacacggataagaagaaaagaaacctactcctaagggcatgtccaacaaaaggagcacccccaacatcccacatgagcaaaagtgatgaaggaccagactagggatatgcctcacattgtaagccataccatctcatttttacaattcagcacctgtcagtcggtcacattttgtatttaaacccttggattatttttattcacatataagtccaatatttcaagtataccccccagaaatcataaacatataaaaacatcaacccctcctctcctcaccatatttccccaatttctccggcggtctcttccccggcttcgcctctctctccctgcacctcccctccccgatggcgccgcctctccccggcccggccttctctccccatcaccggatcaagcggcggtggtggcggatcgaggcggctgctgcagatccacgcagcggcggccgggatcgagacggtggccgcggatccacgcggcggcgaccgggatcgacgcggtggccgacccatcgacatggcggtgcttggtatcgatgcggcgatggccaggaccacatcccatcaatctccgatgcgccgctgcacttcttctcccccaccggttagcctcgagctcgccggatccacacggcaacgacggcctcgaccttgactgtgatggcaatggcgcgggagctcgagttgatggcgagctggagcgacggcatggggcgacacagctacccaacacgcatcctggtcgattcctccgagcaaaaatgcgatgcctctgagaagggcgcgtggacctccagcagcattcgcgcacccctacagggatgcggctccttccgaggtgacgtgaatattcgctttcagaggtgtgagaccacgctccagggtggagcgctaggcatgccctaacatgtcttctcttgaattatgaaaaaaaaatttacagggtgatcatcatctcaatatgctcggtcatcactggcttatatagctgtgggccaccggatttcgcgaaattccattttccaccggtgcccgaaacgaaaggggctgtcagaatcgtaaaccctggctgtggcaatggcatgaccaaattgttagcttgcagtctcaaaaaaaaatgtgagcttgcaataagccattaaaacccactaatccagccaagtaatgccgatttttaccccacctggacctggacaaggtgcccccagatggaggaagccagagcaaaccaaaaccaaagtgggcaccaccagcatcagaatgccctttattcaagggggccccacattgtcagcagctaggctagtaacaggtcatcatgcctgaataggaagaggcaacaaccaattgccacactttcttgcacaaaaacccctgacagatcacaatatcacatggcaagtgtagcccaagaaaacccacaagaatgccatggagaagaagcttctgctgcttctctctctctctctgtgtctagtctaccagcttgctgtatattattaggtgcaacagggcagcaggcagtggtggccaacaatagacaattggacaacctgtttcctcctcttcggctctcctcctcctcctcttgccttctcttcttcttgttcttgcccaatcctagtagaagcgcctaacttgtcgtttgctgtggcttgggttttgagagccggaggaggcaggattgatttttccatgattgggttttcttgattgattggcgcctgctgctgcggtgcggttggtccaagaaccgggatttcccggcgcggaatccggtcatccaagaggtgagatgatctttctttccttgccctgcttctctcgcggttctttaggcgttcttggcgtttctgttcttcaattattattattactatttgttaattttgaagaagtggagcgggattgttcgcctgttcgttgcttttggcgagtgtagaatcctgaaaattttaatgaggtggatgtgagagtctgttctgttggtggtgatttttgtcccggccgtgaagaacaaccgctgctctactgggtggttcttgatttggttttggtccgttctgccagtgttgcttgttctttctcaactgcgaggtgtgagcatggcgttaaattccatcttttagtgtttatcctctaaatttctgaatttttgggggcggttggatggttacactccatcccgtatttgagggcaaagacaacttctatgttaaattctgttttgtttctctgtcaattggtcagtcagtataaatttggcccgttcttcacgccagtgaggcgaaaattgttcaatcggttcaatcttcagagaatttctttatggaaaaatcacaacttccgattagtggatcaagtctctttctttgcggtttttcccctgcaaatttttatgtcaagttttgaggcggtagcagcagcagtcgttttcagcatagaaatatgcacattggaggtatcgaatattgtttaatttgtttggtagttttgctgaggatattcacccaagaacatagtcttcccggtcagaaaaaataatctgatatattagtggcagtcctcttctgaagtcatctcagctgaaatctagcctgtttttcttgcgggtattttgtcgctggagttttaatttagaagtttaaattaaagttaaggttgtttatatatatacgcttattgctcctcaccaattagtacagtgaattaacaagccttaatttctttattaatctgatatacattgggggtgaactgctaaactctggtcaaaggctgcttgcctgaccacacacttctttttttctgcaacttgtgacaggtcaagtagtgcatgttacacggtttcttccgagtggtgcaagaactagaccttgtttaggcttaacgtctgatttgtttttttttaacttagaaattaagctacactaaaatacctagtagtagcatgtttttggttttggtcggttgcacattgtggtgagacaggaagtgcataacacttttccattattagaaaaagattaggttgtttttggatgatttccttgattttgggggtgctaaatagtagtagtgctgtttgattacatttcgtcaaaattacttttttgacctgccttttgctgtgccatggccgatagccgtgcagggtttgtctgggctttatcagtgcacatatttttatggttctttaatctgtggttactctctgctagtggtttattacccagctgtaatcacctgttcatagcgtggagcgttttgttaatgcctatttaatggagtgattcattttactttcctgccatgtcttggtaactgcaagccagatgtagtagtatattaaaagtttcccctcctagttttgctggggaccaagaacattgtccagcttgtctaaataccaaaagaagtcttcccttgcaaagagagtggaagtgtgttttgcactctgaaagtctagctggcatattctcatgatacttttctcaatttctactccattccaggtgcatctgaatagataagaagagaacataatctttgggcattctctgtggttgatctctgaaaaaggtatcaaacagcctgcaaattaggtctcctgctctttccatcaaaatgtcaggtatcattttttttcttatcttatttatatatttgtgatgggttgctgatgaaatggttgctcattagtttactaatgggtgctattgtgctttgtgtgtaaagttcggcgccgatcagagagtatggagggcctgttctcgtttgacgagaggaaagatcgaaggtcagatgtggagaactcggaggacgagcggagaaggctatccattgggtcactcaagaagaaggcactgaatgcatcaaacaagctaacacattcactcaagaagagggggaagagaaaggtggagaatcggccctcattcacaatcgaagatgtcagggatgaagaagaggagcgtgctgtcttttccttccagcaggagctttttagcaggaacttgctgcctgacaagcataacgattaccacatgttgctgaggttggtgttggaacaatgctgaaagattgagagctactgaagcatgcagttgtttgtttctttctttcttcctttctttttttcttttgtgctgaagctctttctagttttatttgcaatatgtgtctaaaagttgtatgccttcattatctctataggtttttgaaggctaggaaatttgacactgagaaagccattcaaatgtgggctgagatgctccagtggaggaaagaattcggcgcagacacaatactagaggtgaggctaaacggctaatgctgctattaattgatacataaaaattgaaaatttaacttcgccagatacttcctgaaggatattcaaatatgttggtccatgtacacattgttttgtttacataaataggagattccatctggcatcttaaactaggagtgctttaaggtatagactatagagtgatgagtagtagtacgtattttatccccaagctcaaatcggtttattttgaaaggataactgatgtctacaaataaatattgcaggacttcaattttgaagagctagacgaggtccttgtctattatcctcagggttaccatggagttgacaggcagggaagnccggtatacatagagagactaggaaaagttgaaccaaataaactgatgcacattactacagttgaccgctatataaagtatcatgtacaagagtttgagagagcattccatgaaaagtttccagcatgctctattgcagcgaaaaggcatattgattctactacgaccatacttgatgtcgatggtgtggtatgctgattcttctcatatctgaaatcacatttgtttgtgctgcaaattctcacgaattattttattacaaactgtaatcctaataatgttcctactattcattgccaattctgttgcagggtctcaagaacttcagcaaaacagccagggacatgctgggtagaatgcagaagattgacagtgactattatcctgaggtatgctacttttgttaatttccttgatcaatccaaggactaagtttggtttacactttacctgtatactcagacactgcatcagatgtttgttgtgaatgctggtaatggtttcaaactactctggaatacagtgaaaggcttccttgatcccaaaactgcatcaaagatacatgtgagtatgaatcctccctggagatattccttttcctgctcttgtccaaataaatatactatattttaatggagcttcgtttataggttttgggaacaaaatttcatggaaaactccttgaagtgatagatgcaaggtaagctttccattcagaaacattttatatggtttcttgatcataatgattttgtcgtcatgtctttgatttaatgcacattgttttgctatttacagccaacttcctgaatttttgggtggagcatgcacttgtgctgctgagggaggatgcctcaagtctaacaaaggcccatggaatgatcctaacattatgaaggtaatttttgttgatttatttcctaaaaatatatgtgcttcttcttagtaaggtttaatagtggttcaaaatttggattatttttgttgcttttgaattgtgacaagtgacaatatgataatgcctagttgatttagattacttaacttactacataaaaaccccaatatctttgttctcggcatgcttaaattataaatagaacatgttatataatcaatcattcaggattctctctctctctctctctctctctctctctctctctctctctctcttctgaagaaagcacacagatctccttatctagttcaaacaatattttcaaaagaatattttttttccatacatgttatactgaagtttatagcagcatcct

SEQ ID NO: 82075 - DNA, 2928 bp, Oryza sativa
ccggtggtcgccgacggtaaccatcggggcgcgggcgcgccgctcccgtcggccgtgccggcgagaccgctttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagttatttagtgtttaagccttttcttttccgttggtcgtgtagacgctgcagcttcggaagatccgctcttcgtggaagttgaagccgacgtttgggaagacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagagcaaacaaaaccccaactagtggacactctactcatagtaccactagtataattttaggtagatgcttcgcaatctaattaggtaaccttaggtggttttataactatagactttgggaaatattcatatcacctggacactctggaattgttggtttattgtggaattggcttcacaccgctctctctattcaaaagtccccaaaatggttttaggctgggctcggggtgcatggtttggatggtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatagcacagggttggtgccctgctgctaggggctcagttccgtctgcctgtcccgggggttccggccgtaggcgggattgggtcggtactcttgtctatggctaggatgggttggaaactatgtcacgtcttccgtctgtataccgtggtggtatgtggcacgtggatacacgtgagaaagacgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcggcttgccagttcggtctgaatcatcgtaggccttgggttaaggcaggttcgtgtgggttcacggccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcgatattttcaaaataaaaatctttggttatttgtgaaaattgtctagtctctctctgtcttgctgcttcatttatcgccaaaatctgatcttttaaatgttgtttctctttttgtttttgtttgtagatggccggcacagtcacccgtcgtggtttggatatgactggcttcgttttggagctgcgaggcatgtgcgtggtcttggggtatccacatggagtggactaccaggccaggccacttccggatcaggagggtgaggatgcagagcctcacgctggttgggaggtcactgcagtgatcctctctggctctcctgagcggacttcgctggcagtcaccgcgggtggagactccttccccgccgcttgccagaacgccgctctcctcgccatcggcacccttcaccagcgctacccggacgagttgcagcactcgccctaccgctactaccctcgtcgcggaggagcccgcgactacgccaccttccgagatgctagctcggaggatgacgctaccgttgtgcacctggcacgcatggtggaggcgtacgacgcggctcgtatcgacttccatcagatggtgcgccgcgggatggttgagaacaacatgaagatcctggggctgcggcaggagaacctgcagctcaagaaggacctcgacgcgttggaggcgcagctgcatcagctcaaggtcgcccagggtgaggatagccgccccaagcgtcgccgcgtctgccgcagccagaagatcaccgcccgcaagagcacct

SEQ ID NO: 82076 - DNA, 1161 bp, Oryza sativa
gacgaaattgaatataacgtgttagttcagttaccctgaattatttgataatcaggagctgaatagatcacttgagatactgacataagttatatatgtttgatgcttctccccatttagtaatactcctagtacatgcttaattctaaacttgtcaccatagatagttgatgccttgtatggccaaattagtggtgttgctagcatacaatatttggacaaacaaccttacaaaatactggagtgaaaagcaatgatattgtccatttcacttgattaaagtggtgtccttgcacacagaattttagataatatggttagttcagttaacctgtatgatttgataatcagattctgcaaagataaactaagaagcatcttataaactatatatacgtttctcagcatcatggtagcaggtgccaggacatttgggtttttggtcatagcaatttaatttctaggtctaaattcaggtatatgaatatttgcatcctaacgacattaaaaacagtgtgcgtgtaaaaaactaaaaattgaacaaaaggtttataacaagtgcgataacatttactcccctgtgctcccccccccccccccccccccccaaaaaaaaaaaaaaaaaaaaaaagctcctagcatcccaatgtggaggtaaatgagttggtcattgggtaggtaaagggtattgaagggataaaatttctcaatttgagaatcgctggtaggtaagaaggtaggaactgatttattttgggacaaagtttgaactctagaagttggtttattttaggatgaagggagtagcattcaaataatgactgtgcatgacgtgatattgcagacagttgttgggacaacagctttctggtctggatgtagaagacttgcaaaatttggaaagtaagctggagatgagcttaaaaaatatccgtctgaggaaggttaaattacaatttgttaacagtccatccacttctaattcttccttgacataatatcaataactactttgactaacattcactttacaggacaatgtcatgatggatcaaattcaagaattaagcaggaaggttgttaccacttagcacattcactcaacattacttatgtacactagtctacttggtccaaatcttattggagtgagataatttg

SEQ ID NO: 82077 - DNA, 8934 bp, Oryza sativa
caagaaatggaggttccatatagtgaatagcgatgcactaccagtggttgagctagggtccccatcgttcttaggcaattaagtagctctttactaatgaatatgaatttgcctcaattaatgtttatttttagcaaagttgcttattcgagggttgaccactatgacaataaaaaatatttccttagagaagggctgggcttgagttaacctatgatccttatatgaccccttttttataaacgcatacaagagtcaaagatgatagacttgtacctgctctattgctcataacctttttttctcccatcctttcgtcaaaacaagcaggtcgagtttcgagtgcaaagcctatcgcctctaacttttagtatgtcgatgggctatacccaacaatggtatttctatagtattggggatattagggggtgtttggttgattgcttcactttgccacgccacacttcagtcatgccacagttttttagacgtgtgtttgtttcaatgcgacagttgtgtcatgccacactttcctacccttaggtcccacatgtcatactcagataactagagctaacattgccacacttgtgactaactatttcttggccatacttttaccacatgccacaacttgcctaagcttagttatggcaagcttaggcatcaaccaaacaacccctaagactataggtatacatgagattgtagtaaagagatggaagacaaggattattatatagattcgagctctctactaatgggtaacagctttactcttgttggctgaagccggtcgtattgctattatatatcacaatctctcacaagtgcaatagagaggagaacctaatctagtatgatagtatagcagcgtaaatcgaacaggtggtcgacggctaagctgttgttggctacacaagtactcttgtatagtgtatcccgtatttaagacactgaaataatcatattttcgtcgagaagaacgtgcaaggaacgaatcgtacattgagttcactaggcaaaatggcatccatgccaacgactaaggagaagagtgtttgaccaatggctatgcagattgatgtccaataagctagagagccttgtcggagcgattgcatgccaaactagctagcctaggaactggctgatttgccactgtgcaccaggccaccaaaggtggaggagctagctagagaatattaattaatatataatatcatatgtgataaaatatgcaagtaccacctcatcagttgtagagctagtaaagctactatctttgggaacctatggaagctgtagattgtagaatgtgctccataaatcctccacatgcatgcattacgattatcacaatggggagaatggctctgacatcccaaaataatactcatgatctcagcatcagagtagtacataaatgtcaccagagttaaacaacaacacaatgtatttctctttctcatgagcacgattaattcataagatactttttaagctagacacagataaaacacatgaagaatttaaactagcccctccaattccacttccattgtatcccggccgagatcgattatacatgtgtacacccatacatatatctatcaccccattgtgcactgaaaggtttagtactagtaaaaacctctcaaagcacccaacacatatgcaacaaaattaagtaacatccaaacaaataaaaacatatatatatatatatatatatatatataagggatacataaaactctccctctaccttggaaatcccatgtttcaaattttctccttcctttaattttgatttccctcatgcacacaccataacaccaaaaagaagatccaaactctaagttttttttaagtcggctatatatagctttataactatactaatataagttgagttgcataagcaagagcatggatatttcatgctacttctgatgaggctgcaggaattaatggatggatcgatgatcgacttgagtttttaccagccactagaattgaaggaaccttgctgatcatgtgcactgatcatccgctgcctcttgatgctcccaccgccgccgccggcgccggaagaggaggtgtcgctgctcgccgctttgcggttcatgacgccgcgcagcgcctcgtggatcgacgcgacgagctcgtgcctccggtgcgaggcggcaacgccgtagccgtgttcgccgtcgtcgtcgttcccggcctcgtctggatcttcctcctcgacggcggcgatgaggaggacgctgcggacgcggccgccgagcgtggcgatctcggcgcggcgggcgcgcagccggagcgcggcgagcgcgcgggcgatgcccgggatgaggtcggcgcggtcctcgcagcacagcgaggccctcgccacgagcctccctccctcgtccgccgccgcgtccacctccagctcgtcgtcctccgtcggcagcagcaccaccggcgccgccgccgcctcccctcccgcggcgccgtcctccatcatcgccgacgtctgccgcttcagctccttgacgtgctcgatcacctccgccagcagcgacgccttgtccgtctgcaaacaccacaaaacacacaaacaccaatcagtgctcgatccgtcagctcagctcgcgccatcattagagaggtctcaagctttgggcgcatgctgcagaacacagcgtgcagtggctggcactagctaagtgtagtggaggtagctaggtaggaaggagaggagggagaagagacggggaagctgagtagtagtagtggaggaggtgcatgcgaggatggaggaaaagctacaaaaatcgcgggggccgtggcgcggcgtggcgtggcgtggcgtggcgcagcctttgcatgcgcgcgcgcacggcgcggcgctctggatcgccttttggggagcgcgctctggcacgggcgtgcgcgcttgtcgcgccgcgccgcgcgcggcgagagcgagagcactctccccgacgaatccaaaggcttctctgctgcatctgcatgcgccaaactgatctctgcacaaattccttcctttattttttcttcttgtccatgtcagtgtatcagcatgcaaatgctctatatctatactactgggtgatctctacattggagcttagcttttggctttggtactcctatgcccaccacaccttgtctcttgccccccttaggttttggcttaggttacttaccattatgaaaatatggacattgtttgattggaacgcatgaattttacggaactaaatataatataattgaaattgtcgtgttttctgtacaatgattaatctttgatctaactttacacgattatttacaattaaaattgttgtgttttttatgatgattaatctttgatctaaaacgcatggattttacaaaattatgtaccatgaaaacaaggttgttttatgtatgatgatcaatattgagttcctttgaaaagagagagtgaataggtagcttaagttttgtgtttgtgagagggtcatcatatatggtgtgacaatataattgccttggggaaaataattgaacacagtacatgagatggatcaaaaggcaaattaagataggaaagaacatgcatggttcctttgattcaagcatgtaatcatgctatgtgggttagttttgttgcaagacctaagtaagtacatgtagagttgcctccccaagaagctacctaagctaataggcagctactaagctactagatctgacttctcctttgctcgtaccacttctcaattaagtttttaattggtctgtttaattacttcgatcatcgattgtatatttttgacttggttataatcagtagtatatatatctagatcttctgataatctgaatcgattgtgcatcaaaaccatgcatcccagtttggttagggtttggacatgagcatgtcgaactgatgatcatcatccataggggaagaaggaaggtttggttagttaattaattaattcgattagtgcactgtgagattgtgagaagctgcacatgtagtaatatgtgagaaataatcatgtattcatggaggagatcgcctgaccttggtggtgttggggaggaggctgcggagcctggcgaggtggccgttgatgcgctggcggcggcggcgctcggcctcgctgtggctgcgcgacgccgccagcgccttggcgtccatgatctccttcgccgtcatcctcccgagctccgcctgcagcgtcccgagcagcccggacaccaccatcctcgacgacgacgaacccccgccgcccatctgcatcatcgtcatcggcggcggcgcctccatcccgtactgatgatgatgaggatggtgattatgccccgccacgcctccgcctccgtcgaagtagaagggctgctccaccggcagctgctcgccggcggcgaagggcgccgctgccgctgctgccgggggcatgtagagcggcgcggccgcggccgagccgggccacggcaggagagccgtgccgtcgccgccgcctacagcttcccacatctccaccacaacaaccaaaccaaccaatcagctgatcaattaccttcttggatcgatcgagttcttggctcttcttgctgatgcttcttctttcgttgagctaattaataaactcgatcgtgcgcatcgatggatcgatctatgcaacaaccttttcttgctttttcttcttctactactactacaactcgcagcagcagctgttctagcttttcatcagtcaaagggaagaagggggggttttaaactgatgggtgtgtcgagtcgacctgcgcactgcgcaacatggaatggatagcttttttctttcttccccaagtgtggccttttcgcattcgcaccggttgtcgggtactagtggtagtggtggtcgagagagaaagagagagtgagagacggctaagctaagcatgagctagctagggctcctcaactcagatcgtgtacggcactggagctcctctctgtctgcctcatctttgtgctagcttgcagttgcagcttgggacagatagtataatgacgcttgattacgctgtaatgtaaagggagccacgtaagagaaaccagtccggtttagggatgtaaaaagtgtactggacggtttcgagagttcaggccatggagcatccagtttggaagcttatagggtctgtttgatactcaggttgtgttacagctctatctcttctcaggttgtgttcttctcaactttcccaacctctctttctacagctctatcttctttttttaaaaaaaaaactagtaatgtaacccgcgcgaacgcacgggaatgtgtatttgtttgttctaaaattaaacatacctagcaaattaatttcaaatttgtaattaagtcagatgtttctgaaaacgggcttatagaccttttcgtcttatgaaatcttataagaatttattaataaatgtattatgtgtatcatcaagctacccttcccctctagttcagatgtgtaggcatctgtctaaatttttaattataggtgacttttaattacctaaaatattatttgacaaccgatattggtaatcctttaaaaaatgtttatttataaaattatcaagatcaattctacaatgtatgcattagagagaaattaagttgcttagatatctaatagtgtgttatagcgggtgtaaaataaggtgtatttttaattatgttgcttgaaaggattatggtgtgtaccttaactatcttagagaaaaaaataagggaagatagggcaatagttgcgtgcggagaaccagaggcaggcacgtgtccattatgagaggaggggatggattagagatttcttgaaacttaaatctaatggctccaaataatggatacacctatttagtgaaaaatcaaaagtgagatattttcttttttctcatattttttctaatttattagagtgccacgtgacagtttaagaacgcttttaggtgctacgtgttaacgtaggatcgttcataggaagtttaaaatacttttagtatataatagaattaatgaagtattggattcgatacatcaccaaaatttaggcataatatattttatcaagtttccattagggaaacaaactaaactaacccaaaataatcatgttttcatgtgtgcagtagtgacattcatagctccttatcttatataccatttcagggttacagccctacctttttattgggccacgtggcaccacaattagaactaagtttggattctaggatcgagaagcagccacgtatttgcagcccttccgtagccgtccgattataatcaatgatggtggtgcagcgagcatgattggcttccgtagccgtccgattggaaatcaatgatggtggtgaaaatccattgcaccgacgactcgtacaaaggggatcgaggataagattattattattattattattattattattttgacattttcacatcggtgatttctagatgagctctttgagctttgctggcatgggaaaaaacgaagtgggtcaaaagcccaaagtgaggtagggatagatgtggcatttatttacttgatttgaaatttaatattttcaataaataatcataatcgtgactctatatgtgctttaaaaatatatatatggttaaaacgtaatttttgatttatgagcctactgaacgttttacatgcatggtttaacacaggcttgtcaaacctgttctttataagctcgtattatcgaacatgcaaccaaaattatttaatctataatcctataaatcttcgcataaatatcacaccctctattttctaaatagacgacgccgttaaattttgacataatatctaaccacacatgtattgtaaaaaattatgtgttatttgttgtgactttatttttattattgaaaaactataagcatgacatatagcaccaaaatcgggaattaaaatatcgttcaaatgcacagaggctaactagcatgctcgccactttttttaggagtatattatatttctcagtcaaaagtaaaagaagattaacttaaaaaaaagagcaagggaaatataccacaactactattgaataccgaaaaatgagaattaaaacattgttaaaatgcatcatactacatatccaaatagtaggtgcgaggtgcgcggtgcgccaataggcgcaccaattttcttgtgcatgtcactagggtccgacagctggcactgccatgctctccatttgggaccatttccctcctccattccctaccattgagttatttttcagatcatttggcttccaaaatttctcatagtttttaagttggtccccctctcctctctctctaccttatagactgtgttcggatgttgaagttgggaactaatccctcacgcacgtaaaacagaacaactcattagcatataattcattaggtactggctaacttttttaaagaaatggattaacatattttttaaagcaactttcatatagaattttttttaaaaaaaaacacacctgccgtttaataatttgggaagcgtgtgcatggaatacaaagatgtgagttgggaacctcaagcaaagaactcagccagaaatccttggttacaatcagaggtattaacagctcacaaataatttcatttctcataccatgaattaaaattgatatcctctactaaccaattttacaagtatgtacttaagccgtacgtcggcaattccattctttgtgtattatgaaaaagtttatggtactaataataatgaatgatgtgttcaaatgggtattacagtatcatatccaattaccagcttggtgatgacaaaacagtcctattatatatgcagattaatttaagtccaaatccaatagaaacttagggacattataaaaacccacaggttgcgaatgcccatatatatctttttagcaaatctatctcttctccattactctttactcaacactcttctataattccttgattttgttttagcttataatcttgaatttgacttatctaaaaaaaatttattgagttatcttcaccattaagtaaaacctaaaaacttaattaattactaatcaggaaatgcatagtcctagcatgaggcttcctcttgggccttaacatgaaagtgagctgcaattttttttcatttcatagtatgtggttatttggcattccatatttaaacttgaggcctatgactataatatcgtaatgactgttacatacaccaattaatttgagacagacgacgagcactttgcttatattccaaaaagaaattcctgtgttcttccacgtatatatttttctctagccaatcaaggagtaattaaaagatttgacaatgatatatatcctatgtcggccggtgacccggtcggccggccggccggagtagcagcagctgcatgctgccgaccacgctgcctgcctgcctttccaatccgcgtaccgtaaaaagtgtatatttttggtttttcattttaacctttgactcttcgtattttttaaatcttttaagattattatttctattgttattaaattataaaacataaatattacttaatgtgcgactaatcttttttttataaaattttaaaataaaataaacagtcaaatgtattttctgtgagatggagagaggaggacacggagagaggaggacgtagctcttgaaaagctactgctgcattcgcttaccctagttctcaactccctcctctcgtttttcgcgcgcatgcttttcaaactgctaagcggtgtgttttttaaaaaaagtttcatattgatccattttttttaaaaaaaagtttatacttaattaatcacgtgttaatgcaccgctcagttttctgtgcacaggatatgggttcc

SEQ ID NO: 82078 - DNA, 658 bp, Oryza sativa
tgccagtatattgtaggcccataaaaactattgttaagcatatcaatgcccgtataattaaggcccataagaactctatatattgctattattcctatgagacaatcgtactgctcagatttccaaggttagtaacatggtatcagcatttagatctgatttcaaagacagaataatttggatcaggacaccttcctgtcctgtgcacttcattttctcctccttaatgaaatgacaagcagctctcatgcctcgttcaagaaaaaaaaaagacaggataagagtaaggcagctgaaattctcaccaattgctttgtcgcatcaaagggaatataccttctagctttgttctgtgtgtaccgcatgaccttgggaggcaaaggcaaagtcctacaaaatcaaagtaattaaagatagggatgtattgtgaaaagttcagtcatgaacatgaacattcatgtgcgaggcaatggaaccttgtagctctcttgcttatcttagctatagcctatagaagcaaggtgagcaaactggatcattttgaacccaaaacctaccctaactggaccaatcatttgttcttgtaagcttcatggacaggtttttattggcactgcttgtcaatgaatttgaattcagtaaaacaaactagattctc

SEQ ID NO: 82079 - DNA, 4671 bp, Oryza sativa
tcggtgaaaatgtaaacgcccaacaatggcgggataataagtcagccgtgcaggcggaaacatcagttggcggcggcgaaggcaaaccgggttggtgaagacgtagacgcccaacaacggtggcataataggccagccgtacaggcggaaataccagtcggcggcggtcgaggcagccagtcggtgaagatgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcggggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcgatgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctcctggcgcgccaactgtcgaaacatgatttcggcaataataaaagggggtagcatacgagacctaaaagtggatggatgcagagacaaaggatttagacaggttcaggccctctcaatgagaggtaataccctactcctgtttggggatttgaatccgccgggtgtgtattgatctgacgatcaggttgtctctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacaaaatgtatgctaccctagcttgcaagcctgtgaggcaaattgcaagccaattgtttgatcagcttatcaagcctgtaattgtaaagaaatgataataatattgtctgttgttcaccaatcaagagaatgatcaatctcctcatagatgaacgtggtttgtccttttgtttaggggaaaagtataactgtcttattgatacataactggagatggccacaggagaatcacgagaataagcgcaagaaatagtatcgtatagtccatatggcatgtatgcaggtttgatcatagtactcgtttacagaataatgtaggcactgtttttgcaagtgcggttcactagattaaatttagttttgaggataaatcgaaaataccttttcatggcacccaaacgaagccttgaatcaatgggcaaccttttcaacttgggtctgcgtggcaggccaaattggaaccttctgtattgtaccatcattttttacagtgtgcatctccttcgtttttttttaccatagtgtccatctccttcgttcttaagcacaataatattatcacaagcaatctttcccccgtgaattatcgcaagagtttatttatagttgtacccctttaaagaaatcatgatattgtaaccttaagaacgaaacttcctgataatgaggtgaataggcacgagctcgtgtgattgttccttgtatcaccagtttagtatccactatggagacaccattgtcacccttttttaccccatttcaactacaaacctattcgaataaaatgggtaatatagagatttgatgcatcaatttcattggactaacctgtttccacaaattttgtaaacgcggtaatcacaaggatatgtttggttttcaatacaatttcactctgcgtgatagattgtaaaaaatgggcgtcctggttaggtatttgtcgcgcccggaaaaagtgtctttttctgaacgctagtgtattaatccccgtcccagaaaaagccgggtacaccacacaaacatgatacaaaagacacatctttattatatcgttaatatttacattatttcaaaggcacttcaggcctgacaataaaaaataaacaacagcggactagcgggcctacggctccatcttcacaggcgctcaaatggggtataagccaggactccccacctaggacttcttctccaaagtttttcttagtgaaggggggaaagatagagcaagaatgagtacaaccacagtactcagcaagtcacaccggtagatgtattattaatgcaagggggtacaaggggtaataatatagggtttaagttttgcagtaaacaacatttaaaagtcacttagttgctcaaagctattttgtaaagacgatcctagagctacacagtattattaatcaaggacgtgaacccacacgaacttgccttaactcaaggcctacgatgattcagactgaactggcaacccgacctgggtcccagctcgtcccaagccaacccaggacaaccattccacattttagttgttaagcaaattttaagaattaaaccactaacttgggtacattgctaggcttgcctataaccgagggcgcagctattcgaatagattattgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtgaattttcagagcacaaataataattgaaaagaaataaaca

SEQ ID NO: 82080 - DNA, 1974 bp, Oryza sativa
aagatactgatgcctattagtagtgacagcgatgtagccagccgtgaagaagatagcatcagttggcgttagaacaggccagccgtgcaggcggtgataccagtcagcggcggatgcggcggccggtcggtgaagacgtagacgcccaacaacggcagcataataggctagccgtgcaggcggaaacaccagtcgacggcgggcgaggcggccggtcggtgaagacgtagacgcccaacaacggcagcataataggctagccgtgcaggcggaaacaccagtcggcggcgggcgaggcggccggtcggtgaagacgtagacgcccaacaacggcggcataataggccagccgtgcaggcggaaacaccagtcggcggcgggcgaggcagccggtcggtgaagacgtagacgcccaacaacggcggcataataggccagccgtgcaggcggaaacaccagtcggcggcgggcaaggcaagccggtcggtgaagacgtagacgcccaacaacggcggcataataggccagccgtgcaggcggaaacaccattcggcggcggcgaaggcaagccggtcggtgaagacgtagacgcccaacaacggcggcataaaggccagccgtgcaggcggaagcaccagtcggcggcgggcgaggcggccggtcggtgatgttctgactgatccattcctggagcgtaagagataagcttaaagccatgaatcccttttatgcatatctggatctggatcctgcagaacaaacatataggatgagtagtatctgatataaatataatacttgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatccaacgagcccccgggtgctaggaatcggcccaaaggcaaccatccattggcaaaccaaacggaaagcataggaggatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtctgcggcgacaaaggcggtcgactgtgaaagcgaaaatgcccactaatggaggcataatatgtcagccgtgtaagcggaaacaccagtcgacggcaacaaaggtgatccaacggtgaggatgtatacattcaacaacggcggcataatatgccatccttgtaagcggaggcaccactcagcggcgacagaggcaggccggcggtgaaatcgtatacacccaacagcggcggcataataagccaaccatgtaagcggaagcaccactctgcggcgaccgatgcatgccggcagtgaaatcataaacgcccaacagccgcggcataatacgccaaccgtgtaagcgaaagcaccaatttgccgctacggaagcaagccggcagtgaaattcttgacccccaacaacggcggcataatatgccaaccgtgtaagcaaaggtaccactcggcggcgactgaggcaagcccgccgtgaagtcgtaaacccccacaatggccgcataat

SEQ ID NO: 82081 - DNA, 6980 bp, Oryza sativa
ctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagacctttacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactctttaacagatgtgcttaagtccctagaagacacatggttccaccacacctggaaatatatggcatatgtggtataaaatccgagtaaataaactcataaaggatttaccaaccgcctgaaaatgaccacaatatataatcagcctaagccataatattggtcaataaaaatgcacacttactggcgaaaagcaatgatattgtatcaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctaaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatataaatagaatattgcccaccagaggtggcaaaaatattggtggtagtgaagatagtgataccaatcaaaagtactgaagtcgcatagccatggaggcgaagaaacagtcggtgatgacaaaagcaaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagtgggaaacaaattaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagatgcgcagttgtgaaaataaaagcactagtcggcgacagcataaccagtcggcgacggaagacgatgatgttcatcagtagtgatagctgtataaaccagatgtagaggcgagggcactagtcagcagcagacgagacgaccggcgatgaagatggtaaggccaatcaacactggcagaatcatgcagccatggaagtgaagaaaccagtcggcaaccatggcaaacgtaggcagcttgtattgaagatactgatgcctattagtagtgacagcgatgtagccagccgtaaagaagatagcatcagttggcgttataacaggccagccgtgcaggcggtgacaccagtcagcggcggatgcggcggccggtcggtgaatgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaaataaacagcagcggactagcgggcctacggctccatcttcacaggcgctcaactggggtataagccaggactccacctaagacttcttctccaaagcttctcttactgaaggggggagaaagattgagcaagaatgagtacaaccacagtactcagcaagccacaccggagatgcacaattaatgcaaaggagtacaaggggataataacataggggttatgttttgcagtaaacagcatttaaaagtcacttagttgcccaaagccattttgtaaggacgatcctagagctacacaatgttattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaaagatatgagaattcccaaagtctaaagttataaaaaccacctaatgttgtcctattaatcagcgaagcatctacctaagttcatactagtggaaccataaatagagggtccactagttggggttttgtttattctagggtgaacaaggtaataatatcaataacaataatagtatggtcataacaaaggtaaataggcatggctaaataaaacagtgataacgcgggaatttaaataaagcgataatgcattaatttaaattaaaaataatttcgtaaactgggattcaatatgctcaaggatgatgtgacttgccttgctcgctttcccaaacgccggcttcaacttccacgaagagcggatcttccgaagctgcagcgtctacacgaccgacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgggagagagggcgcgcggaccgggtccacgggagtggggcccacgcgtcagcctctcggtccacggtggaccgggagcacgcggctggcggcggtcggcgccgtgggtcccgcgcgtcagccgcgcccgcgggcgcgggcggctgacggccgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggcggtcttcggctcaccccgggactacaacgacgacggaaacggcggccgaagcggaggacggcggcggcgcggttcgggacggcgatgacgacggcgttccggcggtcggcgagcgaagcggaggggcggacggggtcgacgggaacgcggcgaagccgatggaggtggcgccgagacgggaggaagtccggagcgacgacggcggcgaaccggagctcggcggtgacggcggagagagaggagcacgacgcgagcacgaatccgacggcgagagcgagcggcgagcggcggaaacggaagagcgaagcacgggggacgattttatagcgccgagagggggaaagcgcggccggagaaggaggaatcggccgcggagatctcggctccattgaagaagccggcgaaactcgcgggattcaaatcggacgaatccgagggagagagagagggaaaagagggggaaacgggagagggaatcacggggagtgatttccccctctttaatgcgtgcggggatggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgggggaggccgatgggccgcgggggaagagagagagagagggagggactgggccgagccggcccaagaaagaagggggggaaagaagactttttaggatttttctttttataaaacccttttaactttgtttatttcttttcaattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcatggttgctccactggaccttgcaaaaacggattacccggttcctggtcctgcgctccatggtgtccaggattttcactggcctctccacataagtcaagtcttcgcgaacttcaatctgctctgagtcggcctgttcggatggcactcgaagacatttcttgagttgcgacacatggaacacatcatgcacgttgcccaaggaggcgggcagctccaactggtaagcgacttctccgcgccgagcattgatacggaaaggacccacataccgaggtgcaagcttcccttttgtctgaaacctgtgcacacctcgcaatggcgtgacccgcagatacacaaagtcatccactgcgaactccagatcacggcgacggttatctgcataacttttctgccgagactgtgccacctttaaattatcccgaatgattctgactttagcttcagcttctctcaggatatcagtcccgaacacttggctttctccgacttgatcccacaatagcggtgtccggcatttgcgcccgtacaacgcttcataaggtgccatttgtatgctggcttgatagctgttattgtaggagaactcggcataggggagactcttatcccaagtcttcccgaaatctagtacacatgcgcgaagcatatcttctaggatctggtttagacgctcggtctgtccatctgtctgcgggtgataggcggtgctgaaatttagtcgggtaccaagctcttcttggagcttcttccaaaagtgagaggtgaattggcttcccctatcagatacgattttc

SEQ ID NO: 82082 - DNA, 651 bp, Oryza sativa
atttaattgggtaattgatccatttaaatcaattaaatcaaataaattccaaggctcattatgctaggaattcatgtgtattcattcttttatgggatatcaatgggatgaagagttttgagaattaatccatttgattagggaattggtaacttatatcaattagtcctaattgatggatggttgatggttgtgtagtggaggatggttcatggctagttgatgacaattagttgctctattccttttcctattccatgagtcttactcttcatcttccattcctcttataaaatgagaatggatttgatctcccgcaagaatagtgagacacactttcatccatttcccaacgctgttgctgctacggtaatcccatcccgacgagtgtgtgcacacgcgttgggagagtaggcctccgaaaccacgcgctgctgcgacgtttgcacggacgggcgggcgatcaggtttttggggagcgcaacgcgcgactactcactgttcgtcaacatctacttcaccttcaccaatatgtatgaacactggagacaacggcaacactggatacaagaagaaggaggctcccgtcaacaccaacggaggcaatactacctcaaactccagcggaggaccattcttggggtataacct

SEQ ID NO: 82083 - DNA, 672 bp, Oryza sativa
gggatgatacactggaacacagcactcttacttgtgctattgataccatctggaccatgcgcacgcgaccattttgatactggccacaaaataatagtaaccacttatctgaacgtatgtactaatgcacatttcaatataataatcccatgacttaaacttgattttaaataaagagagatacagatcgtcaaacttggagacgtgcgaaatgctatatttataagcagacatacttattattgataaatgaatactgattttattaacagatttgcttcggctgaacaaatttttcaaaaaaagacatacccctacacttgcggaatacacggatcgatcgaggtgaacagctgctacgtggacggcatggatggatcgatcaatcttatgtacctgcgaagaaaaaaagttttttacgctaaggcgggaaagataatgttaagatgatgcgccaacgtatgtgcccaactaagccgtactcgctcggagtataacgtacggttgtctactgtacaagcgcatgtaagagtcgtacatacatatacgacatactctctccgtccaaaaaaaactcaatatagaagaagatgtgttgttagatgataaaacatgattaatacttgtcttttaatttttttcataatttttttaaataaaacgaacggtcaa

SEQ ID NO: 82084 - DNA, 712 bp, Oryza sativa
  unsure (1)..(712): unsure at all n locations
aatggttaggatgaagcctggtatatatctgaccgggaccaacgtgccatctccaggagctaacacgccggctccggctagggacgagtgcttggaggctctcatcctgatgggatggggcgggctgtgcgtcaaaccgcctgtcgccacctaacccacgatctgatcggtctgtgactggtcacagaccggataaacgagcgcgctgcattgcgttacatgcggcgtgacgcgctcgtccaaaccgcaataaatgtggttaggtgagccctgctatgctcacctaccccgtatacgcggcgcaaaacccacaaggggtcggggcgcctcggccctcggggccgagacgggagcggtccgacccctcggggagacaaagagaagggcggccgtatcaccctcgggtccgacccccccccccgagggggttaggccacgtgggtgatcgtgtctgcctcaagtctctaagtcatgatactcccggtcccatgtcaccgacagaatatatatcaaatcagtaattaaatatattttcataataaatttgtcttgggttgaaaatattattacttttttttataaatttggtcaaataaacttaaaacagtttgactttaacctaagtcaaaacatcctataacttgaaacggagggagtagggtaccgagctcgaattcgccctatagtagtagtagatctacccngaccatct

SEQ ID NO: 82085 - DNA, 977 bp, Oryza sativa
agctcactgtcggcgtcagaaactccgaacttggcctcaagagcatcccacatgtccttcccagaaggcatgtgcatgtatacgtccactatgttgtcagcgagtacactgatcaatgttccacggaacaggcaatctgaagcctcgaacttagcctcttcctcaagagaaagaggtggttcacttcgtttgccccgtgaaacatagaagcactgcatcgctgtcaaccacaatagtgcacgtgctttccatcttttatagtttgaaccatcaaaagcatgtgttttcagtgcagcagcaaagccaactaccgaaaatgacctatcaagtttttggattgttggaaatatagtcattaatcggcatattttaatccaaaatgttaaagcaataatcatggcataagcagtgtagggcgatcttaacataaccagtagcatactatgcgcatcatgaatgtcaggaacaggaacataacagtaacgcatagaggcatcatgaagaacaggaacaagaacatagcgcacatagtatagcgatagcgctaataatggaacaggaatagcgctaacaatgggaacaggaggagaagattataccccgagaatggccctccgctggatggtgaggcagaattgcctccgttgttgttgtcgttcacggcacctcctcctggcgcactagctccggctcctgttggcggcgcaccacctccgccatctcctccagcagcggcggcaactccagacatcgcgatgagcagtcgtgtgggaggcactccccaaaaacctgatcacccgcctacccggtgcagatctcaggcgaaggtgtggtttcggaggcactgctccttccaatctctcgtgcgcgcaagagatcagaagcgaggaagcgagagcaactcaggcggagaaggagaaaccaacaccggaaaagaagcgatgaaaacggatcgcactcgcggcctccttatctat

SEQ ID NO: 82086 - DNA, 7215 bp, Oryza sativa
ccacctgtcggcgaccccgggagaggagggaggagcggcttggctgggcctcggcctgcggccagcccagcagggaggagggggaggaaaggagagaatgggccagcggcccattcgaaaaaagggaggaaaaagaaaaagaaaaaggaaaaaggattttccccagaattaaaatattgcttgctcaattttaattggttaaaattatttctagggctctgaaaattccactaaaaatcctgtcagtgaatttcgacatgtagaactcaagaaaaattccacatgccaattccgattattaattgcattgatttaaaagggtttactcttgctttgcaccggtattttcttagggtcatttataaattaaatttaggcttgggaggagaacttcggggtgtgacaccggaccgccgacgccattgcacacggcttggcgctgcccttcaggcacgcccccagccggccgagatggagccgttgcggtgcttgtcgccattgtcgccgctcgctcactcgcccgggtgagagagccgtcaaagagagggaagagattagggttagggttggaaaccctttccccccaccggctggcgatttcatcgccgcaggatcaatccgagccgtccatcggatcggacagcaaagatcgaccccgcgtcgggacgtcgccttcataggccgcgccgatatgggccgcgtccgcctaagcgccgcacgtgcacataatgggccggtccgttttgggccggattttcgataagagtgggcctttatttttaatttattaagcccacgaatttaatttctcataatgtgttatatctttattagctaaattttatcctgattttagccttttttatgggccggctaaggaaatgattggccgcattattatatttaagcccgccatttaatgttttatttatttccataaattcatttatgagctttcttagctattttaaaatttctggaaaattatggtcaattatttgatcacttagaaaattatttctagttaaatggaaccaacgggaagtttggctagaaagaaattaatgatatgatattatatttgaccaatgttaatataatttcatgtcaatatttattaagattattatttccttaagccacttaatttatttctagttgaatggaaatttaactagaaagtatttatgatttcatgtcaacatcattatgatggtcatttccttagtatattaattatttatagtcgaatggaaccaacgagaaattcgactagaaagcattaagatgtgaagttatatttaacccactttattataattgcgtgtcaattataattttttattccttagttattttctaccaaacggtgatataattgaggaattaattttaagattattcataattatttatgaccaatggtgctttgactatgaaattttaagtttattttgcatatgatcgattaagccaatgtaaattaactttatgcaattggcaatgcttattatttaagatcagttgcaatactgagtaatttatttctagattaatggaaccaacgggaagtttatctagaaagaaagatgatttcattaagattgttatttccttaattatttctgcccaacggtgatgtaattaaggaaacatctaagtatcgtcaatcattattttcattttctttgtcattttggcctttacggtgatatgacttagaattttacttatgccactagtgcattaattcctccgtcactcgtgccttacggtgatatgatcaatgatctctaatttgttactaagcttaattcctttaccatttctgcccaacggtgatatggctaaggactttaatttcatgtcatttactaatagcattatgccctatatcatatctacctgattttggtaatttgatttaggatattaattttcagtaattcattattctctgccatttcataatcttttctaccctatggtgtttgattatgaaaattaagatttatttgtatgtgattaattaagccaatggaaattaattgcattactaatgtttaattaataattaatttttcagcattaggacaacttaaggctattcagcttcgtgatggatcaaattacgttgaatgttgaatggagaaataatgtgcttattaacttagccatgttggattatgacttagccataagagaggatcctccctaggaacctcaactggccgaagaactcaatataattgaggaagaatatgataatctcatgtgggcctacaataagaagttagccaactgggagaagtccaacagaatgtgcttaatttatgtcaagggtgccatctctccagaagttattggaggaatcattgactataatgacattaagatgtatctggcaaacattgaagaaagttttgaatttgcacctgacactcatgccaatatgcttgtaaatgagatgatcactagtcattacaatggcaaaagtggtataaggaagcacatccttgagatgactcatatggcaaatcaactcagatccatggatatgaaaatatctgatggatttttagtgcacatcatcatgagatctcttggtcctaactatgatccattcaaaacaaaatataatactcagaaagaggagtggaccatacaagaattgatcttacactccgtggaagaggaagagcgccagaaagctgaaaagcagaagattaaagaccggctcaacctcactaatgcctttgataaaggcaaaaaggtctatcaaggggaatcctctaataagaatagtgagccagagggtgagcagaagcaagaagggatcaaggcctccacttcagctgttcctttaagtacaagtccctactgccacttctgtgcgtcagatggacattggcagagaaattgcacacgcttcacagcgtggttagtcaagaaaggtataaatgaaattaaataaatcccttgtgatgaattttcccttaatacttagtgagtttgactcaatgccgatgtgcatgtttctaactcattacaggaaactcgcaccgtccaaacggtagcaaagaggggagtgaacactcagagtaactgatggagtgaagatgaaagtgaagtgttgttggagacctcacacttagtttcacagcaattgcaataatgtcttatttgttcactctattaagagaaactttactagtttaattttttaaattcatatgagaaacgggtcatgtccgttattttaccaaatagaacatgatacattaagtgtgataataaagtgattggtcttgtccttgtgcacgacagtcatatttgttcttttggatgatcatgtgactattataataattgcctgtaatgacaaaagatgagacatcattgaaattgtgacattgtaattgatgtcacatttctaggggaggttagaacgtctcataagttggagatattctttcccttggattgattttagtgaagttgtgcactaattaaacacagttttctattctagtagcaacatattgtgtgttttctgcctaacacattgatatggttgtgaaagacatgtcccaggatcgaattattaagctaagcatttgctaatggatccatactctaaaggctcataaaattaagattaattaagattatgttctggccagtatatatgtaaattagagccttactgagatcctggatgagggggactaaatttttcaatcaacacccactaagttaagcttgagtttatttgagtactatagtgagctataggtcttgttgtctcagtgacgcataatgttgttgaagacacattgccttggggagctattttatttaataaactcgtaagtaagtctcaaaatcaaggggagaatgttggttgattttgtcgacttgtgtcgataagggttaggagaggatctaaaccatcggtttccttatcctgacaagaaacaaactaagagataaatttgttttttatgtgatcggtacagaaaacagaatcctaaactaattgagataacccccgagccccaccagtgtcgcctatataaagaaagagaaggaaagaggcagacgaccaaactctctctctctctctaatctcaaaccctaattaatcgcccaatcgatctaggcactggaaggggttcgtgaggcatctctggaagaagaagaaagaagaacggtaatggcttctaactcaggtcagtagatcaattatttttccgcataagcaaaaggtgattgtttatagactaaagcttaagatcatgtaattagaactccaacaatgtactcatgtccttaatttgttttagaatccaaaatggtgcatattcatgaatatgaatttgtataaatttcttttccagcagttaacgtgaaaagcagtgtgcgaataaaaatgggggcaacagggtcatgacaaataaagcgcattacatcgcatattaatcactgcttgccagttgtatgggttgatgaataacacgtagcaataacaagtggtcatttagaaattattgctgccaacagacatgacgatagattgttgcgcccgcacaggcaatgcagaagttcatgacagaagaagcaaaacggaaatcattctttagatttatcatttatgaaagagtaaattttagaaaactgcaacgtagtgacaaaactatcagtttgctgcaacattagtgacctatttcagtttgctgcaataacagagtgtctctatagttgcaattttctgaaatttacaatacagctaacctgagcctctatcccccccaggggagcttcttgttgcttagttccctttatagaacctgaaaggaacataatgccaacggagtattctaatgcagccatataatagatacccagttttatatgtacaccaatacgggcaaatattcaagattacgttgcaccagttccacggggaattttgcaggagttagtttgagatatgatgcaagagcttcacatttggcttgtgccttacatgtcctttcagaatatctttcaatctatcatcactttctgatgatatatatatatcaactcataaatgtaagtagcggaaataatttgaccgaacagtgcagataccaaatattaatgcagtaacaccagaagggaagcaaaggcaaaggatgctcacaaaaagaaaagaagaagaagaagaagctattgttccttagtttacaaaatagtttttatgaggatatagtagatactacaattagtataacacaatattgcaataagataataaataccacaatggttatagccttgcaaacaaaattaggatatatggattttaggacccacaccagcatcaagctaaatggaaaagaaagttgcccatgcatgtaaaacttatggtcatggatttaactttttttattgggagtctaattctcaaagtattggagtaaaagcccagaacatggatttcactctgaatgcaatgatacatgaaatttttgtatattctccccaaaaggacgaaacagaagggctttcccagtacactgagatggcattctcccttgccatcccacgtcggcaaagatggaggacacataccgcctttgcttccggacccaccaaaatgaggttcttgtgtccaaataaggccaccggttcttgggcgaaaaagagggcgcgtgaggctaggcacagcgttgcttccgcgctgtggagcgagtggcgtcgccctccttcccgtgcccgcagtcgccctcaagcgcgcgccgcctagcccaccgtcgacgtcgcctcttgccgacgagccgcctagcctgccgtcgccgtctgcaaccgacgagccgccaagccctctgtcgtcgtcgtcgtcgcctcccagatccgttgtggagagaggataggagaggcgtcggcagtcgagggggacaaggagggcggcaccatcgagctgttgtcaccgccgtgccgcccagagctcgccggccgctccgaggtcatcctgtaccgccagatccgcgttgccggcctgggaggagagccgccggtcgtcggagcaaagaaggggtggtccccgtcgtgggagagtgacgaagatcagggtggtggtggggttgccgctcggactgcccaccggcgccgcctccgtccgccccaccgcccagcgccgtcgccgcccgggccctgccgcactccggtcgccgcctcgcttcctccgccgcatcgacttccagtgcctcgctttgttcggttcgactggtggagaagggatagaggagtgagagaggagagaaaaagtgagagtataaaaaaagactagtaggatccactcaaagggatatgcaccatggagcatgtagctaacaatgttcctggtgttcttgagctgagttatcacacgaggaacggtatatttttgcgacgcactcctaatgccctaaaagaggccgttcattagtacggcagtcatgtcgaataagctagagctccaacaaaacactaccatactcaattctttgaccccaattattcaaaagaaacatgaagcttcttccagatgcctactatgtggtgattatactaaccttcttttcaatcgcgaagaaaaatataatgaggtgagaagcacgaagaattcagctggacaaaacattatcacataagcaaataagttgagtcgtagcacttctctttcaaggttggtagcaagaacgcctcaagaactcatcaaaatttcaaggtggaaattatgagagccttctcctccacgggagcccagagcccacaagatttcaaaaccttttcagaaagactagagagaacggtcgtatacagtgggtgaacggtataggtacccttcttcgatagggtgccctcaaccaaaaccacagggctaatgtaggtaaaaaatccacacaattcaatacaagatgctaacaaacaaaaatgacttctcaggatggaagaacatacgtatgtgaatatgtgatgctcatgcggtgcagagatcaaaactcagcagtatggaagcacaggcaatataactcacgagttcagggctcaaaatattaattttattatctcagggccgtggaggcgaggtctttagcatacacatactaattacctagcaataacaccaaaagagtactgctaccccggtgttatgtcttcttaaaagaaatcatttggttttcc

SEQ ID NO: 82087 - DNA, 39594 bp, Oryza sativa
ccccattaagtatgtggatgcatagagattcacatatacatacgtggtttgctagtttagtcttaattgtgaattagctgtgaagtactcttgtttatattaggatattaatagattactgggtgaccttagaaactgtttgatacttttgatcagtacaagaattatgtgcctccactctaatgatgataattactgataaaaatgtcaatttggtaaagttaataagttatattgacatagcctaatgacccctcctgaatatgcagacttagccacagaaatatattatgttctttcagcaggcagtcacacaaacatactgttaattcttcatggaggcataagccttgacaaaaaaagatgatgagattgaaatggcatgcacgcattttatctccatttcatattgcataacacataaaaaaaactggtagtaaatttccagaataagtgtcaaggcagtaagttgatacaagattaccttttctgggatctgcactaaagaccccatcaacatcagtccagatagtgacctgaccagccttaacaagtgaaccaattatggctgcagagaaatcacttccatctcttttcaaggttgtaggaatgttttcaggtgtactcgcaataaacccagtagcaattattgtctcagctggctgtcgagcgaaccatttctcaagtcgtttctcagattccaaatagtcaggatctacttggttggaacctgtaggatttacaactaaaacttctcgtgtgtccatccaactgcaaggggttccagactgcatagtgtaagatattttggtgtaagtccatgtttttaaaggtataagctaggtaatatttttatatgagcagtgccttctgaatatagtaggtgtatttccatagagattactctaaactaaatgcaaatgcacaaattggttttgttgataataacaacattaaagaaccaaatggtttggtacaagtgtaaaactacacccaaatatttaaaataagctcctatgcacttataaaatagaatatttatttctcatgaataataatgttcagaaaaggagatcgagcactgctagttctatctcaaaaaagaaaggtgcatatagactacattcagctgtggcttgaccggatttccacagaagaaaggatgatccaatgagcaattattactgaagctactgtagtgtaaggaggttctatgcatgaattctacagcgagagtaattgctttgtgccatagagatgttaatttcttttagtgtgttcattgttaccttctttatggcaaatgacaacaattgagctgaccatatctctccatgtccaacaacaaaatctgagaaagactccgtggcatgcccagctgcaaaaagggaaatgtatcataactcagctaagactatatatctgcaatcaaaccacaccattggtacataattgtaaatagtcagcagttagcacagaagtactaagggcccatgtaaatcctctccataagttggacaaaataaaggacaacctattttactgaaaaagaaaaacatatgacagaaagataagaaaaatagggtgtgattaacctatgcaaattgcacgaagcattgcttttaggttactgacatccgcgtgcaactgagataagaatcttgcaaggtcctctcctccaagcagatcctttgctgctgccatatgcttctcgaaaacttcatcaagtgcagtgatataagaatcatcccttgattgagccttatttacaaggttgtacatcatgtcagtgactttagacattgcagacacaactaccagtttcctctcagaagggtcgcgaaggattatgtcagccacattctgaatcctctgggaggttcccatgcaggtcccaccaaatttatgcacagaccacatgtcaccttttggaaggtgagcactagcttcagcttgctcaactgaaacagctgagaagaaattcataaacttagatggcaatatattaatgatccacttctatcaatacaatgaacgaactatttattcctattttttgttatcttaatgagacaaagacaagccttctttaccactttaggggaagtaaagctaaaagaaaaatgtgatagtaacaataacattgatagtggttaaattgtatcaaaatcaaaacctgagatgcaataccaaaaatgagaataagtaccctgcaatagctttaatcaaagaacagttccaattgagtaatggaatctagcctatggaatttctccgtcaaaaaaggggtgaaaattataccacaatctagactagactaaaagtgaactgggagaaaggaacaaattcaacatagtgaaacaatggccatgaaagatgatagataatattaccagcagctggcttgagcatattcttcgaaacatccccataaagtcctcctggaaggtcgctggccctgaataaagcaaaagtagaaaaaaaaaagaggaaggattgattcattcactgaaatttcacattgcctgatggttaccaaagatgatatagaaataataattttattgaatgcagaactgatagagtagaaattgactagagaagaagaccgttaggttgctatattttgataagaagacagttatctgataagaatacgttaacattccgtaaggagtataactgctcaacagctttcgatagaacatacatgatgcaccaaatatgcatttccccaaattccctttagaaataatactgcaccacgctatcaatcacagctaagcgaaatgcacaacaacgaaaagaaaaaaaccctcatgtctgtgacccaacgccaactcacaacatgacaatttcagtcaagaagggattcaatccatgcacagaaaaccgttcacgatgaagaacaccaaccacagagagctccaaaacgaccatgcctgagtcttctcacatcgccaccgctgcggattcacacctctgcatatataaataatcaccagtcaggaaaccaacaaaccgcatcaccagaggggagaaaatcgacaaactggaaaaaaaaaccacggtcaaggaaatgaaatcgcgcatcctcgacacgaacaaatccacccaaaaaaaacaaataaaaaaactctggggattcgcccagggtaaaccaacgaggagaaaccgacgagacgtccgcaggggacgcgagaggcgcgcgagatgggaggagaggggacgacctgtgggagggggcggcggcggggcgagggccgcggcggggacgggccgcggcgaaggcggcggcggggtgcgggctcgcgacggcgaggctccacatggtggcagccagcgcagccgaaatgggtgggattagactgatgagcgtgacagcgagctccaaaaccctgctttaaccctatttgcattttttccgttttaccccctcctactttttgttttttaatatctgtgtttatttaaacgtaacaaacaaataactacttcatccgtttcacaatgtaagttattctaacatttctcacattcatattgatgttaataaatctagacatattgatgttaatgatgtctagattcattaacattaatataaatgtaggaaatgttagaataacttacattgtgaaacggagggagtatacaataatgagataatagtataaatttgtatgtctactctgaggggcgtagaaatcaaggatgaaaaatagaaagcgaagaaacagcctctagattaattcagaagttcaaattttgttgtgttcttccaatggaacactaagttgtgttattttttaaggcaatatagttatatagggttttttttctcaaatatcagcaacttgtactgtggtccattcaatgataccaatgggccatgggccgtggcaatggtctaatttacattttacttgatttttctctacagaaatctgattgatttctcggtcttcttttctttgcaacaactaaatttaaaagtgcgtgagctatacatatttaccttgtgtcgaaaatctgataaaattcctactgtcctagcaaaggcatgaatcatcttttcgattatattttcaaatatccgggcacgtttctgcgagtgctcatcttggtttcgaatgtagttcacgcgtacgtctacgtgcatgttgtcgaaccatttggctataggcggcagatggtttgtgacttctgtgactgcccctgaagacctgcaggacattttctgcggttggaattctgaaccatgtgctacagtgctttcagccaactagattaaccagagaaggcgaaagcaaaccatacttctccagcgtcatagtttgattcagaccagctacaagacaaattagttggtaatacaaaattttggcataaaaaactttcagccccagaataatatatatcaaggggctattcccgaccatgatatctgtatagtatagaaaacgttgatactaaggttgtatgagattgaggtaaagtaggtgggagaatggatttttatactggtttggacctcaggatagataataactctagttcactttatatatagctctaggttgtatcactttattataatagggaagcaaactagctaccaactactccctccatcccataatataaggtgtgcacgtatttcaagattcaacctttaaaacatttgaccaacacttagtataatatgaaatgaattttatttgttaaaaactatatcattagattgtgatttaaatttacttttatatggttataattttgttgataaaaattttatagtatataagaaattataaactaaatattagttttggagaccgtgctaactttgatcacactttatatatgggatagagggagtagtattcgccgtgaactaatccgactacttgaagtcgacggctagctattgtcttcctattggttgattttgcaatgtggcttgtggctatggcttttgatttttcgatgccctcccctcctagagaggcgttgtatttatataagtagacaacttcttatccaagtagaattcaaagagccctcgtaggatacgggcatataagactttgccttcctcatgttagaatccaatatcttctattcccgtggaaggagttcttgttcttatatacctttctgcataatgttaggtatgcaatacttttggtggtcacgaatctaagtataggaggtatatctaattcgtatcactggtagtagcccttgaaaacgaactcgagaaaacgagtaggtaaatagtccttgaacaagtcatctttcccagcactaggctagaaaattactgaattttgaatttggagtgaagtcagaacaccaccaccacagaaggacaaccactaaacttctgccaaatatttcttggcctttgttggaggataaactcctcgagcaggggatccctccttcttcagttcggccgggggcagtgaatgtagattgaggaactgggcgtattagaaagaaacaaggggggtcggggctgcgacctagcgggcgagacaggaaagattatacaggatcgggccgctaagaagcgtaataccctactcatgtgtatgatgatttttctgagctttgaaagtctctgaatctctggtgtacagactagagtcaagtgttcctattctcctctctcctccccctctcactggacgtccacatccttttatactccaaggggttgttacacgcatcggatgtgccatccagtaaaaagggcaaatattctctagattaaacgcgtgtcttgcactacagcttggaaatttcgatcatcggctgtcgagcgggccccatcaaatcatgccggctgacacaagccgatatggaggaggatccctgtcattcttcatttaatggttgtagacttgaggcttggatgtgtcgggaacgctgtcccgggcgctgtgtctctcgtcatcttgatgggacagggcgcacctaccgcactccgcatgacactagggcagaccacgcgtggcctgttgctgtctcgtccgttgtttcaaccggtcacgttcggtcaagattcggtcaggcgagcggcacgccacatttaatgtggcgaggaacgcccgctccgcccgcattaaatgtggttaggtgggcgcggagcggcgtccacgaatcatctttgcatggtggtcatgtggggaccaccccgaggggtcggggcagcctgacccctcgggttaggtacgggcggcttccacttgtccacgggcgcgaccccccggggtgagcgccacatggatgccaagggcggctcctgccttttaagttcggtactcccggtacccccaggcccatatcaccgacaacctttctcaaaatatgaatcatcacctgtggtttataaaactcgcttctgagattcatttgggttccatttgcaagtattgttgttcttcctcctttccgctcccaatccaccacaacgcacagaaaaaccctaaccaaaactttcccttccaccaccaagttcgccatcgatctcctacagtccaatgtcaacaaggcggccatggacaagctccagtgcgatggggcgcttccaaatgctcgggcgattgagcgcacaaaaggtggtaccgatccttatcctactattggaaaaatcataatcatttcttctttcgtcaaatgtggattctcttccttgattactgtgacctacacctccttcacttgaatccaaattcgatcgcctttcttaccatcatcacccacctatgtgaggtgtacctcggagcgcgaccctttctagatctatttagataattttacgaggttatattcatggagcaatcaaggatcacaggctgctatggtcttcgccttagagatgggatgcaggactgttaacaacggaattttgcatcatactcgaggcggatttggtgcagaatcgagttggattaagaatcgaactgtgcatcaactaggcattgcatcggctggaaacaaagttggagacagactaccgatatggcaagcaaccgatatggtttaacttgggcttgggttgggcctagattggaataaatgatattgccgtatagagattgagctcatttaaggcaattgtatctattaattaggatatttttgtcgatttaaattagagttatggtaagagttgcttgtattttatctttaggaaagtgtgagtcgtgtccgtaatggacaagttttgtactcgaggtataaatatgaaccccagggcattgtaataagggatcgaaatcaatcaatacaactttcggtgcagcgccaccctttttgttttacttttcgacaagttcttgcttcaagtcgaggcatcggctgcaatttctcgacaaaaggtaacttgtctcgatggcttgcgctatcggggctattatgtcgttttagatgtattagtccttttatcgtggttattgatatcatatatcttagttaatctagtcttagtatctcgatttagttctatcgactgacacttgttttagggtttatgctggtatcggctaaatcgtcttactagattagattaactaaggtatctaccatcctgaaaagtgtttaactccttgattgtttagactttatgcttctttgtatactttgtgatgcatcacccctagccgtatttagaattgtaaaaactaacctggagttaatcataattaaggataatatcggggtttcaactgatcttacctaatatgcatgatagcatatgtttcatggtctatctacgtatatttgctacttatatgattagattgttctatatagacgcatcaagttagattgatattgcccaaacttcatatctggtgatcaattcctatttgatatgtttatatagattaatttactcacataagtttatattggagtattagccagtatattatctatctttgctctaaatattgatctatcagctatttccgtaatattgtcttaaaataattcataaaagctaaagaggcagtattacagccgatagggcatatttagggttttgctttcattgactatcataaagccacagccgattaggtttacccgtatttgctgggtcctgacgatatgtcgtcggctcgattggccaattggctatcgttcatctaattacgtttttctgttttctcttgttagttgtagatcaaactagctggcacgctcttagcattagaggcaagccttagacctacactggagtgaagcgaatctcccgagtcgtcgtgttttacgtcaacagggacaagtacatcccctttaattgccccacctctaggaaagaatggaggaatagatggttttatctccacacagtgactgcctccccttgcctttccctccctgacttcaaagcaatctaaaaaaagttctagatttcgagtcctccaatcaccgaatccttaggaccttttgtaacaaagatcaaatactttcaagatcgtggtctgatgggatacgagatcattgaggatttcgtgtgttgtccaattcaaccgctctatgctcgtgcttatcatgcgtataagtacacaggagatgaagacacgacgtggatatagccctgggttacattgtccaatgttatcagtaggatttatcataataaaaacttttgttgagcactaatgttgacaatattggtgtagatctctccgatgacacagtgaagactcgcatcagcaacgtttcatacggttgcagctatcccaatcaacctcatttatctattttgggccacaaattggttaatccatctaccgcatagatcatccatcccacttggtgatggtctgaaagcaaaattaaatctaatatcatatttttccattggacaagcatcgtaagtcaatccactaatcatgaataccacaaaaacatagatagttctgatcattttcatccccctatgagtcaaattatcttctttaaaatactactacttaacaccccctataagaaaacttttgtagcttgccaaaactgattgtttagcctttaaagccattaaaaaatattttacatagaactctagttttctatttaacaaccactgaagactcctcaaacaaaaccacacaaacatttatgctgaagttctagtcacatgttataattttgcacatagcagttttcttctaattcacatatttgaacaacttgggtgtactcggttcgaaatttatctttgtgtttcccaaatatagtttatacgcaaattagagttaaaggctacactcatagttgaacttatatgagctattgaacttacatttctttagctttgtgaaagctccctccaactagccaacaaacagaggaattccatcacctaaataacaaataaaatttagaacacatgtaacattacaacctggaaaagataggaatgaaaatataggttgttgcggtcttgttaatcttcttaggcacttaggagacgagaatctcgaatcatgttgcatgttgatggataacctaacaaagcaacataaaagagggattgttctttaaatggaaaaaagatattaagttaaaatgtgatcacaacagaagttttttaagttaaagtataaatactttgaacgcattctcgtcggtcgtgtcatccccgatataaatcgggagcacgtcttcagagttgagtccaaggcggtcgagcatgtacttaactacatttcccttgtttcgggaatcctttaaatgtatctcgtgaaccttataaaagtaaaagatgtcatgagcttgctgtaacttttcctaaaaacaaaatgcaggagtagtagaacaatttagaatatatagaagtgttaatagttgtaacatctataagccatttttcttccaaatacatgaataatacatgatatttgtgcagttaataggaaatgatagccatgccaactaatgatgttagcggtagctggccggtagatatagacatttatcaccaaaccggggggcaaatgcccccttattagtctttactttcttattcttcccgagtatctctcggtttcacccatggcagttgtaaatctacaatcattaatgttaaactctactaatgacaactaatgaacttagaaattaagattaaatattaatagctgaacataaagttttgtaggtatctactatgaatatctctccagcagcccatgtcaaactcttgttattgaattttgataaaggaaatattgctatgaataataattaaatgtagcatgttagtcttattaaactaaatcttcttaccaacaatatttaggtttcctctcttacctttagttttgagtgtagactagtctgtggaaagattcagcgttgggaccaataaacaaagagtatggttggtatcgacaactacaccagatcactgcttctctcacccataaacctatcaaaaccttgtaaagacgagaacccaaaacaaaattgacactttaaatgtgtcaactctggtgtgcaatctactagcccatacattatgtacttactagaatctaataccttgaaggcattctcatcggtcgtgtcatccccgatataaattggaccttgtaaagacgagaacccaaaacaaaattgacactctaaatgtgtcaactctggtgtgcaatctactagcccatacattatgtacttaccggaatctaataccttgaaggcattctcatcggtcgtgtcatccccaatataaattgggagcacgtcttcatagttaagtccaaggaggtcgagcaggtacttaaccacatggaggtcatgagatgccacctccagccgccacagctcaagattgtgtagattattgccaatgagccagagctgcccgtcaatgtcagggaaggggtaagattgcacaaagaggataaagggctttcacctgcgcgagtagcaagaaggcaaggaagacgtcagtacatgccgtgggacgggcgcaactctagacgatggggtgggctggcgcatagacgggcaccaccggcagcgagaaatgtcgggctgcagcggctactcaatgttgggtcaaattctgttcagagttgacgataaagaagtaaaaaaatgatggtagtgctagaaattggaatggaggaagcttttagatgctattagagatttagagtaaaccggtaacttttggttctataaaacaaaaaacatgaattttcgatgctctagagccaattttgcctatttttttaaatggggaaagaaattaaaatgtgatcacaacacaagtttattagttaaagtattaatatctttaaggctttctcgtctgccgtgtcatcaccgatataaatcgggagcacgtcttcagagtggagtccaaggcggtcgagtaggtactcaaccgcatttccttgttccaggaattctttgaatgtatctcatgaaccttacaaaagtaaaagatagatgagtatacaagcaataaagtattttaagagttttttgtctcagaaaatattgttagtgtccttatactccctccatccacaaaagttacacctattacttttgtcaccaagaccaagaagaaattaaatcatcttggatgttacaaaatcaaggagtaaaagcaaacatacaaccaatgagtatttagattactccttgggttctaatcaaacatttaatttatctcttcatttaagtcttgaatgcataaagactacaaataggaacaacttatttggaaaaactcaaatgtgaaatatgtctaacttttgtggatggagagagtatttgtgtactaaggatcggttggcccactatataccaaatcctatacataatcaagcctcatatggaaggtgttccacataaggaaagataagcaaagtcctacttgacaccacaaggtctactcggatcagatccatacttgctccctaattctattttgacaaatggtatgtgagagcgtaaatacaagacccctaggaggaaaggagacaagcctaaacaaggtatacttgcttcctaattctattttgacaaagggtatttgagagcgtaaatacaagacccccaggaggagaggagacaagcctaaacgaggtctgtacgatccaactagcaccacaaaagacagcaaagagggatctatagccacctccaatctcgtcgagtttttgttcgaagaagcttacaactgctaaccgtcgaccacatattcaagctttacgctgctagagagactagattaagttctcctcgcaattatacctgtgagagattgattatataatagcaacaccggcttgtccatctatttactacaatctcgtgcatactttagtaccaacaaatctcatactctacaaatacggttgtcgggtcccgtcgacacgtaccatttgtcccttactcattctgagattttcggaattttgcacgacttcatagatagtggtctgaacgaggtactagagcttggaacaatgaagagtgaaattgttataggaactacaatttcaattcctctaagattgaaaaaaaagaaataatgacactcgagctctaactcaccttcttgtcaatgtttctttagtggatagaaataatgacactcgagctctaactcaccctatatagctttagtggcctttaccagagacgtaaaagcctgtaatgcaaaaggtagattcgaaatttcatatataacggttagaataagtagcacaatttgcaatttgcaaaaataaaaaaaaacatgagttataactcattaatagaagggagagaggcactcgtaggctgcaatggagtatgttcttccgtcgataggagtcaacaatgtaacattaaggatctttgaaaaataatgtattaagaaattttagcacataatcaaggtacaggatgctagaactatgaaatatttctcaaatacttactatttcactactacttgcgggctgcgtagttgctactcttttcaattccttcaaaacaagagtagtgagcttggtgtagtttgtcctaaaaacaaaatgtaggagcaatagaataatttagaatatacaatagtgttagcagtttgtaacatctattaggcattttttttccaaatatatgaataatacatgatatttgtgcagttaataggaaatggcagtcaggccaactaataatgttaggggcaactggcaggtagatatagacggggggcattggcccctagtcagttctacaccaagcgggggcaaatgccccttatcaatttttattttcttattctacctaagtaataaactcttcgttccacccattttacttcttacatccacccatgacagctacaaatctacaatcatcaatgttaaactctactaatcagagctcatgaacttagaaattaagatcaaatactaatatctaaacccgaagtcttgtaggtatctactatgaatatatcttgtccagtaggaaatcttgcggacagatcttctgctttgcttccaccatagtgatgagtgaattaacagccttgttaaattctttttaccaaattttgatagaggaaatatcgctatgcatagaaatcaagtgtatcatgttagtcttatcaaactgaatcgtcacgctgggaatctaaaagttgctagttataatagatgatggcttgcattctagatgcacatactatctgcacatcccctagagcatggctgatgcatttcttgcatgtattatagtgtcactgcgacactacccaattgcatacatatgctcttctgtgagcttagcaaatagattagcaaaggaggataggagcggatggggactccgggcacccttctccttccccttccccggcccgaggccggagagctcgccccgcgccgtcggccgcccatcactgcgcctggctcagcagtgcctcctccgttctccctccctgctctctctctctctctctctctctctctctctctcgtgcccttagcttttgagctagcacccgtagcactaccgaacgcgcgtgtacgctgccccgagcccctccgccgcccggcatggcctcgccgccattgccgtccgctcccggaggccgctgctcgtcgccggccctccttggtactccttcgtcccatccggcgccggaaacggattccttgaaccccggagatgctcccacccctttgaatcgaacccccgttgctccggtgaagtttcccccttttctcgccgctggcgtgcgccgccgcgatccgtcgtcgctggcctccctccagcgaatccgatccggtggctcactccctctcatccgtcccatcgttctggtgtactccctctctctcgaatcgtcgcgacgagctccggtgaactcggccgccgtctgccgtccatctcggcctccccttcttcctcctcccaccgacccacgtggctgccacgtaggcgccacgtcggcgccacctcggctttgaccgggccaagccggtcagccaccccctccctccgtcttccttcccatgtgcacggtccacggagagcctaacggctgcgcgtgggcctgccacccttcggtccacccggtgcaccagaccgtgcgccactcctacccgaaccctagcgcgcgccgcatgcaccgctcccacggtgagccgcgccactgacaagcgggccctactcgggaccctgcaaggtggactcggcccaccggccctccatcttcctcactctccccgtgccccttgggccgcctcttcgggccggccggcccattagttcgaccgagctgcgcctctcctctcgggccgcgcccaagccgcccgaggaagtctaaatcacatccctccttcaatttctttccaaaaagggtttaataaactattaaatcctttttcctttgattagaaaatcaatatctctctatccgtaactccgattgactccgttcaacttccagcaattccgtaaaattgagatctatctaatggcactattaattagtctaaataggatcttttgggtcttgtgtaggtttttaattgtttgcgtatagttgcggttaccggattttcgtcgatcgtggatttctcgaagattcgtgaagctcagtgaagaccttgagcaaggcaagtcaccctttgatcaattgctcctataattggaaaatcattattactttgtttgcaacttgcattattagaatcacacacttaatttgcttggcctcggtttgcgtgccaaaccgacggacctacccagtagtcgcactaactcctgtaggttgtactaccctgattccttgttgctccacccttgtggtacatcagtatccgtgctctctgagcgcgcataccaaatatcccacatacaccgttgattgtcgaaaacttgggaaatgggtttgtgaagccttgaaaacccgacatgtgatgtcggtgtgtttgaaaaataaaatgaattgtgaaaactcacgatgcgggagctgtggctacgtggcgctgtcccgtattcgcatataaggaccgattcctgtgggaaactcatcgagcataatcaaagtgcaaccacaaggtggaatgggacaccctggctaagttaactagtcggttcagggaaacctcacatgccaatagttgggaacgccggggcggggtcggttggagccaaaccgggttcctggtaaggcaagaatgagaagcttgctaacttaccgatcgagatggttggagtttgatttgtgaaaactaaaatggcctaaatttatgtgaggatttgatccttctatgtggcatgaggtatccctgggtcggtttgggaaaggctttgtcgcgaacctctgacaccggccagtgtctggagtaagttcgtgtattgtgggtaaagtgtacccctctgcagaggttaactaactgttcgaacagccgttcccacggtcatgggcggatgtgaggtggttcccgttgcgtagatttgattgcctgtgctttgcgaaaagttgttgtggaatgggaatcgtaaccagaatcagcctatgtggcagatggatgacctgagtggtcagaaacgaatctgtgtgattcgggatgtcagcgggcatcatagactaggcttcccaagtggaagcggattgctttgctgctgggcagctggactctgggagtccgcaaaaatgaaaaagactctgggaaccgcctaatcaagtgaaatagctctgggagccgataagtaatgatctgacccaggaggtcggtacattaccatttgagttgttgaaaagcatctcttaagtcgaatcaagacgcaagtcttcttttgacccaaacttaaaaagaaataaatcgcttagtgatttcaaaatgatttcaaataaaggatttgcaaaacaaccttgcctctcttccaagcttgcattaaacacctaaattcccgtgacttgctgagtacgaaagtactcgcccttgctctatataaatatatatagttcctccgccttgaagagaagatgaagcgaagtgaagattagggtttcgtcctggttcccagccatcgcctgtggtgttgggtgttagttcgttggttccgctgctgctgctgttggtgtttcctcgtccgtgtcgtcggttgcattctcgggctgttctgagctgcaacctaagttaaggtaaataagtcctctattttaaggattgcaatgattcatatttgtcaccgtgcgtaccagcgctaagtcctaggactggtactgagatcgtggtttcgtaggaagcggttcgcgccgttttcctacgacacgctcctgtcaggtgccgttgtacggtagtaccggattggggtgtgacaagaaatttccacaataacctaaaaaggtaaaatgaccatctaattattctgggtatgtagtctaaacaagtactgttatattatttagggtcttattgctacgagttctaataaagctaaaggtagcccaatgcatggacataaggactcggacatgaacttgaggtgggaaaaattaggaagtattttcttttgtgaatattcaaaaggcttgcatgtacacatgtcaaaatgtgtttgggacctggaattcgataggtggggtcgtggcctcatggggagctgtgttagtgattcagtgtaagattgcaaatagatgcggaggaatgtgcaagacaacagagttcacaaattatagcaccgataaaattttgagaatcggagatggctggagttgataaacaactcggcaaaatgatcaatacacataggtctatttaatctcctcaataatttgcatttgtcttaaaaaattaaaaactggtggatccacctacatatttgagagtcccgactccttttttttgcccttccctctttatctcaaaatttcgtcccccaagccggtgccaagtggcatccattactaactgtcttaccaacccttatagtcaaccgcctctctagctcctctgccttcttctctgaccgtcttgtgctagatatagatggccctcctcctgtggtaaggatgaaggcaaatagaaagcatgcgaatgttgatcttgcaagcggcacaactaggcaacagcggaaggacgtagccctaagcacaaccaatcaacattgatgccccttaagtgctttggtcaaaaaacaaatgaaaggagagatcaggaaaccgttatatcgatgtggccaccgtcctgaaacatccagatctctccctctcccccaagctccccccatctctctctccatatcaaggcggtgatgggccttgggaggagcccatcaacagcatccctttgtgagaagccattgaaatggcttctggaccgcaacaatgaatccttctctacctctccatatctccatcttaagactgtagtgggcctcggggaggagtttgccagctgtgcccctagggacaacgtcgtccctcgaatgctttggtacaaagtgaagagcagagatgaggagaggagaagaaaggaagggatagataggtgtaggaagatggtcataggcaagtaggcctaccattctttattattatttttgctgatctaacggccacttcatcatataaacaaaaatcacctcaatttgtgcaaggggtgaactaaatggttttgatagttgaagagggttcaatacccagttttaaagagtacgggtattatttgatgaaaacaaaataacgaaacacgaataacaggaaacccaatattttattagtcatagatgagtgtttacaaatagacggggttcccataggagtctgcattttgatttcgcgaggatagtttatatacatctgtatgacgtgcaatctgctgattcctggcacctagcaacgaggcgatcaattaattacatttgtaggaaaaagcctatcgaacaccttcgattaaactgtgctcatggtcatcgccttcaaaattaattgctcgtcgaaggttgaggttagtgtagatttaatggtgaatatagtgaatgtggaacgggtggttcgccaaaatctgaaaatagtacactatcatcacgctgatgtgtagaggaaattttgtgaagggagtgacttttgcctcgtcaatgccttgtcacgtactccagccttcatcaaatatggtctttgtggttgcttttgcctagttgtgccttgcaatggtgtatccatttcccatccattttggacgtgttaatagtatagtgacctagcctcgtcggtactcggccatggtttcatatagcatcgttagtgatcaacacaaggtacattttggtggttgcagttttgtcagcttttagctgagatatcgtcaggtcttgtcagtctcgcacatagtgtagatgatgattgaggccatttaatgtcatcgacactcgaccatgatgtcgatgtgtgttttgaatatgaacgccttacccttgtggctagcgttgctttttaaagaaacaatcttgttattttcaaggaagaattgctcccgtgtgtgaacatgaggcaaatatcacagtatagcttaatagacatgatcaatctaacaatagtgatcgactttgttttagtcgtcaaaagatcaaatagtacatctgcagtctgattgataggttcagacatgcttagtacctttgatcaagcaacttgctcaataacaccaaccaccggcactggaaacggatctcgtcgaaaccatcgccatcggtgtggatggttgtatttcgggatggtacacctcccgtgtgtgacacagactggtcatatttgtaatccttctaaagtcgaagggaatgcacctatgtataaattatggttggtccattgccaatgatacttaaactccacccaagtttatacaagtgattactcaaaacccgcaagatagattatacgatttaatgccaatgaggccagatgagccttgtatttgcccacacgtacacaccgttgatggtaattagctcaacgatgaacaatgatcatcttcttagtgaagactacttgatgagggtttcatcgtcgagattctattcctcaatctcttggtgaagatcagtagatgagaatttcattgccgggatcttgttccttgatcacttgttcttagggtgtgttcgctacggccagctcccaacgtgcacacagtacgtgcggaaaacggagcggtctattagcacgtgattaattaaatatttgctaatttttttaaaaaatggatcaatataatttttttaagcaactttcgtatataaacattttataaaaaacgcaccgtttagcagtttgaaaagcatgcgcgtgaaatacgagggagaggtgttgggaacaccagcatcaaacacagcctagtgaagtccggctgatgagaatttcatctcctgaatattgtttcttgatctctactatggccgtgtttagttcctctaaattctcaacttttcatccatcgtatcacatcgaaaactttcctacacacataaactaccaactttttctccaaactaccaactttctctcaacttcctaacttttccactatctaaatacagcctattaagaccggctgatcagaattttatcgccagaatcttattcctcaatatcactcttggtgaagactagccgataagaatttcatcatcggtttcctttatctctaagtgaagagttgccaatgagaatttcatcaccagatcttgttcctggatctattaatgaagacctaccgatgagaatttcatcgtcgggatcttgttcccacagcttgacttttctgttagccgggctgcacgcttgctcaacgctatggcatgtgtgttggctccctctacgtgccgatgccgggttacacaaatatatacgtgcaacactatggcgttgcttgtgctatcaatgatgaacagttgatgaagatgggctgtgtatatctattatggatgtagaggccagattttaatctattttcaaagaaaaaaaaagttgatgaaggccggtgaagatatcgttgctgccagtgacctaaaggatttggttttcatttaggctttgggttgagatacgctccggtgctctctacttgaagtattctactacaagtagaattaatctcaaccgttaattttataggataaattagtaatcttctaatatagtttaggggtaattttggcatgggatgttttcttcggttgttcgcatcaggtccgacgcatcgcatctcgccccgacgcaagcaccgcatctctccccgatgcaggttttcgctactcctcccggcaggcagcggcacgacgccgctgccagcggcttggtgtggcgaaatcctcaggtggccactcctcccactcctcacccgtgtatccgttccccttcctctcctctattccatgccggcatcccggttcgccgtcgtggccttccgtggaggagcacgccctcaccggcgccccctctgtcctctgtgagtggccgatgctagtctgcctatttgctcgctgtctcagtggtgaacatgtcttaaatttgcctgtataaatgcatatactagcttgtaaatggctgtgtataggaaaaagtacgaattacccccctccgaatcacaaaaccagatattcttcacccccaactatgcataccggacgaattacctcactcgacccaatccgcggtggttttggtctacgtggcgtacacgtgatagtccagtcaacattctatttataaaaaaattgtgagacccacctgtcatacactactctatcttctctctcactctctctctctctcttcctctctctctctcaccgtcccacgggtcagcggcggcggcggcgcgtgacgcggaggcagcggcggcgggggatgaggagctcggcgcggcttcccccctccctctcggtggcgtgcgcgcggggacgagcacccaacgaggcaaacatccattcctagatccactcgcccacgaccaccactcccccgtctcgctctcgctgttgccgtgctgagctctgaggtgagctgcttggtgggtggaggggtgggtttggtttggttggtcgctggttggcttggctgcgtaggtgcgcaatgcagtgagggaggtgggtaagggggggagggagagatcaggtcaagcgggattatagggtgcgcacagtcgcggatcgagaacgaggaggcggtggcgaaatgcaaggagcggaggcagtggatgaagtccgtcgtgcaggcacggaacgcgttcgcggcggtgcactcggcgtacgccatgtcgctgcgggacacgggcgccgcgctcttcgagttcgcgcatggggagggcgtgctgccgccgcccccgcccccaccgacgacgacggggccacgggggaggaggcgcgccccgtgggatcatactagtactgcagaaatctctaggcaatcaaccattcactctgtttttatttctggagttactatcaatctaaccatgttttcagatgttaacacaacgttattgttcagcaaatactcctcttcaccgagctggagctgtagacaggatctgaaatcttctgaattttatttagatattgaaatcttctgaatatttgtccctgtcatgtacagcacgagaagttgcagcaatggaggagacctcatcaggggcagcagatcgctctctgtatcagaaggcagcagcgatggttgcctcctacacggagacgtaccgcagcaagcccttgtccttctggctgctgctcgtcctcagcgcgtgagcatcccggcgtcgagcctcctgtcgcggctgtactacaacaacggcgggcagagcaagtggatcctgtcgtggtccgccgtcgccggctagccgctgaccgccactactggaaaactgatctttgctcggtcgcccaaagccacaatagtcccggttacaaaaaaacccggtttaaaaccccgcagcattatacgatctatagtcccggttcatccctgtcagtcccttgtcaaatgggcaaaccggaactaaagatcaccattttagtccgctgaagacctcttagatctttactcccaactaaaatcacgcatagtatataatctctattctctatcctctcccccacaccggcctcaatctcctcaacaaccggcctctcctctcctcagatccatctccctctcctcctccccctcctcctcccatgcccagcaagggccgcctcctccccctcctcccttcccgcacgccccttcctcctcccatgcccagcgagggccgcctcctccccctactcccttcccgcacgcgtcaggcggctggtggggccgcacgcagcaggcggccgtgcacgggccgagtagcgagcggcagcaggcggtgctaccggcatccattcttttttctttttttttttacaatttgtgattcactgagatgtataattttatgatttgttgtatggatctgagatgtataatatgtgatgtatttggtttgtgtgtaattttttaaagatttgtgatgtatttgatttgtgtgtacaagtaacttaagatttgtgatgtgaatgttttgggatgttagtttgatttggggagaagtagagagagaagagagagtagtgtatgacaggtgggtcccacaacttttttttataaatagaatgctgactgaactgccacgtgtacgccacgtagaccaaaatcatcaaggattgggtcgaaggggtaattcgtccggtatgcatggttgggagtaaagaatatccggtttatggttcggaggggtaattcggacgaccgtgatagttcggggatactagctcgtacctatattagagaatctatatttgcggatgttaaattgaactggagatctatcttaaaactgtttttttaggctgactgattgcggtggacgagagtcaatggctcgtttaggataatgataaattacgataatacccctacgcgaattattatctctggaacaagtatatccctctacgtttctactatcactaactcaggcggtaatagaactagatcttaaccatacgattaaatacgttaatggctcggattactttctatcacaaatagaaagcaccggagtagggctcgttttattaatatctgtagaatagaatatgtatgggtgtgtcataggtttaacaccgcacagggcgcttcatgcgtagcgcctggcggcggcatcgcgcatgtgcctcagtgcttctacgcgcatgtctcagcccctcgcgagcaggggtcctttgtataggcagagaatatggcaaaagtgtgtgttaatcctctattacattcaggtagtcacacgttataattcctttggataaagagaaaatctattatatacgtctgaaatatagctaacctcttatatacctttgaattttgcttccttcattacatacccacaaaatttgattttgattccttctatattccttccgttagttgatcattaattgaccatcccattgctataaaatgactattttaccctttggatgaacataaaaatttatgaattacattattgaaaatgcaatactttgtcgcatgaaactattatagttatgagtttgctatgtgatgacaaaatttagttttagataatgaaataaaaaaaatatgtttttattttattttttaaaaaatcataaaaatgaggagcattcatacaaagatagaactaccaatgctcataatattttttttatgaatgctttgaaaaaaatccattgtcctattataatttcaaataaaatttttaatttattttattttttattttcaaaatttatgtcaaaattttctatactagttatttagtctcattagtttcataaaatacacatactgtgtatttaaataaaattttcaatcgtttttcaagcttatattcaaacgtaaatcatcgagagcataaaaaacatttcaaccaaacataacagaaatgaaggaaaatgtaacggcaaaagtatagaagggatgaaatttctgagatatagaagggatcagctaaatttttcgatcgtcacctccaactttcgtccatcatccgcatcagacctttcgtcctacagcgcgtgcatcaaccatcgctagcgagtccgtgtcgatttggtccgtcgtcctgcctcatccgtttcggcgccatcctattttttttttttttgcctaaccatcatccgcgagacatgacagattagaatctgtgcgtgacatgaccaatcggacgtgatcggtcggacgtggccatgcggcgttaggctacccctttgaagttggaccccatggacgtctgtctgtcggaggatgctacgcgtcggacgttcgatattttgtaaatatcggacgcccgaccctacactgtcgtgcgcatacatatgcatatatacatgtgttctattatttctactctagttgattagctcgtgtaaaaagtctatatgcttgtgcatgcatgactgttgtttatactctagttgattagcacgtgtaagaagcctatatgcttgtgcatgcatgactgcatagttactatgcagtacttgtctcaacctactttttattttttttaaattaaatttccttttaaattaattatccgatttatgattcgatttcaccattaaactccttgcaattaaatctttacaacaagatctcagatggttatattttgatgagaaaaaaataaacattgtttcaccacttgtaaaaaaatgtttcaccacttggtcaaatgttccaactcagtctataaaatatttcagacaaatacaacattcaagaaatactaaatgcaacaccgataatgaatgtatgaaacattgagtccccatgagtgagacataaaaatcttggtcaaatgttccaatttagtctataaaaatgtttctgagaaatacaacatttagaaaatactaactgcaacaccaataatcactgtatgataaattatgataaattgagtctcaatgagttagacaaaaaaaaacttggtaaaatgttctaactcagtctataaagtgtttcagagaaatgcaacatttaagaaatactaattgtaacaccaataatcacggtatgaaacattgagtctcaatgagtgagacataaaaataaaaaaacaaatgacataaaaacccatatgaaagatataatatatttgcaaatatgaaatattattaaaatattttcatgtaattataaaacattaagttattacatctgaaacattataaaatacaaattggaacattgaaaaaacaatatgtgcaacatttacatatgtattagcgaaacagtactagttgacacatttaaaagaataaaaaatattttttcatcggaatatagccatgtgtgatcttgttgtaaagatttaattgcaacaagtttaatagtgtaatcggattgtaaattggagaagtaatttaagaaaaagattatttaaatataaaaatgtatacgtgcatcggtgcatgatttggtaaagtgctctacatagagcaagggagtagtaaagtgctttgcatggagacaaggcagcggatagaagcatgcatgtgatgagataatgttacgtccgatatttcattggagcgtcggacggccgatgcgaagcattttcactgtctgttcgatgtttcgtcatcgtaggccgtgtttagtttcttccatattctcaactttccatcacatcatatcacatcaaaaacttttctacacacgtaaacttttaacttttttttttcaaactctcaactttttttaaactttcaactttttttaggaattaaacacaccctaaggcttgtttagttggggaaaatttttgggttgagttgtcacattggatatgtggacacatatttgaagtattaaacggagtctaataacaaaacaaattacatattccgccaggaaacaacgagatgaatttattaagcataattaatccgttattagcaaatttttactgtagcataacattgtcaaatcatggcgcaattaagcttaaaaaattcgtctcgcaatttacacataatctgtgtaattagtttttttctatatttaatactctatgcatgtgtccaaacatttgatatgagagcgtaaaaatttttgttttgagaagtaaacagagccttagggcttatttggcacagctccagctccagctccagctccacccctcctggagttagagcttagccaaacagcttcagctccacccaaactgggagtggagttgggtggagctctctcacaaaatgtactagagttgtagagctgggttttggcagctccacaactccacttcagactcaactcctaaagttatatttaggagttggagctctaccaaacagtcctagtcctagtatcgaccgatcgccgccacagccccaccacctgccggctgccacggtcgtcccggcggctcccccgccgtcctacctcgctaactcgatctgtgcgctagctctgtacgtctctacctcccaacagtggttccttcggatcctcctagctagctggccagtccgggcgctctccccctcgatgatgccttcctgcagtctgccatgccctagcctctgcctcaccgcaagttctggcttgccgccgacgccgacgcagacgcagacgcagccaactgtgtgtggttgcgaattgcgatccgtcatcatcgtcttgactctagcacctgccggttggggcggggtaactcgatcggttccctcattccctgatctggtgtacggcatctcgattgtccttgtggccttaacacagtattaattctgtttataatgttatactgttagtattaatcttttctttacctattataatattataagaattataaagatgattttgtactcacccctcccttcatctgtcatctaacaatccatgcgggagtcctgatctgctcacgatttttttttttgcgtgcataatctgttttggatcaggctgtccatttccttgcttttcgtccatcgcgtgcaagagatcgtgccctgtgcgcatcagtcacccgttctagtgtgcgccggatcgtgctcgtgtgtctccttctcccgctctcgcgccagtcatcagcttgcatatagagtttggccaacctcgataatatctggcgcttgttcacataccaagatcttgtagccggcgcacggtgatcggacagaagcgtcaagcaacacgacgcggatgtggcatgtggccgtcgactggccgttgcgtaggctgtcaagaattttctgtgcaactccaacgaactcctcccggattcgggattcgttgtcttggccgctatttgcatcaccagcatctcgtagccaaaggtcttgatccctgttgttgacttcgcttgcatcacctaggtcactgccattgctcagtctcgatccatcttttctgtagcctgtagcaaaatatcgatctgatctgttgaggatgtgagtttgaagagataggtgcagcacattctgatgattccccccatatcaatattcttgttccaatttgtcttttcgatctaaagtctcaaatatagtgtttatctcaattttgatgaagttctgggcaaatattgttctcggtgtgtctgaattttgatgtaaaattatctgattttggtgaagttattgacaaatgttgttcagttacgtttagctaaatttttagatcaatctagctgtacaatttcaaattatgttcatatttaagcctcgagagataatgcaatgttcatggctacatctaatcggagttagacctgttgatgttcgtcattcatatctaaaatatgtgaaaattcaagttgggaaaaattcgtgtcaacgcacttttgtcaaaacactaccaaaaccataagttcttcatcagacaaatagggctaaatttacaaagccttgcatgtctttttaccactaagtcatcttaagaaaatgggagtaaacctgagcattagttcaaaaaccaagataaaatcataactgaacataaaaacagagttaaaaacagagttaagaacataattgcctattgtctttttaaccaagagtaaaaactaatgatgctacgttctgcattatgatatggtcaaccaaaatagccatctcccattgcaacgcacgtgcatatttacatattaagatatcaaaatttatgataattttatcatctctaagaagatatcggaatatatcatgttttctagtataatatttagtatctttagatactaggtatattaagatatcaaaatttctagtgtagaatcttgatacctccaagaatctactctgtactcttacaaaatactatagtggtggactggtggtgtactcgtgttgagtctgccctcgtaaccaccaactaacatgtaagcctgtgagattggtggatctcacataagcaatttaattgccagaaaatcgccttttcacataaatagaggcaaaatactttttttcttactaaataaataattgcaacgcactgatattttgctagttttcaaaggatcgtaaaatttttccacaaaattaagtttagagacagcttgttcgctacactattttttttttttggagatagttaccttgccctctagccactggcacttgtttgatggatgactagcaaatttcaaagtcgtgatctatagccgtcctctttccgtttgaatttggaaatgaagttacctcgcgatttcgtgaaatatggaggtgacattgaagagaaaatttgataggttgatatttatatgtgctccgttcatgagggggcagttgccgcgagagagatggcggcggcggtgctgaacgccctcgcgccggcggccccgtcgcgcagctcgccggcgcggacgcggcggggctggtgtcggcgatcctgcaggcggtgcgggcggcccggcggaaccggagggagtgccgcctcctggcgcggcgcgcgatgatggtgggcgacctgctgcggctgctgccgccggagtcggagacgatgcggcggccggaggtgaggcgggcgctggacgggctgggcggcgcgctccggcaggcgctggagctcgtggaatcgtgccaggagagcggcgccgtgcgcggcttgatgacggcggggaggcaggcggagcagttcagggaggtgcagggcgagatcaacgactacatgctactcttccccgtcgtcagccacatcgacatcacccgccgcctcgacatgatttacggcctgctgcttcctgcagactctcaaccccaccaggtgaggtgattgctcttcctaaatgacatttatcgaaaaaccggggttaaatttttagatatcgttgattcaattccacccctgattcctctatgatgtaaaattgttaatccctaggagttactgtaccattttacaatccttggtaatttctgaaatagaggaatgttagttgtgatgaaggaatcgtaggctcctagctttgccagcacaaccgtttgggggaattgactgacagagaaatgccaggggccttccgattaactccacaaggtggtggggcagtgggttaaatgtcctgggttcaaagcctcaccccttctaattatttgatattaggtcattccctattatttgcgtcttttttttttttggaattgactgaaaaggcatcagcgtgggatctgacagaaaagttcatatctagtggcttgcgaaatcctataggaggaagaggaggctactaagtcgagggccatcacaaagaagaccacattttggaggaggttaaccaaagagattgcctgtttgtctccaccacactgggagttcgccaaaattaagaaaacaattttgatgtccatggcatattagccaagcaacaatggcagcagtggtaccaaaaaaatatatttaagtgaactagtggcatgaaacagaatggcaaaattgcgttggcaaataaggaaaccacaaaccagttaatattcagaaccaaatcatgatttttttttctaaaattgtgcatgataaactattgtcctctgcttgattttcagtgattaacatcgtattgaactgtattccagatgccagaggatgcgccaggttcacctggcgaccattttgaagctgatgttaggttggtcagatgttaccaatgtattttgtaaatatgtgacacacgacagtgttcagatgcacatttgtgatatttttaaccatgcattgttgttcgaattgtattaatcatgcattatgtacagtacaatccattagaatcatgcttttccaaagtccacacagtaaaacaaacacattctcttgaactccaggataaacatcgttcatgtatttagctctgctagactacgaagtaacattcctttcttactctgattaagggtaaagagtttttttttctttctaaaatagtgaaaaggttttttcatactcatgtggccaaaaaaggaactctatcttttcatgtgtgtaactttcaggaatgtggagatcactgcagctgaggtaattccgtttgaaagcaatcaaactataacagagccttttgagttcggtgaacaccatgtagcaggtgtgtgctgacttctagtgcacatatttatttatttattttatttagatacatgaagtaatccaaacattaaacagtgtaaagtaaaaaaaattctaccagcagacttggtaggaattatgttggctaaaaaatgaagttctacaaaaaaaattcttatacatgaagtaatgcaaaaaaaaaaaaaaatggcaactgaattctgggggtccaaaaggagatttagtgtaggttttgacaatgtatcgaaccttttgttctgtttccattaatggaaattgggggatgccctcttgatccgtaaaggaaagtaatgcaaaaatttgtatgttcttataaataatgttttgggacattgtatctaggtcatcaggaaggtttggaagagctgctgtccaaagtgcagaggttgaaatggctttgctggtggtctcagcatgattctctaggttggtcacaaaagtcatctcagcatccaccatgatgcgcatccttgtgttgagtaccacatccgacatttaaaaaggattcaattattataactttatcctgttaaacataaataaactgttaaattctgctaaaagaaattttaatgcatgaaattaaccgaactccattccttttgacagagcgtccatcaacttatgacttattaaaggctgctacaaataatttctcatctaaaagtaaaattgcaagtgggggttgggctactgtttacaaggtagttcacaattttccatgcccttattatatgtgttatcgtataagcattttaggatgaagctgaaagcaatagtcatattttttctgattgtttaaaatatcttatcaatcatcagaacatttttttataataatcagaatatgaatattctttaattgtgttatatagttcttgtgtttattagtaaatgataatgagataaggaattgagtttatgctaaattatgactctttttaccttagtgccagatcatcgattgaatgactcgaacaaagccaatttgttggcatgcttatgtatataaagcactgcgatatattcaactagatgaaaccccgcgcgttggtgcgggagtttagtatgataatagtagaaataacgtgtaacatagctagacgttttaagcttatagaatttgtatttttttatcgatcattggaaaaaggctataaaccattaagttgatgtggtttatgataatttaaatggtatatagattgataatccaaaaaaaagtaaggtggtgtgacttcatgaaagaagaaaatgggggaaatgatttagacaatagattaatcatttaaaggctagaaacaataatatggtttaatgggagaatatagatactgtagaaattgatggggatatatatgttgaaatattatgtaaattatgtgggatgatgatttaacatgcttgaatttgaaagcttcaaaatataattaaatatagatgatataacatgtttgcatgaggtttaagatttaataattgctaatgaatgataatgtggtatctttgcatatcgagttttaggatgtaatgagttgtaactttatagatagtatagataagcttatagaaaacacataagatgccatggcccaaacctatgcatcttgtaaacagcattgaggtatacccttttaggtatataaagtgttggaaatgaatttgtccagcataatttaactgaaggtacaatatgcaaaacttttttttttttttgtatttgtagaacgggcaaggaatattgtagttatttaattattctaattttgtttgtacgttccctttatatgttgtaaccaactgcacacttatatgtctgttggtccttgatgtctctggtttgaaatatagccaagcaagatatatatgatatactaggagacaactcattttctatctggacaaataactctgtcatcaagaataagttttagaaaaccccaaatttcttgtcgaagtgcagaaaataccaagtattataactcgtcatatataacaccgggttttataaatgtttctgaaagccccattgcaaatccaattccaatcctacatattttactatcttggaaacaatagcccaaaacaacaaaagaattaaagacttcatcataattaagtaatgtacagttcaacacgcataaagattttgtgaaaatgtgataaaaatttaagtaaaaatatgtgatcaacatgtcacagggtgttatgagaccctaagacaagaaacctccggttatatatgtaccacaaccatcagacccagggttttctacaacttcaaccataaaaccttggttttctgcatttactcttatattcatgttaaaggagcatttgattttattagtttttttgtatgagtggttcaaggagaacaaaatttagggtctgttaggcacagcaccagctctagctccacctctcctggagctggagctcagccaaacagtttcagctccaccaaaaataggagcgaagctgggtggagctctctcacaaaatgaactagagaagtggggctgggtttagcagcttcacaagtgcactccagacccaactcctggagctaaatttaggagttagagctttaccaaacaggcccttaatacctagctgtggtttcaaagggcacaatggtcacttcctttggctttcctttttgatgttgcaatatagagaaaactaacattttatacactaacaagattaaggtgtaaaagtgaaggtagcctagtcagtgatcaagacccctttgctccacatgcttggatttttttaacgttaagtttggatgttgacgagattgattttgcataaacttgggctaatatgtatatgcataatccctcatatggttaggatattcaaacacttacaatatgcaaaagctttgctgcacagattgataatcaatctcatttagagaaaatatcttttgacttcactttccaggctcaaatgcgtaatagtcttgagattgcaatcaaagtatatcctatgggcacgggagaaaaacgtgtattttcccagtacgaaagggagcttaatttacttacgaagcttcagcatacgaatataattaaacttcttggacactgcactggagaatgggagctgattttgatatatgaatatatgcccaatgggagcttggacaaatttatacatggtattctttctcggatcttgtatacattgtttattattgaaccaatttccacgtattgtattgatcttgtatacattgtttattattgaacaaatttataaataattgccatgttgcaggcccaaatagagaagtatcgtttgactggttttcgtgcttcaaaataattcaagggatagcagagggtctgctctatctacacacgtatgaagctgagatatgcattgtgcatagggatttgaaaccgagcaacattctgcttgattcagatatgaatgctaagataggtgattttggtatagctaaaactataagcccggcacggcagcaagacacatatgtatcaggcacattgtgagaaattatgaaacgcgtggatgattagattttataattttacatccattaaattcttctgactggtaatgtgtactgattctatctcttgaattgcagtgggtatattgctcctgaatatcttcgtggaggtattttatcaacaaaggttgatgtatatgcctatggtgtcattcttctagagattattactggcaggaggtcctgtattccctgtctaaaagatgatgagtatgtgcatttaactgagtatgtaagtaaattataatctaaacgctattcaatctctaaattttgggccaacatccaaacaaattaaagaaaactgcataatattttgtacaccctccatttcaaattacttcttgttgtagatttgtccaagtcaaacattttaatttttaaccctgaagtacctccacgtagaacgacaactaattagaacggagggagtacatatttataggacattttctgaaagacgattcttttcgcaggcctgggatctatggagaaccggaagatcagctgagcttctagatgcagcattgcgcaatgaggctcgaattgctgagataacaagctgcattcagatagcgttgttgtgtgttcagaaggatccggctgaccggccttccatgttggatgtgcttgcgatgctaagagatgagaagattgtagctgcccctaagaaaccaggtgatcttctccttggagacgaaacgagcgtagagtcaggtgatcttctccttggagaggaaacgagtggagagactgcacattggttcgcaagcagcggcgctacttgcagttctactgagttcacggtgccccggtgagaagagattttgtcatatttgaagctggtggctacttaaggtgcaagtacgttatgtataaagctattacctttgattattcacagcgttgcaagcaaaataagcatggtgaatgtgtatttcagattctgagtaattatggatttaccatatgtgatggaaataaattaaacatacagaaggtggaatgtatagtatatcataaatattttagacaaaattggctacaagcaatataattctgtggcatttgcttatgggcgaaagtaaaaaaccaaacatttactgaaacactagcaattttgttgcattttgctatagaacactgacagttaaaatagtagccctgtacgtggaagataggcagagacggaagaatcagatgatagagtttgtgtcgaatacgtgtatatggtaggttatagtttaggacttggagttgtattagatatagaaatatagtaagagtcagattctattctagaattgatcttaaataaagaggtagacttgttggaaccacatgatgacttagcatagcgatatgtaatggctgctggcggtgtccggccaagggtcgttgtaactttgatatactgtattatgctaaattgggaagtagtgtccgtaattagtgcccctaggatgtagacttcggttgaacctcgttaataaatatcgtggcccggcccggtatcattatcgtgtttggatctcatatgatatttttcttccacgtagtatacaaactctatttgcgtatgtatacaaagtttgtatacgacgtatacaaagttgaatacatatgtataaaacccctgaaaaaatatgcacatatacaaagtttgtctacacatatacaaaattgtatatacagttttactttgtataggtgtatacaaagtttatatgcagagaaaaaacaaaaaaaaccataagaaactgaaataaccggagaagaaatggaaagaaaaaaccagaaaaaaaacgtgccacgcagttctgccaggcccttctcttcacgcgcaccacatgcattagggattttgccacctataggaggtatggaaccccgacccgatcttggtggagtagtttgtttttactttgtttatttacggcggtttcgttccccctccatccgaattattgaccatgttccatggattgtatgacatcgaatatatgtttcatctaaacccaatctccattgcttttatgagtgtttttgctcatctgtacaagggctgttttggcgttgttacacacacattcaaattgttgttttgaaacgtacatcttctaaattgttgccataatttacacccagcttgcaagttcgtacgccatgagtcaatatcatagttccgaaaatattcataatatacatggagttgtcccaaatacacaacaagacatgttttacttggcgtttcaagcacacaatactttattataggtttaccatttgttggtcgaggcttgcttacccaactcttcataatagtggtacagctagctgcagatgatcagtatatatactgatgaaatgattttccccttgtcaggtcgaatgattacctggctctagcttgtgcttccttgaagcgttcttgtgcttctttcacaagagaagagagagatctagcaggcttgattgcctcatgatcattaccagcaaagaacatgcatttatcaagttctaacaagttctctgaagccttggtcagtacatgatttcgatcatgttcattgaagtccttggcgcagctcggtttgtgctgaattgctagtatagccacctgacaggaaagcttcattattctcagacagtcagctgtggcatcgttatttacatctattatctctatcagcttcttcaacagttctctgtccacatgagcaacattagagaagtcatctgcatcaatcagtttctcgcatatcaccattgtaaaggatagcaaggccgcaagcaatttcttttcctgagatagtatatcatcttgctccgtaggggacttgtcctgaacggcatcttttggcggttggctctcttcatctctggctattgcagaatagtcgcttctctcgcctctgtcgcagcacctgcatagatgcttgaatctgaacctgccactgcatttctttccgtattactggacaatattaggcccagagcctgtatatagcagcacaaaataaaagttatctcaaaggaataagaatatacacaatactccctccatttcatattatacatcgtttgatttttttcctagtcaaactttgttaagtttatatttttctataaacttggtcaaacttaaaagaaatttgactaggaaaaaaatcaaaacgatttataattgagagaaacgattttacaatcgtgccatgtatgtatatgctgattcagtgaaatgaaatacctaccgcaaactactatgattcagtgatcacacatcacttaatttaggcatcaaattagcactagcaggaaatataacactatttacggtttagagtttagaccaagaggaggaaatagcagagatttaccgttgtcaaaagattgatggcatcctgcttcgatagttggcagctcttcaggaagcgagaacataggtgctccaatattgctgctgcgctaatctggcactgcttgtccttgacaagcatttcagtgagttgatcaaccacggtgccgtatctccttatatccaaaacatccttggagtcgccttcacacaagatttccatgatggtccctgctatccgtcgccgttacttggagttgagagagattttacaagcagttcacctgcttttctcctcaatgttatccttgttgccgaagaagatgtcccgaagcagactaacaaactcttccttggtcatgagcccagtataaggccccaatgcaacctgtgcaaggatctgtagtgccggttcctgcagtcgaagccagcgatcgttgtttcgcttgataatacgtagcaagttgcttaccatgtcctggctagttgaggtttcctggagcagccttgtgctggcttctccaggagaactgataagcctggccaggactctgagcgatgtgcttaatatgtcaaaccatacatcatcgtcttcgcaaacggcgtcaaggaaagcacgtgaagtgatcggagctgtgatcttggacagcaggccttgggtgtcgcatatctctctgcagttgtgatcgtcgccagcgagcctctcgatgattagcaggattagttctttagctcctctgggcttgaaggaacttgcactcttcctccttttgacgtcctcacggagcctctctcttctagcttccatcaattgtttggaactgctgactcatccggttcttgtcctcttcttatttgcgtccatgttgcctacttggcgatgacaaactgactcgttggtcagcagtagtgtcagtatgactcctctctgatgacgtactgttgaaaagcttgcatcggcgaaccacatgtgtcatgcttttggtggtgtccagcacaatcaagaaggcaagacacggattgcagtgctcctgggaaccgagctatgtgtaggtcgccggcgatgcccgccataatccttgcagcacgctcccttatctctctttcatccagggtccaacttgtcgggcgcgagagcatcgtgagcagattttggatggaatgcctggaggatagcatgtggcgccgtacagatctcgtcttcttgacgacgaacgtgtcgagcatccgtactccggtgagatggtcatcatgatatccagactcgagcaggatatttgcacatttcgatgtggtttcttgaaggtatcccgtgggctgaaaaccccactaccgttcgaacccgcattccgtgtcacaagtctgcgcaacaggaaccagctatagaagcccacaccgtgaatcagagcaagagagtagaaggcaaacaatgctgccttgagttttcctttgccggcatcatcggagctgtagtaatccagctgtatgaggcgcatcactgat

SEQ ID NO: 82088 - DNA, 31066 bp, Oryza sativa
aaagaaaaaaaaatatgtttaattttcaaattaaaaaatggttcattataagatttcagaatcactaaatatcttttgaagaaagaggtgcaaaaacttctgattttttagccatcggattcatggtaagcgcttgatataatttctaaaatcgaacacggacttgcgtggagacgaatcattttcacggctcatgtgtggacgatagatagtgcggactctaatatgtcatgttttgtagatgatgaaaagaaaaaaataattatgtttaattttcaaattaaaatctggttcattataagatttatcactatctgttgaagaaagaggtgcaaatagatggcgcggactctaatatgtcgtcgtgttttgcagatgatgaaaagaaaaatataattatgtttaattttcaaatttaaaagtgggagggaaaagtagacttattctgagtaggatttgagctgtgggaggcaaagtagacttattccgagcaatgatttgagatatgggaggcatcgtagacttattccgagcaatacagcctaggaaaggtgaagtaatgagatgtgggaggcacagtagacttattcggagcaatatagccgtgtataaaaaggagagatgatgggaatcgaaccctggtgggcaaattgaaaattttctctccaccaaccaggcgggcaagctacttgtgattgatggatacatgactgatacatatcatatattaagcaaggttttggagtagattggaaaatttccgaccgactattaagcggattaaaacgtattttggcaggaaaccgccgacggacgaaaaaaacctcacggaagccttacgaatttttttattaggtatagataaagaaagagatagaaaagtagcggtgcagtacggattccaagatgtaatttatgtatgataggtgggaccagatattaatagtatactatgaattgactattacataagagtatagagcactttaaatagtatattacataaaagtatataggctctgttcgggagtgagggtcactctccgacacgcaaaacgaagcagtggtttagcgcgtgattaattaagttttagctattttttttaaaatggattaatatgattttttaagcaactttcgtatagaaacttttaaaaaaacacactgtttagcagtttgaaaagcgtgcgcgtgaaaaacgagaaagaggagttgggaacttgtactgccgaacggagccatagagcactcttatttgaacagtgaacgtttgtgtcacttattattgttaatgttttagtactgatctttttacttcggactgaataattttacaatttttataattaagggttattttggtttgatgtcaaaatatgccttacaaaattgatagcactttcaatagtattttggctaacaaaacatgccaatcatcacacacaacttaccaaaaaattaacaatatcaaaatttgcctaggtattgacagtaccaatattttagcatggtaactaaaattctaaaatttttcagattttgacaattcaagataggtgttagagtatatggcagctagacttatattaggataggattgatttatttggattcattccatatctgtaatcatttcttatctcttctcctttgtacttctatatatatcggcccctaaggctcgatacaatgtatccacgctacgcagtatatctctctccctcctatactatccaatatgttatcagagctaaaggtctcaagttcgaattctggctggcgtgcaattaaataaaaaattgcagcccacttctatcccacgttggaggcttgaaagggcctcgcatgtcatgcccagaaattcccgaatagaattccaagcagaatgtgcattaaaatccccgtccaggaccggccggggtatacaaatgacaatgttgacattcagattcacgtcttacaaacatcataaaagtcttacataaatgcagcggaaaaacgaaagacaacaggagctaagccttgactagaactgcagcgggaacaccactccacaggcatcctcgacggcacggacgaagcctactcctcggagaaacctccatctgacacatactcgtactctggggttggggaaaaaatagagcaagactgagtactacccactgtactcagcaagtcataccggaataggggtatgatgcaggaaattatcaaaggagagctagagtggttcatttgcataaagcaagcatttataaacagaagttgaaagaattaaacagttgcaataattaattaatattgatcatccgctgtccaacgctatcccacgttgcaacaggcccaaccatccacctatactatccaatttcattagactaaactagggtaagactaatcacggtgaatctggttgaccgcccataaccgcgggcacggctattcgaatagttttactctgatcagaggtgtacaactatacccacaagacacagccccataacacgtttccgtgcgccgacatgccaccacgacataccggaaagaggccgtgacaggacccttcgcataaccccctctaaccaagcacaccacacctcaggtttcacccccactccttgcaaagcagcgggcagtcccctctcgtgcctaggtgaatccagaagcgacagaggccgtcgcagggcccgccccgctccatcacgcccacccttgcctggatgcgtcagctagaggaaagctacactacaagcccagccgttgcccatgctggcttgtggtaagtatgataagttcttccagggcatcccgcgaaccggtccttaactgccatgggtgcgactagcagaaccatgcacccacagcccaccatgtgattcattttaattgaccaacaccaaaacggtggtactaaaccaaccttaccaattgaacctaaagtctatattttagtgagctttccccattgtgtgctagtggaactaagcatggctaagcaattcctagtccaaaatctattcatgttataacccaagctaacaaaggagcatggtatcaaaaatggcatggctgtaacaataggtaaacaccccatagtaacattataaaacaatgcaatatttgaagaaaaacaatagagcatttgcaatataggatcaacatgttcaagtgacaagcatgacttgccttgctctgctgctggagaaacctcggcgactatctcgaagtacaccggagcgtcggaagaaccggaatctagcgacatacaaggcaaacattgcaaacaggctataagactactgaaacagagaacaaaaccatttttaatggattctacacatttttcttgatttactgagacttgaatgggcttaaacggagcacagatgaattagttatgaattttagaagattcactgtgtttattactataaaaaaagtccttaaatcatttattgcgcaataattcccagggctgacgtcatcaagggggggcgcggcgccgacatgcggggcccaccggtcagcggctcgggagagagggaaaaggtgcgccggcaagcgggccctactcggcagcggctcaagggagggtggtccaccgtggaccgggaccacgtgggtggtccactgccggtccacgggaccgacggcccagatcgcccccggggttgatcggacgggcggcggcgacccggctcggctcggctcaaggccggccgaccggccacggcgatggcgatggcgcgcgcgcgcgaacgcgttgccggcgacggcgcaaaggcgacgcgaaggcggcggcgctaagcggcggctaggaaggagagggaggggaatagaggggagaggaagcctcaccgagggtggccggcgcggaggaagacgacggcgaacggcgacggcaagccacgggaggacgacggcaaccggcggacgggcttcggggtgccctaaggaaggaggagagagagattagagagagggagatgaaccacggcggccggcatccacggccgaaggcggcggtagaggtagaactcaccggagcgcgaggggatgcgaattccggcgatgaatcccgacggaggaagggcggacggggtggagttcgtccttgcgaacccgacggcggcgacggcgcggtgcggcggcgagcctagcggcggctagcggcggccggagcggcgggaaaggcggtggcgggtgggtgcacggcgtgggagcgatggggagcacgagggagttcggcgaaatggggaaaaagagagagggggcgacggcggagcttaaataggagaggggagtctcgaacgtggccggtaggggcgagattccgccggccaacgtgggggagtgggagaggagagagagaggcaggattcgaaaatcgaatcccggccatctcgggcgcgggcgcgggcgggagagagaggggagtgggcgcgggaggtgcggcgcatgcgcgggcgtgaccgacgtggcccggaggaggcggaggcgtgggcgcggcggcggttgcgggcgcggcggcgcgggcgcgaggtaggagatgggcccgacaggtggggcccacctgtcggcgtcccgggtaggaggagggaggcggccggcctagctgggccttggccttcggccggcccagcggaggggagaggaggaaggagaatgggccggcggcccactcgaaaagaaaagggggaaaaagaaaaagaaaaaggaagaaaaggattttccctggaattaaaatattgtttgctcaattttaattggttaaaattatttctagggctctgaaaattccactaaaaatcctgttagtgactaaaaattatttctagggctctgaaaattccactaaaaattccacatgccagattcgattattatttgtattactttcttagggttttctcttgatttgcaccggcattttcttagggtcatttataaattaaattttaggcttgggaggagaactacagggtgtgacatcgcatgagggagtgttggaatataaagtgaattgtccaccttttctcatcagcttaagcttttgggttgaacaatatggtatcaaagtgtatctctactacttaaaaagtgaaaacatttctgtcgtccgtaataacgatgaaaaaattaaaacaaaaaaaaaggaaagtccgattcaatttgctttcatcgtccatgaaaatttttgtccataaatccgattgaaatccaatcggacaatccaaacaaagaaataaagagaaaaggaaaaggcatccacatgcatcaccaatgttggtcagatgactgggtcagaaaaatggcaaccagcggtggactcggggggtcggcgacgatagccgccggaggctcaacaaggggaggaacatggctagactaggctcgaagaagccatggccagggcatggaataccgttgtagcacttccccttacaatgtgtgtataatcaactatcaagattcgatccaaggacaacaacttagtataaattggctagagaggattcctatatcttttaattaattaattaagttaaaggtacaactctattgaatgcttcgggcaccgtccctcccctggtctgccaggattagtttggccttgagctttatgatgtacccgatggtggaggaatatgaaggacggacaaggctatcaccacatgccgcttacctcattttccgttgagcacacaacagacgaaggtaatttttaacctagacaccacgcctaagttattaattactactctaaccttgcgcaggaacttctttctttatccagagttctagtaatagagcacttaattgcacactaagcaatgaacccgcaccgatgagaatatatctcaattaaataaattaattaaagaacataaagaaacttgaacacttacttgaataaagaaagtatccgccgagatataagcgagagaagaaggccgacaatcctggttttctccggaactccgttccaagaatactgacactccaacactcctccataaaattctcgaaggaactccgatatttcgaggcactccttccggagcttcccctcactctataccaaagtaacatactaaatatgaaactacaagtgagttgtgaaagtgcatctaggcccctaatgattttggtgattaattacaatgcgattagagaggactaatatttttatttaagcaaatgtgaaggttgttatgtcctcaataatgagttagcgtaatgcatatcccgcggaatacgttgatgtgatgtgatgcggcaaatgagcaaatggtattttgtacgttttcgtttccttgagttaataggaaggccgcactattaagagggatgatgcattgacatacgaggagtgatcaaagtgctcaaaatctatttttaaaaggtgtttctcctcagtttggtgtgttctggattttttcggagttttccgaaactcattttcggactttccgaaaacacacagaaccagattgtcgcttctggaaattttcggatatgtccgaaagtgattttcagactttccgaaaaagactgcgaaggcaaaagtggttctgtatattttcggacttgtccgaaactgattttcggattttccgaaaatcatcagtagagtcaatttcgcttctgtatattttcggacttgtccgaaagttattttcggacttttctgagaacatccagaacgatgttgttggtactagaaattttcggacttgtccgaaaagttttcggaatgtctgaaaaatccttcgttgactttgctgttggtgctgagctggaattttcggacatgtccgaaaatctcaattattgtgcataacgggcagaatctgggctgtggctataaatagccccctcccctcacttgtgagggctgctggttccattccaatcatttgtgcccttggcttgctctctctctagcacttttgtgccttgctttcttgtttcccctctcacccgtgttcgatttggatttggtgtgtgtgtgagagttgtggatttgagtttgtgtgagtgcttgttgttgacttcatgaagatttgtgagcacttgcatcatctccgggagttctttgcttcatttgttactcttggaggttgagaactcctaggcggctaggtgtcgctcccgagccaccgatctacttgtggttggccgggagaagtttgtgaaggtcagatctcacctctgaatgggaagagatacctttagtggaaggaggagtacatttgtgcaacctcacaaggatagggttggaaaagacctggctcattatgagctcctcaacggagagtagaatcccctcaagtatttgaacttcgggagcatatcgtcttacaagaatcctggtgatatatctcgcgcactcatctatcttagctaattgatgatgctgctagtagtttacttgttgtttgtgcaatcatttccttacttgtaccactacacttttttgcttgctttactagcttgctcgtaaatctgagattttcagaatatccaaaaataatatggaaatatccgaaaatagtttggaatatccaaaaagtctagcttcctcatttacgtaaaagctttaaacgcctattcaccactcttaggtgacatcaaggttctttcaacctacaatgctatatcgatattacatatggttatggactttgggtgatcatttctccatgaatcatcgttgagatctaagtatttgtagcacataacgagcatgatcaattccaaactttcccaactagtgaattgccataaaagaactaactagaggctagattgttacgaacaacaattcatggctccagcaatgactaccaaatgagaataaaaagttaatatggttcactaaaagaacatatggccatatacaacacatatactaaatgtaatatccataggcggaacaattatcccttacaacttgatatggattagagttagaggtctatgataaccatgtatcaaaatgacaaaagaggttgtaaacaactatcatgatgatagttttcacccatctcatatcctttaaaatttgaagcatgctactaaatattccaactatgttggaagtgctagttctgggctatgactctgattgcttatctatccatacccctttgggacatattgcgattgtgtagattacgggttatagaaaactttgtgtagttgtttaaaaaatatgttggttggcaaatcttggttgtttggctaccccggtttttggtaatgccatttatctaagctaagtgtgtaaagactagaaaacccctcaaaatcttcaatttcctatgtcagcacacatcctaccaatggatatatacattccttcccttgcccaaccttaacaaataaagggtgagctagtctagtaggtcttcattgagtattaccatcattggagagagagaccatatcaaagggcaggcacaaccatggggttcaaacggtgagtagtcagaccgatcaatccctacgatcccttgttatcctcttcttgttttactctttgttcgtcttagttgtgaaattgagtgaagaattgctgatttagtgtttgaaaatcttttgggttttaatttgcatgatgtaaatccttcttcttagaatggtcatcttgttctctagtctccaccatggtcaccattactttctagccttcatttgctctacgactatctcttgtacgcctttgttgtttgagatacattttgaatttgaggggaatgggagcacattatggtgaagttgaggtttgggaggaaagcggatggcatgagggggaggatggaggagatgaggttggggaggaatggaggcggcgtgaggggaggcggcgcggtgtgggatgggggagtaggctgactgtgagagacaaattagggcagaggagagttggtagtagttggactttatgggctaaaggctattgggttggaatagtgtgggctggctagtaccttttcactctttcacgtgtcatatggttataatataaaatttacattacaaattgttattaattgggtatcaatccaagtcgtcgactagatttgttgaggttcatgtcccaggtctagtggcgaatctagtttttgggcttggtttgggctcctgctccacctgtgttaagggcagaccaagcctcaagacacacatgccattgcccgaagcctaggaaacaaagcccattaggtccagcaaactttcaccatataatgggtgagttcggaagcgctgtagctacaggactcaggaagcaagattatgctaggagagctgcagcgctgtggctgtgcagccacagcccagctgaaccgaacagacccaatggtggtcttggcccaaacatgccatgtgccggcccagatctccgcaaaacctaggtccgtccctacctgtaaccatctcgtccctcccaaatcaaagagagaagaaataatcgctggtaggattgaactgagaaaatcataactaaatatgcatggtgttgtgttggcactataccttttaaatttctttcaaatgcatgttatgtaggatttattttgtactaaatatattgaccggtaggttccacatccattaacatcattcttcaactcagcttcccggtgacctttgttcttagtaaaaggctctagttatttttcctgtttttttctttatcaatttgtattctcgagtattaatggtactatatttgatttatcttcttatcattgaaggtccattaagccacaaacttccatgcgtacatcggtgaaggtgcataagttgacgacagaagatgcaatgaattacattcttaccatcaagaataaatttttgcgtcaccctgagaagttccatgcattcatacacaccatgattgatttctccaggggcaggtgagtaataggcattaacatagggtggttgcttacaaaatcatgactggatagattggagcaagaaattctcatgtgttactagttgtatgtggataacaagttttattgaaactttggttatgcaggattaacactcatactgttattgaacgtgtgaagatcctttttgatgggtatcctgatctactccttgcattcaacaagttcttgccaagaggcataaatgcaatatgatgaagaattttgtctaaatatgtttcctcgtttaaggctcaagctcactagctataataaatctttgataactttatgagttggtttactcatctattttaattgaataatttagcaatgctacatttgttcttatcgtacttgtctaagtacctaagtgccgactatattttggagtgctgttattcttattttatctatgccatctatttggtggagatagagattctaagtagctagtgagtatccatttggtgaaaaatctagagaagctaaggcatcatttgatgagattctctaattggctacttcctcggttatcgtgaacacactaactaaactactacgatgatttttttccaaacattttctgtatagaagtttattttaaaaaaataaaacaatttgtcatgtttacaatagttggtacttaattaatcatgttctagttatctatcgtgttttccatgccgtagagtagctcagatagacaacctatttgagtgctgcctatgttatccagcctctgctactattttattttctcgattctataaacactaagtctgaactatttagggagctcgagatttcgggagtagctatagctacaggaagctcccaaacttgtccttgctctcttactaatatttgtctcacgttgcatttaacgctcgcatggtttgtttgttcaatgtaggagctatcaccattgatcatgtttgtaccacactagtcgtacttaattacttgatttttttctctcctaactgtttttttgactttctaatggtcttgaatcgattcttgttgctttggcaccctaatgtgttgtccatagcaatactactattccggatgaactatgttgtaatgaaatagaaccatggaaaattggcagaccatgttgttctgttaaatgctgtagacagattgccatcacttgaccaatgttgcatcgaaagtgttgaagatgctaggttgtgtaaaaaatagtacatatattttaactatttgccactcttacaagtggcaattaaggattcgccattagactgacatcatagatacatgaggtgtgcaaatgtgatgacatgagcttttttttttttgctgctaccattgcaccttatctaataaggtaaatttgaaatatgatggtgtttcgaagtaaaaaaggaaaagctaaagattctcaatcaacactctcattgggctgcaataatcgagtgtcaaagcaaatataccaaacaaagaacaatagcgtgtttctaaactatatatatggaatttggtgcttgttttgatcgatttgcatctatgacatagtccccatggttcacgcactattacctgctctccatggtcttcaactatcttccagatctccacttaccccaattatcttgtcgaagcataatgcttcaaaactgcaaaaggttcaaacatttgttatcacttaagcaggagcagaacaggtcaacaacaattatcaaataagataataactaactaaactagactttaaaaaataaaatatactaaaaactacaatgatttgtcctactaggtcctcatcctatcccaccaagttctacaaacctaagagtccacatgaaacgatacaacatactacattaatactactaacaacactacaattatggctgtcaaaaaagctcgaggcttgtgcgctactcgagcttggctcgtttcggactggattcgagctcaaatcgagctcttaatgagccgagcccaagcccatgcgcaagttcacgagctttgtcggcccgagctcaagcttcttatgagcctagatgtatgtgtaatttttatcttttatatgacaaactagtatgctaaggataacttagtatacattcatttgaaaatttagtatgtgatggtatcatatattaatcttaaattctcgtaaacttcttttttcatattattaatttagaattattgtttttataaaatattatcatcaaaatatggaacatattttaggtttacttaatttcattcatcttacacctcacagccgattcggtcagatcgcatcggctaggttcacacgatatgtcatcgacttactggctgatcggctatcgtattctaatttgattgattttcttgtttattcttgttggtgatcggatcaaactaactggcacgccctaaacctaaaagcgttttggacctgtactggaactaagccgaactcccaggccgccgcgtttctcgtcatcagactcctaatgggctttgaaggcccaattaaacgtcttacatattcaggagcaaggggcatgggaccgtctgacacaacatgtgagaaacctagtcgttaccaagatgaagagcatcaaggacacgagatctccttgctgaagcccatgccggtgagaaattgacacgttgtgagtacatttaagagtacctgagtagaaaacctagccaacaacctacttaaaacatcccgctaaacttggctaaatcctatgcaagacttcaagtaaaaatggccgaaaagcagagtgaaaggctttacacgtgtaaaatttgagagcaattcttggctccttttgagattgcaagaactttgccgtttgttgcacaagcatgacgttatcttggataaatcaaccttttataaaagtactttggttaggagataccaaatgttgtagatggctagcagcaaagggcgatgatcctaatcctctgttgcagcaatatgtaggacatgattaggaaaatgtgactcccattctactgagcaaaagatcattctatccaatttgacaagagtaagagagtccctattatttgaccaagtataatttctaacatgcaaggggatttccttgactacctaaacgtccctatcatggccctgttgagattatcattgttggcaacttttttgacaagttgacaagcacgatcgcagcaccttaagccttgcggtgatcctagagtcgccaaccacctcgatctagcaaagagctaaacctagatgggttttgataacaaaatcggctagcggagccgatttctagataactacccatctcgtgggcaaaacgaaaggttttcaggacaaacctacaaagagatgtcgcactctcgcagcgtcggcagacggtttacggcgcaaaccgacaaagatggacaaactaagagaaaactaaaagcaatacgaaaaaacgattcgattgattgattgtagattggttttttacaatgaaccggtcatgtcccttatataggggttggtcttgccctctacaggccctcctccacgtccaacttgaggtagaaaccaaacgaaacccgaaacatgccttcccgagcaaggaaacctcgagacccgacaaaacacaatcggactcggacctgccggtcagactggccacacaccgccggtctgaccggccctcaaccggcggtctgaccgcccaacacacggcggtcagaccggcccactcggaggaaaccggtagacttccaaattttggcaatctttcctattttaatcctaggtgccaaatttgggtttaaacacatgcccccctgcctttttgatgaacaacgtgaatctaaaagcatagaacatgttttggtcttaggacgataatccaattaccggccatagtacctcctaagcgtcttgccaaacgctcgggaagtatttcttcaaatatttcccgttgattgctcgctgaaaatgctccccttgaagtgtctccaaaaaatatgcgttccctcgaacaatgccgcacactcgataaggaccctcccaactaggagaccacttaccgaactccttggaccgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaagattatctcccatcaacgtcttgtaatcttcacttgacaaatcattttgcttgatataacgaagagaaccaagatttacctccaccggtaaaatggcttcttgaccataaaccaactcaaaaggagtgactttagtagcaccatgtttagatatcctatgcgcccacaatgcttcagaaagcacctcatgccacctctttgggtgttcctcaatcttctttttcactaacttcaacaatgtcttattactcgactcggcttgtccattagcctgagcgtagtaagtagaagaactcaacaatttaataccataagattcggtaaaactcttcacttccttagacataaaagaagcaccttggtccgtagttattgtttgcggaataccgaatctatgaataatatacttcaaaataaagtcaattacctccgtatgagtcatattcttcaaaggcacggcttcggcccacttggtgaagtggcttcggctcacttggtgaagtaatccgtagcaactagcacgaacctatgcccctttgatgacgaaggataaatttgaccaatgaaatccaaagctcatcatcggaatggccatggtttgattatggggttcaacacggcggcaggcgccaattgaacattgccgaaccgttgacaagcttcacatcctctataatatttgaagcaatcatcaatcatcttcggccaatagaactccgctctcctaagcaatcaattcatcttgtgggccgattgatgagttccacaaattccttcatgtacctctcccatagccactttagattgatcttcatctaagcacttcaacaagacaccatctatatttcggcggtataaatcctcatcaagcaatgtgtatttgaacgcttgccgcagaattttccgatcaaccttaagtgtgggatttttcaaatatcgaatcaaaagaattctccaatctccttctgcttcctgggcacaaatgtccgaattcacagttaattcggccactatattgattgaaacgtgccccccagcgctctgcccagaaccggtcagactggccacacagggccgttcagaccgctcagagtcgccggtcagaccggcggcatgcggccggtcagactgcccctggtcaccggtcagactggccgagcaatgccggtcagaccgcccctggtctccagttttgccaatttcgcacaaagatttaaaatcaagcaccggctcttctaatatcagaaataatcccttcttcacattatagccagatgcttgttgtgccaaattatttgctctagaattatcatgcctagcaatatgtctaatagcaaaattatcaaaattggcaataatatctaaacatgaatcaaggtacctatttagtgatctgtccaagcatttgtagactccggcgacttgttgcaccatcaattccgaatcaccaaaagcctccacgtatttagctccaaccatctccataacttgtaagccgaacaataaagcattgtattcggcttgattatttgtacaataatactccaaacgaaccgatgcttcataacacatgctattaggtgaaaacaaaactacccctatgccttgaccttctttgcaagaagaaccatcaaaataaatcttccaaggtataacttcaactaagccaacttctccctcataagcaatatctatatgatggtccactataaaatcacatacaatttggcctttcatagatttcaatggttcataagccaaatcatatcctctcaaaagctaacctcaaatcggctatgtatccctccataccatccgatttgacaacaatatcatcaatgtagatctctaagataatgcctagcaaatcatggaagatcaaattcattgccctttgatacgttgcaccggcgttcttcaacccaaaagtcatgacaacccactcaaacaaaccaacaaatcccggacacctaaaagccgtcttgtacatatcctcttccgccataaagattttattgtagccggcattaccatctagaaagctaatcaccttatgacccgaggcatcattaatcatcatgtcggctataggcataggatactcatctttgggagtggctttatttaaatctcaaaaatctatgcaaactctaatcttaccactccccttcttctccaccgggactatgctagaaacccactccgcataacgacatggcctaataaaccccaccttcaacaaccgatcaatctcctctttgactcggtcatatagcaaaggattaaaacgacgaggtggttgcttataaggcctaaaacccggtttaattggaagccgatgctcaacaagctcacggctaagacccggcatctcatggtactcccatgcaaagcaatcaacatactctttaagtagctcgataccttaaccttataataggctctcatgtttttgtttacaaaagtcggccttggtttagttccatcacctatatctacttcttcccaaggatcggccgatgtaaacccttttccaaacttctctacttcatcaaaatcttcaatggtttcaccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgacaagcattggatattcccatgacgccactcaaaagtagcatcggccattgcaacctcggtcgatgtatccgcttgcacaatttcaacatcattgccgtcccattgaattaaacattgatgcaaggtagaaggcacacaacaattggcatgaatccaacaacgactcaaaataacattgtagttaccttgcacatcgacgatgaagaaagcggttggtagcgtcttgtttcccacggtgagctccgccgaaaagataccctttgcctccgttggttcaccattgaagccattgagaatcatgttggtcttcttcaactcatcatcctcacgccccaatttcttgaataatgagtacggcatcaaattcacggtggcacctccatccactagcatcctagagaccggcttcccatcaacatggcctttgagatagagaggcttcatatgacggtttgattcatcgggcttctcaaaaaccgcatctttaggacctaatgaaagttgagcaacctcggcttcatccatagcacaaaactccataggcaacatacaaaccatgttgatatccatgtcttcttttggagatgattcacttttatcaaccgattgtttctccttctcttctacatcaaccggcttttccttctctatggatttatgcctccataccggtggtggtcgcaactcattgaatcttttatctctttgttcttcagcctttttctctcttatttcttgagcccgaagacgttgcaaccttctcttttgagtagccgtcaaatccttaggcatccatctaggattcggctctgttccaggaggtaaataatgtcccctaataattttgtttgaaaacgatgaagccctcacatcgccctttgcaattctcctgttaaaccggcgctggagcccggttagaccggccgtagaccaccggtcagaccgaccagatgcgccggtcagatcgacacttggcgaacggtcagactggcctgaggcgtcggtcggaccgctgtcgggtcggcggtcagaccggcctgatggcccggtcagaccggccgcatggctgcggtcggaccggccagaaggcttggtcagaccggccgactgcgaggagctggtttcggcttcggattttttgtttgaagatactccaattccatctccagaaggtattggcacatcatgagaccccactttgatggtaattacttctgaagtccttgcctccaccttgatgcgctttccttccctcctttcttcattggcccggttcctgccataaaaccggccattatttggtgaagacaaacgctcatgaattggccttcttgatcctccccacccttggttgaattgcattggaggcatatgattgaacattggcggcgttgccccccatggcatgtaataaggataaggataacccggcggctgcattggataagaaccccatgacatgtcttgtggatgatgatatggaggtgaatgcgaccgtcttggtgaatgaccaaattgttccctaggaggtgatcttggtctttttcctttgttgtgaaccctctcaccaccttgcttctcatacttctccaaaagcatatcaaaagtcattttggtcttcctaggggctttagaagttgaagctccactcttattctccttccaaatgccaacctccggcttctttggcactatcgtcttaggccttggttcgccaatgaccactccttttcccttagtagattcggcttactccggccgaatcaacaccttcttatcattgaaattaattgtgttcaccagaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatataatttgtttttcttgtaaaagataatcaaagattttgtcacacttggccacatcaaaactatatttaacctcactttgccgatctttgcgaggagtcggcattaggttagagcaaacaaaaggcttgtttttattagtccatgaccattcggcaacatatatatcatgatcaccttcctcctcactatcactagcctcagggtaatcaatcacattaacattaggctttttgtcatatgatctaacaagttttttattatccttaacccggctttcttgagccagagccctttgcataagttgactaacatcaagaaattgttggtgtcacgcccggaatttctatccaaaattccaaacgcttacatgtgtgtgaaccctcgtccaggaatcagccgaggcacataataacaaattgataatagagtacaattattactctaattaataagcgtataaaatgtcattacagaggtagatagttcctctcaaacaataaagatctaagcagcggaaaataagataaacggcgcagacggctccactccacaggcagcttgaccaaagctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaaccatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgaatcttaagttatcccaatagtgagctaatgtttctaagcagggctaagcaattatatctaatatctagttgaaccaatataaataaagctcaactagtcaaattataataacccaaggtatcaaggaataaagtaatcaagaacaaaaagggctataacaaagaataggttaaacccacccaatgacatttgaaaataaatgcaatatttgaatagaaacagtagctttaaacgggatcaacatgctcaaagggttgtttgggatctgtgtgacttgccttgctggccttggaactcttcaaactcttctccggcgaaaacggactctccggaaacgacggaatctaaacagaaaagagcaaaaacaccaaaacaacacataaacaagcttgaacagtacatgtggatatttttaacatgtagatctcaattttagaaaaatttagagacttgaaccaactaaatcggagctaagatgaattagttatgaatttttgaagattaaatcggattaaaacacttatatagattttaattgaattatgacgcaataatgaattatttttgaaaaggaaaaggaggattattgcgtcagcgggctagggttttggtggaccgggcgcacggcggcggttcacgcgaacggacggccgagatcgacttgatccaaaacggacggccgagatcgaacggtccacgaccggctcacgggagagggcgacgatgacgtcgacgatgacgtcaccaccggcggcggcggctcggcggctcagacggctcggacggcgcacgctcgctggcgaacggcggcgcttcggcacgaacggagggcaccaacgggtagagcgcgacgcggcgaactcaccggtgaccaaaagagcagcggaagaccaacggacggcgacggcgacgaggttgaaacggcggcggtcttcggtttgacgacggcgacgatgctccggcggtctccgactgtggcgaagcagcggacgaggacggcgacgacttggcgaccacgacggcggttttcccgagcgacggcgacgtctggaacggcggcggcgcacggctggagcgacggcggcgacggcggctcgaagctacacggcgctagggcgcaacggacgaggggaggcgaaggcgagggtggcggcgggtagaggagacaccggggaagcttataaaggggctaggaggcggcggcgaaggcccacggcggccggcgacgagatggaaagctcgagctcggagagagaaaagccgatccgattcgaactcgaatccaacgatttccaaaccgatttagccgatgtttccaaaggagaaaaggtagaggagatctcggggatcatttcccctcttttgattcggccggagaaggaaaggagcggccggatttggaagggaacggcggcggcggcgcgctagggttcggccgggcgacggcggctcggggaagacgaacccccacctgtcagcgagcgagggcgcgcgcgcgcggcggcggactgggccggactgggccgaggagagagagaagggttttgggcccaaaagaagactttttaaaacctttttcaatttaaattatttcttaaatgtaattccatttattaaaaatacttccttagctcaaataaatcccagaaaaatctaggaattatagaattaagcaaagtatttaatgaaattttatctgggcccattttatattggaatttattaattaaaattagatcttctcttcaagacttttaaaaaataaattctaaaaattccatttaaacaacaatttatatattttgaattttcagggtgtgacagttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagtaaacaagcgcaatttaaaaggatcactattagcctcaccacattgcgccaaaaattaacctacatgctcccatgtggtcttactatcctcaccactaaacttggtgaattcgggaactctataattacggggaaacggcacattatcataataatcaggatacggctttttgtaaaccctagcacgattcctagtttcaattcctaataatctcactaattatatcctccatattattaggcccttgttgatttggcggtggatttggtggcctaataggttgtgtttgtggcgcaatatgattatattggctttgtctagtatcaggaggataccccctagtaacgtcattataagcattaggaacatgtgggggaacttggggattatttgcagtagtagatataggaggatcaaatgttctaagatgatacaaataactagcattagtcattggatctattccctgtatcggaataattgcgtcggtctgaccggcccagggcccggtctgaccggcatccagaggcgtggtcggaccagcctgagtcccggtctgaccgccggggtagtacccgttctgaccggctgtctggccggtcggaccgacggctatgttgcggtctgaccggccgtgtgcgtcgctccattggttctactacccgtttgatctataggaggttggttagcagtggtagaggccttatcctttgacatgtaatcggccataagagggccgaatttaacccttaaaaactcatcaaatttaccctcaaaagttgcatctaacttatctttaaaagcaatcatagatgaatctattgtagatgctacttgttgttggatagattgtgatacctcatcattgcttaccaaatcaggagcgagcttaggacgtggcccgggcttgatgatcacgccttgacgagtcctagtgcttgccctcatcaacgcctcccgtgtgagctcgttgatgtactcctccatagctttgcggtcttctccttcgaagtcatccaatgtgaccggtatcatattgatggctccacctccgtcttggatggcggcttcgtcatgacgaagtcgaaattgagttgacgatgaacggatctcctccccagcggagttgccaaaaatcgtgttggcaacttttttgacaagttgacaagcacgatcgcagcaccttaagccttgcggtgatcctagagtcgccaaccacctcgatctagcaaagagctaaacctagatgggttttgataactaaaccggctagcggagccgatttctaaataactacctgtctcgtgggcaaaacggaaggttttcaggacaaacctacaaagagatgtcgcactctcgcagcagcggcggacggtttatggcgcaaaccgacaaagatggacaaactaagagaaaactaaaagcaatatgaaaaaatgattcgattgattgattgtagattggttttttacaatgaaccggccatgtcccttatataggggttggtcttgccctctacaggccctcctccacgtccaactcggggtagaaaccaaaggaaacccgaaacattccttcccgagcaaggaaacctcgagacccgacgaaacacaatcggattcggacctgccggtcaaaccggccacacaccgccggtctgactggccctcaaccggcggtctgaccgctcaacacacggcggtcagaccggcccactcggaggaaaccggtagacttacaaattttggcaatctttcctattttaatcctaggtgccaaatttgggtgtaaacaatcattattcttctgtgcatccttataaacaagattaaatctcctgcgatttagcctaggacccaaagaatgcaacagaataccccaaagatcatgaaggaaaagaatcgtctcatctcatcttgtggcctgtaaacacaattcaatcaccatgacccctatcttgggacagaactggactgaggcactatgtgaatcaaccctaccggaactaatggatccaagcttgcttctccatgcaatcaagataccaccagttgcccccaccgaaggaactttaacaaaattgttatcaaaatcagacccaagcatagccaagatagtgaaatgaaggaagattgtcatgtttatagagttgggatgatctaggtgacaattaattgtttgttttttaaaaaacaatagaaattttgatagagatggaaatatttgagttgcaaatatgcgtgtcatatcaggtattatatagggtgtcgcatggagtgttcagacactaataaaaaaaactaattacaaaatccgtcagtaaaccgcgaaacgaatttattaagcctaattaatccgtcattagtaaatgtttactgtagcaccacattgtcaaattatggagcaattaggcttaaaagattcgtctcgcaaattagtcgcaatctgtgcaattaattatttttggcctatatttaatacttcatacaggtgttcaaacattcgatgtgacatgatgtaaaatttttatgtgggaactacacagggccttaatcatctaacatgtactatattggtcatatctcaaatttgctagttctttggtcacctgatcagagtgatagccatctaagttaagcattttttgcattataatgtagtagcacgtcagattagttaatgtgtgattttgtgacattctaggccactaatatagaaccgggtgacagagcccagtggcccatcactgaggcactcacttgtaacaagccgaaatacaccccatagcaaaggtatggcctcctagccacagggcatgctaactggcgcgagtgcgctagttacggaactggcgcgcacgccagctggcggtcccacgcagtttttttcgctatttttttcgtgttttccttttatttttccatctttttcgctattttttcgtgtttttccttatttttttaattgttaggacacgtgttttcaaaaatattagagttgaaagttttcaagtcttaacttgaaagtttttcaatctgaagaaagtttcaaatctagagttgaaagttttcaaatctgaacttgaaaattttcaatatcaagttgaaagttttcaaatctcaacttgaaaattttcaaatatggacttgaaaattttcaatctcaagttgaaagtttttaaatctcgagtgaaagttttaaaatctaagttgaaagttttcaaattttgtcttacaaatttaaatttagagttgaaaattttcaaaatttgaattcaaagtttaaatcttaagtcaaaagttttcaatctgttagtaaaaaaatcttccaaaaaaagaaaaattttatcttaattaccgtcattatctaaaactaatttagttagttagagtctaaaatagttagttaggcactcccggaacgcgcgcgcccaatagcttttccgcctagccacacccatcatcgatgactacttatctttgatgggctgtatttgtggtctggcataggacatctgtgacgagccacaaccaaactcgtcaccaatgaggggtcatcagtgacatgtgcgagctttacacctgtgaaagatgactatagttatctttgataggctcctgttcattgcccgtcataggtagcagtgactatgtacaccctaaacctttgtaaaatggttatcccaacctagtgtactgtcaaattttgctctagcaccacaatatctagcgtaacataacacgtgtgattttgtgcaacttgaacagtatcagccaagctttcgtgaaatttacttaagaaaatgtgaaggtataaagttccaaggtgctctccagattacaataatcatccgtattttcttgtcctcctctatctcttcctcttcatgtcatcatcctcattatccctgaaagaaatataaacacgccgtgctacagatatgatgttcacaggtggcgtcctgcttccctttgaccctattcctcgagccattatttagtgacctttgtcctaactcttaactaaaaagtctttagttttccctgtatttttcctctccagtttgtattctcgaaagatataatggtatccagtttaattgatctccatatcatgaaaggccagtcgagcgaccaacttccatgcctctatcagcataggtgcattaggtaacaagagaacaagcacgtaccttctcaccattaagaacatttttttacaacatcctaagaaatattatcagtttgtcggaatatgtagggtttctaccagcgcaggtgtcgagggggtagtccctcagacagcggggagtggagacccctccccgagagtaaagatccaaccagggggtttgcggtgagaggcacggactatctgcaatcaggaagggttcacggggcccgactaccctgcacagagagggagacaggagtttatacaggttcaggccacccagaggtgtaataccctactctatgttggtgttcgttgtcttctctagatcagctaagtacaatggagaccttttcaggctacaaagcaagagtactgatctaaaagaatccaaccctttcatctgtatatggtccccttccttttatagtccaaggaggggctcacattattaccaatctactattagtcttgtcttatcagctgtcttattgtcgccggctggttccctaacacagtcttcaagaaaccctttgagtcttgcgattcatattaccccgggctccatctgagacagttaggatctcaccagtgtgctcgccacgtggtgcgtggtgggcctgacgagacccgacttgcccgaaacagtgccaccgttgcttctccacttgcttggataaatcaagtggtgcgaggcatgtgtgacgcgtgtccaaggcgtcactagtcctaggtgactcagcgctggtgtcttgtccacgtcctttcaacttcagactagttggggatcccccatgatcctgtttcaattatggcggggcatactgcctcacagctggctatggagcacgcccaacttcccggcaagtttggcaatcctcggatgagtttctcgaagatgtcgttggtgaaggaatattccaagatttgtacgtctcgatgctcctctaggcagagggagtgagccctataaggaccaaggtgagctcggggcccgaaacaaggccgggcctgaggcaaacctcagtttacacctttatgctttgtatgtcttggcactcatcatcctcgagtagtgcgtgactcatgcgaactaaggtgagcccggggcccaagagtaggccgggcccgaagcataccttagcttgttctcttaagatataaatcttgcagatttctacgccccttttgccgaggaccgtagaacctacaaggactaaggtgagactgggacctaggacagggccaggtccgaggcagaccataggctatattcttaagacgcatttggggtatgcttgggacccaagccaggtcccaagctacttttatgctcagagatttgagtcatacacgcagtattcctcctcagctagggagaatcccatatatgaaaacttaggtgggcccgggacccaccagagtgggcccctagctacgtcactctagggttacctttttatttttaaagatattctgagcatgctatttatttgataatgatccttttgccagataaatgggtaccctggtttccatttcaccgacagcaggtgagtcacaagcatgaagaatgaaaacataaggaatgtatgtaaaatcatggccgattagactatagagagaaattctcatctatgttgtaggagttgtttatggatcaactagtaaataaatatcgtcaattgctcggttatacaggattttcatttaatttacagtgtggttcactatgcgagcatcttttttatgggttaccagagtatctcattgctttcaatacattcttgccaagttgcattatcaaaatttggtgaatgataagaatttggtcagaacatctttgttcgctcaagggtctggcttgctagcgacaaatttatatgcaataggcttttgcactgatttgtgtatcaaccactgtgttgatttgtgtatcaaccattgttatcaaactgcctgaaaaacactggatatttagtcattcagtaatgctggatttgtgtttgcagtattcatttggagtaccaaagtcctaacaatatatgatagtgatattatttttattcaatctacatgttccatggttgcatctgatcatagttgcctaatatgtgttagatttaattgggtaattgatccaattaaatcaaataaattccaaggctcactatgctagaaatttatgtgtattcattctcttatgggatatcaatgggatgaaaagttttgagaattaatccatttgattaatgaattggtaaccaatatcaattactcctaattgatggttggttgatggttgtgtagtggaggatagttgatgacaattagttactctattcatcttcctattccatgactcttttactcttcatctttcatttctcctataaaatgagaatgggagaagagacacacacgtttcatccacttccaatgttgttgctgctacggtaatcccatcctgacgagtgtgtgcacacgtattaggagagtaagccttcgaaaccacacactgctatgacgtttgcacggacaggtacgacgtttgcacggacaggtgggcgatcaggtttttggggagtgcaaggcgcgactactcactattcatcaatgtctacttcatcttcatcaacatgttgactgggggaggcgtcaacggtggacatgtcggcagcggtactggaggaggcgagaacaacaacaccaacgtaggcaacagcaacaacaatgtctcatcctcaggagcgttctctgggtatattactctaatcaccttagtgttaaacatgttactagatgatgctactattgttactagtattttcatgtttagcactatcactggatcatttcggtttccacatgtcatgtttattatcttttttctggattaaaatatgctgaattatgaccatatttctaacagtatgtttgttcaaacataggagacatcattgttggctatgtttctaccacaccatagacctaagttactttatagttctctcctcctgactgtgttatctggtttataaattgtaatagtcttcaattgattatagttgcacaccctaatttgttgtccttcacggtacaacttattaaaagcttgagattcagtagatccatggaaaataaatagaaccattttgttgagttgtatgctgcacatagactacgcactctattgaacaatgttgcatcaatataatgaaaagtcgccatttaacattataactccaataaacgcctctattgatagtagaggatcatcactttagcaaatagcgtgcgcgcgcgtgtgtgtaacttccagctgcttcaaaccagttaatgtcaaacaacatatatagtaactagagaactacatcatgtgtccaagttttccctatatggctgataaacacatgcatcacccatttggtgttggtttgactggattttcacaagggtggagttaatattgagctgattgaacattttctgtatatgacgcaatacacatggagcatggaaattttatcctaggcagcctgccctgtatgcactggaattttgctcgttacttaagtaatgtttcgggttgataatgggacctacaaggctatatcgttgttaatggaacctacaatgctatatcgttgttacagacggttatagactatgggtgatgatttccacgtgaatcaccattgagatctaactctttgtaatgcataatgtgcatgattagtaccaaactcccaactagcatattgtcataaaaactaacttggggctagattgttacaaataacaatccatggctccggcaatgattaccaaatgaaaataataagttattgtggttcactaatagaacatagagccatatataacacatgtactaaatgcaatatccataggaggaaggattcactacttgatatagattagaggtctataataaaccatatatcgaaacgacaaaaaaggttgtaaacaattacatatatgattttttttacccagctcatatccttcaaaatttgaagcatgctgctaaatatgaagtacttgttgtgggctatgactctaattgattatctatccatacccctttgggagaaattgcgattatgtagattacggggtatagactattcgagattttgtagttgtctaaagaatatgttggttggaaatcttggttgtttgggaaccccatttttttaatgccagggatcctctaaagtaagtgtgtaaagactagaatacctctaaaaaactttatttttctatgaaagctcagatcctactattcaaagcaacacattgagtcatagtggacaaagctgaattcggctatagtcatgtgatctcaatgcatcatc

SEQ ID NO: 82089 - DNA, 11064 bp, Oryza sativa
caaatccgcttgattcacttggttaattccaaaattgattagggggtttcaatccccattgattcctcttcaaatgcccccaaattcccccttgattcgtgccttcaatccccgggaacggacgcgccaagtccggccgccttccattgccgccggccgtggttcccgccgccgttcccgctcctcccgtggccggctctctcccccatcctataaaatgggatcctcatcccccgttctctcgttttagccccctcccgagcctccccgtggtccctagccacctccccaccgtcgccctctctctcccacgctgccggccgcctccagccgcctgggccgcctcgaccgtgcgccggccggccgcgccgtcgcctcctccagcgtcgccgctacctcctccaccccggcctgccctccgtttcgcgcggtgatcgccggaggcgcgttcccgccgtcgcccttctcttttctccgcgccggccgcctccagccgcctctcccgcctcgcccgtgcgccgtccggccgcgccgtcttctccctcggcctcgcagccaccccctctccctcggtcagccctccgtttcgcggggaaagcaccggagacgcgttctcgccggcaaaacagtggcgttgccgccactgttccacctccggccgccactgtcgcgtttcccgtgcgccggccgacgtcgccaccacctccctcggcgttgctgcatcgccctctcctccggctgctcctcggtttcgccggaacaccgccgtcacgcgtgccgcctttccctcggtctcgtcggcacccactccggcagcccctttcgccgtgccagtgcgccggccgacgtcgccgtctccacctccggcatcgcagcggcaaggacgccctcggcctcgcctccccttcgaccgaaccccgccggtgttcgtcgtcgtcgtcatcgtcccgtcggttgcccggctcgtcgtctcgcggcgccgcctccgtcgtcggcatcgcagcggcgtggtccgcgtcgtccccgtctccgtgcagctgccgccggctgccctcatcgcctcctcgccggccccggtcgtcgtcgtcgtcgtcctctcgtcgttcccggtcgttgtggcgttcgtccctccgtcgagccgttctcgtccgccgcccgcgtttcgcctagtgtgctgcagccccgtcatcgtcttcgtcctcggctccgcgtcgtcaagcctcgtgccggccacgtctcgccttcgtccaaggatcgccgccgaagccgtcccctcgccgttcgtctccgttgtgcccgtctgtctccgccgcgcccgttcgtcgttgtcgtccccgcgcctcgtcgcgtggtggtaaggatccctctccctcgctgccccgtcctcgtcctttcggtgtcccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaggtcgtgtggtgtttagtggagtccgtttgtcggccactcgcctcggttgacacacggggtctgcttccgtcgacccggggaccgcctctgtgtactcggtctaccgcggtcctttaggttgacatgtggggtccgcatgtcaacggcgcagccttcctgtcctttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaagtccgttctctctgagcaaggcaagtcacatcatccttgagcatattgaatcccagtttataaaattattttgatttaaattaatgcattatcgccttatttaaattcccgcgttatcactgttttatttagccatgcctatttacctttgttatgaccttattattgttgctattgttattattaccttgttcaccctaggataaacaaaacccccccaactagtgggtactctattcatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacatgtttgggtgcatgccagttgtgggaagtagcaccccggccactctaaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctttaggatcgtctttttaaaatggctttgggcaactaagtgacttttaaatgctgttttctgcaaaacttaacccctatattattactccttgtaccccccttgcattaatcatgcatctgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcagctttgcgaagaagaagatgtcgccaattgtttgccgaagctccggaagaccgcagggtccgctagcgaagtgtaggaagcagtgaagccagctgtgaaggagtgaagatcttggagaacccgtcgcagaacctaagccatcctgtagggtagtgttgttagtcgtgtgttccttgcttgtgtgtgtagcgcgtggtttgcatcggtgggttgtgatgtaaccatgctaggttgtttgcttaatcaacttgcggaataagcaaaacaaacaacacatcaacaagaagagttagttcctttaaggtcctatccttagtttctaacctgtctctcccctttgttttccctctctccctctccaaacctgtcacgtcctgataaattcatcccgaaataaaaatcattctctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaaaaccctaaaagaagtcctcttttccccccccttccttcttgggccggctcggcccagtccctctctctctctcttcccccgcggcccatcggtctcccccgcgcgcgcgcgccgctgacaggcgggcccgcccgccactctcgccgacgggtggggcccacctgtcatctccctcctcgcgccgcgcccgccgccgccgcccgtgccctagcgccgccgccgccgcggattccgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgaaccgcgccgccgcttccctccactccggccgccgttctcgtcgtcgtcgttgtcccggggtgagccgaagaccgccgttcgctttcccccttctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgttcctgctgttatgtggagtttagtagtgtaaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagcctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatatggaatggttggcctgggttggcttgggacgagttggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaaacctttgcaacagatggctgacaatgagaaaggcaataaggtcagaagtcaggacattggtacctcaagctcccgagtgaatgaagcaccagataccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtgtctgatagtgaagattcagatcaagtctcctcagatgatgaagatgaaatggaacgtaaggcatgctctcgttgtggagaaatcggtcatgtcgccagctcgtgtgccactatatgcgttcattgtgaggaagaccatccacccgacaggtgtccaacgagcaggatcacttgtttcttttgtgaaggaaccgatcatgtaccaaaagattgtcaattcagttttctgctgacgaagaagatggtcaaccaacccgccagttccaacggagagaagcatcaaggcaacaccaatcctcgccaaaattacagtctcagcttaaatccagtgccaggacagaggaatcaaaatgagaaatggaaatgccgagtccgggaagatatctgttgcttcaattgtcaaggaatgggtcatttcgccgacaagtgccccagaccaagaaacatagctgccagcatgtcagtccccgcaactccttgcaatcagaagcttgcccctcagcgaattgtcatccatgcagcccgaagcagtcctatagaccgcgttgcaacagctccaactccagcgagtgcattaccaccaggtgtcaatgctcaatttcagccccagccatcagtttacaagacagaggccagtatcggcattgtatctttggatgttccagcacagcagccaaagaaatcaagtataagatgaagaacccgagcgtaagaaagttattgtctgttacaaactgtagtacctgttaaggaagcagacctgccagtcgccaagtggtcactggagcaaatgcagtacctgacaagcctagcgctagtcagaaaaaaccataatactcttatatcagtgttcaaatacttttgttttatagttgttcccgtcaatcatgtaataacagagaaacatgagattatgaaggagtttgataagtttatgaaggatccatgttaagattgcaagtgctgtgagttgtgtacattttgttgctgattagggagacctagggtctcatttccgtaagctcataatctactatgaatcaaataacctagcgattgatggcgaagaaaataaagtgatcaaccaaagagacatttgtttggactaagagtttcagatatgtcttcttcggatcaaaggcatgcacccgttgtggagaaattggacacgttgctagcatgtgtctcacactctgcactcactgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagctagtcagctccaacagcaacatcgacgatataatccacagcaccaatgctcctcttgctgcacctgattctgcagtaaatcatagcaataataccttcagcaccaaccattctctgcaccgacagcctcagcaaagaattgtcgtcgatggaagaagttgtttctctccccgacctactccaggccgagcgaagggcaatcaacctcaggagggcgataccaagcagaagaccgtcatctgcttcaaacagcaatcagaaggaagcttctcctgtgaatgatagcaatatgcagtcctatcacatcatcacagaaccaatcaaggatgcagtcactagaacaatgccagctatgtagccatgtttgtgattttcagttcgctacttatcactgtaatcgggagtttgcagcaatcatgtaataaataaatatattcatgattataaacaatgagttcgttatgtttatggaagattcatgttgaggatgcaatgtaccaatgctaagcacctttccttttaggcaatgcttagtattcatgtaatgaggaagaaatgtgtaatacagacaagttctatgaggattcttttggaagatgcggatatgtgattatgtgtataattgcttactgataaaggagacctagggtctcattccagaggaactatgttctaacctcgagttaataaccaacctgatgatggaaaagaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcccagttatgaaccaagtgaaatgttcgaagatagtctatagaggtcagattaaaatcgcatctaacaacaaagcttcagtttggcaggaaaacgatcagacaataacaagttcagcagtaaagtcatttaggaagatgtcaaagcatgtcaagtgggataagttggttcttttgagaaacgtaattcaaaggcaaaagttatcgacccttgcatcgaatagcagaagtagctagcacccggagagcaggaaagttaatatgaggcagttggtggcaagttagaagtaaatgacaagcatgatattcttatgatgacaaacatgatatcctagtaatgacaaagctgatgtcgacgcatgtcacgaaggtggtaacttgtatgagtttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagataagtttgttatagaagatgaagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatgcgtacaagaaaaattcgaatgtggcccggggaattttttgttaaattctccttggtctaaaaggagccctcaaattttacttgaatttttagagcaccggaaataattattaagcaacaaaaacaattatcaaagtttattaaaaagaaaaatctaaaaataatcctgcttttcttttgggccaattttggcccaaagaactccctctcttccctcgggacgcggccaaagtctccctttcctccctct

SEQ ID NO: 82090 - DNA, 5031 bp, Oryza sativa
  unsure (1)..(5031): unsure at all n locations
ggggggagtgggggtgggccctctgatgtttgctgcttgtgtggcggcaaagagcggtgggcaccatacgaagtaggccgggcatgcaagctgtcgtggcacctaggggaggaggagaaaggagggttctttgctgcttgatcttctctttcttttcttattctttacttcgacgacagcatgtggcctcgagagagagggagctagggtttccatggaggagaatggcggtcatggatgcactgcagcggctatgcgaggagctccctcattccttctcgggccaagggggcggtgctttaccaccgcgctggctgttgcctccccattcgcctccctcactggcgccggcctcctcgtggcaaccacatttaaaaatgaggtggagagagatggggaagaaagaagaaggtgtgaaatcattgtcatgattaatatttgtgatgaacaattggctttgcaaaatgatttaatcaatgaagtggtttggaaattatgtgtggatgttggtgtgagtgcgtgtgactaatgtgggtcaggttatgatatctgtgcccagaaacggttgttttgtctgattgtgtgcaggtgacttgaggtcagccttggttaatggtgaggaccgggactatactcagggagaagcagaggtctagtgctgtcggaataccatgtgagaaggtgactagagtcaggattcttagaggtcaacttcgatcaacagtggggatcgggactagactcaggaagaagttgagatccagacggtcaaggataccgggtgacgaagttggatacgagatggcatacggtggatggacaccgtgtgggagagatcttcgcaacgggcttcacgaggtgtgcgtgcaagcgtcggtgttcgcgaaggaaattgagtgataatatttggaggagtatttggttgctacagtacccatggtactgtagcgtggtgcatatgcatgccgttgcatgcatgtgtgtgtgttgcatgtacggtgctgtacatgtgctgatgtgcagcttgctgcttggctcggcctgggaggagaccaagaccgtgtgctatatggagatgtgacgtgttgacgtcggattggagggactagttggagtccggttcagtttggatcttcggcagctgatgatgccggtttcgatggagagaggattacaatttggaaattgtaatttgatttggtaactgaggttagagtcttagtggaactaggcgttatactcctactttgagtaggaggttttttattttataaatagagagggaggggtggcctcccgctatcgctttgagagcaattgagttgatagtttagttagggtttcgagtttagtcgagatttttgtaaggagtgctgttgttgcactttgtaaacacagagagaagcaataaagttgtcatctactttgagcgttcttcgatttgtgtttcttcggattcaggcggcagcaaggtggttcaaccgttggcgtgtgagcaatccgaccggcggcgacaggactacgtcaagatttccatcgatttgagggtaacttttatttccgctaaaagtttttgggtttttagtttccaatttggatttcagctaaaatctcggacatttcagtagaacagaaatttcggtattttttggaccgaaattttctaaaattttgacacaatttaactgaatttgactaaattcacaaaaaaaagagaaaaactggaaattaggcagagatattggcttgcgggaggggggggtccgaaattttggaaatttcgaaacgaaatttcaatccctgtttataagatgacaaaaaaacgtgacgacgatgacacggtttcaattttgtgtgggtacgaatagaagaatagtaatgacatttatctaaattgatactcctacatttgtaatgaacatggatacaattaacccaatatatgagatattcttaggtcaaccatgtagtcgatgttgaaggggaaaggcacgaggattgaccctttcatatatgctgtacaatgcactatatatgttcgcacgcacgcataggtaggcaagaaagagaggagagggaacagtataccaaggcgaagccggccggagttaaggtaaaacgtaccagtagctactcctaggtacgtgtgggagtcgacgcaacgtacagtgggcgtccgtccgatcggtcggtcggctggtcgccgacgtgacacatttacttcgccgcgcggctcgtcgccggccggccgtcgtgtgcgtgattcacctaatcacaaaaggagatactactactctgtagagagctatactatagcctacgctactgttgggtgggtgtatagctagctttgcagttgcagtcgttgcattgcatgccgctgacacgcatgtgcgatatgtgaccagtgcccctagctactcctagacgctactggggcctaccctattaaccgctgtaaaaaaaaaaaccggtttccgtgtccaatgtttgaccgttcgttttatttaaaaaaattatgaaaaaaattaaaaagacaagtattaatcatgttttatcatctaacaacacatcttcttctatattgagttttttttggacggagagagtatgtcgtatatgtatgtacgactcctacatgcgcttgtacaggatacagccgtacgttatactccgtacgagtacggctttgtcgggcacctacgttcgcgcatcttcttaactttatctttcccgccttaacaaaaagaactttttttcctcgcacgtacataagcttgatcgatccatccataccgtccacgtagcagctgctcacctcctccgatccgtgtcttccacaagtctaacgggtatttctttttttaaaaaaaaaacacagtacaaacacaaacgctcacaagacgcacccactcacccctatgaacgtatacacgcaccctttatctttatgagcacttccgaaaaactgaaccaacatatcttaatattgataaagtcaccacgagcgcattgttgtcgatgtcgatgaggacattagtaaaagcacccgtgttaaatttaaaatttaaactcggacatgctgattccatcacaaggaacgatctaacgggtatttaaaggacaccaacacgcttgtgttttgtaatggacctatttaactggtcatgtgtcacatgaatccatacataattagggatggataaaagtgtggattgaattgatcatgaaacatcggagtgttttttggttaactaacttaatacgatagactctctccgtttcaaaatatttgacaccgttgactttttagcacatgtttgaccgttcgtcttattaaaaaaatttgtgaaatatgtaaaactatatgtgtacataaaagtatatttaacaatgaatcaaatgatatgaaaagaataaataattacttaaattttttgaataagacgaatagtcaaacacgtactaaaaaatcaacggtttcaaatattttgaatttgaaacggagggagtatattgttaaatgaataataaaaacaggagaagtacagattaggagcacaaatagggataacacgagtcactccatgcataggtgctcatgcatcacatccttccacaaaggccaatagggtatgatagggtgtgcataggtggacaaatatctcaaccaaagtcgccattgaaaataaagcgtgtggcaatcacgcgcaaccaataatttgttgcacagaccgatgttgtccacgccaaatactccgtaactaaaaacttatattggagctattaatatattctagtgatacctataatgtaacaatccccgactgtccttttattttttttaaaaaaacattctttgcgtgttacactaagataaaccattctccttaatttgatagccacatcacattttttgctgccacagtttgttagacatgtgtttggttcactaccacagttatggcttgccacactttttcaatatcatgtcccacatgtcatagacttaattttcttgcaaactttgccacattttgtggctagcaatttgtccatcatacttttgtggctgtcacaacttgcctaacgttagttgtggcaaagtgtggccagcaaccaaacacactctgcatgttgtgtcaccgtgaatgtgatttacatatgtatgaaaatattcgcacatcttccattatcttaaaaaaaatacgcgatatatttgcgcctttaattaattactaacggtgttaatttttatgtcagaactgggtacaaaatgatgccatggatcagccagcagacatgtaccaataatcatcagcaccaaccggtcggccggcctgtgagctctcctccatccaaaacgatcaatataatggcatgaacagcacacatcacacatatacgaacgtgtaactagcgctagagctacagagaaatctctcttttctctccctttgtggtgggggctataggtagctatagcaagagctagctactacttgatgtgatttttactggtcataataattttcttaatacgggaaacagcccaattattcatctacatggctacacatgaacagtgtgaagaaacagttgccatggactattcagctgaccggtagaggcccacaacatactgcacgtacaggngaggccggccattccatacatgcattgcataaagaacacaatcatatccatgcgtgtacgcacatatatggatatctgccttttttttcacatagatatgtatatatgtataaagatatacgtctgcggtttcatataataaggctttagagcagcgtatacattcatatatatatatatatatatatacacacacacatgtgcctagattcattaacatatatatcaatgtgggcaatgctagaaagtcttgtcacctgaaacgtagggagctcagcatgcatagtctcgaaatataaatatttatagctatgaatctgaacatttgtctttttagattcacagttaaaagttgttatattttcgaatggaggc

SEQ ID NO: 82091 - DNA, 5320 bp, Oryza sativa
ttagttcctggaaaaatagttagaagtttgaaaaaagttgaaagtttgggaaaaaaattgaaaacttatgtgtgtaaaaaagttttggatgtgatgtgatgtgataaaaagttgaaagtttaaggcagttaggttgaactaaggccccatttgaatcaaagaaaaaaccataggaattctagagaattttatcctatgggaaataattctatagagtcatttgaaaaaaggattgtttcctatcaatttctttgaaattcctatggaatgaaccttactagagcaattttggaggaaaataagcatgaggtcttacctcatgttatcctcttcatgtgtctgaggttcctgtgtttttcctgtgcgctaattaaacgacagtttgaagactttcctgtgttttaaaatcccatacgaatccaataagtgtgatatttaatttctatgttttttctattactcttttttctcaatcctgcgtggtctatgttgcattgacaaaccgcgttctcgcgtcgggccacgagccggccacgtactcctaccgagtacgcgtaccgaccgccacgctatgggccccacactttatccagtctgcaaccgtgtcatgcatgtttatatatgggatttatagtctgttgattgttttacagagaaattggattaatcggcgatcagcagcgctctcgtacgatctttgactggggcaccggggataacgacggttttaaattatctgcaccgtatccggccgggtcggcgtcaagtggtcggtgtgcattatcaagtgctatcttgccgcggtgttttggtgtcagtattcagcaaggtttacgttagcgtatatacctgacaattaacctgattgatctcctggagcaagcagcgcaggatagatggccacgtaagacaggcgccgttgaaaagttcctccatcttccactgttggtttcagttgggcttcttcggctgtgtttagttgttgaaaaaagttaaaagtttgggaaaagttagaagtttgaaaaaaaagttgaaagtttatgtgtgtaggaaagttttagatgtgatggaaagttgaaagtttagggtagttaggggtgaactaaacacggccttcgtttcccaactgccaataaccaactcaggttagagcaagtatagccaactactaactccaaattatttatagtcaatctaatagcttattcatatagtagttacatataaacatttagtactccctccgtccctaaatatttagcgccgttgacttttttaaatatgtttgatcattcatcttattaaaaaaattaagtaattattaattgttttcatataatttgattcattgttaaatatactactactcaagtttttaataatatttataaaagtttttgaataaggcgaagatcaaacacgtttaaaaaagtcaacgacgggatggagagagtacatcatataatatatggtttcatctcttataggcatataacgtattgaaatccgtactgtagctggttatgggccctactgtagctgactatgggcctgttcggctacatgtgctatggctgcggcctgcggcgcagccagcaccaacagtgctgcacacacatggtgcagccgcaaccagcttgccgagcaagccctataaatatgtagcctaattttcttttctctcttcccttctctgattcacatatgcttacaattgatttgtactcgttattaaaaaactaaaaaaaaaagaaaaaaaaatctcggtggtgggcccacgtggcccacgggctggggttccagaatcgtggaggacgaggagggctcttctggaaatccctggacagctttgctgccgcggccggtggagttggtcgctcctgcccaaaaccaggaggattaggaggggtttacaggttaatttaatcgattcacacgcgattagaggatgggttaccgaggcacgccgactattgtggagccacaccgcgcgccctcgcgccgccacgtgctcctcccgggttgacgtggcacaagaggctcgtccgagtaggcacctcccaaaattttggtatgatcagtacagtttgaagtttgacttggccagtttagtcaattctagtatcctcttacggcaaaatactaggaaaccagacaattttctgaacgaccgtttgcaatttacagcaatccaacgacgacaggagagaaggcgatctgatgttttcgcaggggaaattatcaggaatattaattaccatgataagtacaatatgatcatgatagtgtccactgtagaatccatcggcgacactacaaaatctctgtcattaattacgagaatgctacggtatcgtcggctagtaatttgctgaaaacaatccattgatgcatgtataatcaccaaatggaaatggacccctggattactgatgctgtactttttcgtcagggaaagaaggaatctgatctgaagaagataattagcggataaaactttacttgcaggattaactcatgaaaggacgcgaattttactgtgtaattataaaaaaaaaattaccaccggaaggttcgccatagcccatacagcatcgaaaaggaaacggaaagatacaggggcattccatggctatcaaaggacagtaagagaaataaactgacaaaaaatataatttaatttataaaaggaatgagttgttgtggctcccacacaaaaacctctataaattgggcgcaaattagcctcccatctcttcagcaaagccccaggcttagcaaaacacaagcaaaccaaagcttccatctcttcttccagttcaaagatctccaagcctccaggaaactcaaggccagcctcgccatggcgcccaacctcagcaaggccaaggacgacctgatcggcgacgtggtcgccgtcgacgggctgatcaagccgccgcggttcacgctcaagggcaaggacctcgccgtggacggccacccgttcctcctcgacgtgccggccaacatccgcctcaccccggcgtccaccctcgtgcccaactccgacgtccccgccgccgccgccggcagcttcctcggcttcgacgcgccggcggccaaggaccgccacgtggtgcccatcggtaagctccgcgacacgaggttcatgagcatcttccgtttcaaggtgtggtggacgacccactgggtgggtacaaacggcagggacgtggagaacgagacccagatgatgatcctagaccagtcggggacgaagtcctcgccgaccggccctcggccctacgtcctcctcctcccgatcgtcgaggggcccttccgggcctgcctcgagtccgggaaggcggaggactacgtgcacatggtcctcgagagcgggtcgtccacagtcaggggctccgtgttccggagcgctgtgtacctgcacgcgggggacgacccgtttgacctggtcaaggacgccatgagggtggtccgtgcccacctcggcacgttccgcctcatggaggagaagacgccgccgccgatcgtcgacaagttcgggtggtgcacgtgggacgcgttctacctcaaggtgcacccggagggggtgtgggagggcgtgcggcggctcgccgacggcgggtgcccgccggggctggtgctgatcgacgacggctggcagtcgatctgccacgacgacgacgacctgggcagcggcgccgaggggatgaaccgcacgtcggccggcgagcagatgccgtgcaggctgatcaagttccaggagaactacaagttcagggagtacaagggcggcatgggcggcttcgtgagggagatgaaggcggcgttcccgacggtggagcaggtgtacgtgtggcacgcgctgtgcgggtactggggcggcctccgccccggcgcgccgggcttgccgccggcgaaggtcgtcgcgccgaggctctcgccgggcttgcagcgcaccatggaggacctcgccgtcgacaagatcgtcaacaacggcgtcgggctcgtcgacccgcgccgcgcgcgggagctctacgaggggctccactcccacctccaggcctccggcatcgacggtgtcaaggtcgacgtcatccatgtaagtctcccaactacttttgtgcactccgtttactactagatcgtgtagaggagctcaaagcggcggtgcacgtggcgaggcagagcaaagcttgttcgtgttctcgaggtttcctgattaaccggatgaaacgggaagctgctagtttgtgatattcttgttctacctaagatggattttgttagtaaaatttggtcttgattgtattaagtaatatgcataatagtcatcacatgattgatatctcgtcactgctcgtaacttcagccttttagcatgtcaggtaaagatcgctttttatgcctgaaattgcatcatttttcagtcttcgattcctgaaaatgattggattgcaaatttagtacggtcatgaattcttatttcagctattaaaatctgcacgtcaattcattaggtagcccttttctactgtcgatagtcagcgacctgaagagcagggaaatccacatacatttgacatctcgacaccacgttttccatctcgcagcaccacacatcaatccacttggaaccagaaaaaaacattttttttcgtcattatttattttattgatctttaattagtacatgaaagacacgtagattttgacagaattggacgggaggggaacagtaagaaacatcaattaaggtggttaggaattaatcattaggcacgacaaagcggaacgattacgatcaattaattatttagtttaaaaatcttaaaaataattaggctgtgtttagttcagcgcaaagtttggattttggttaaaatcaaagataatgcgactgaaagattttggttaaaatcggagataatgcgactgaaagattgtgtgttgttgcagctgctggagatggtgtgcgaggagtacggcggtcgggtggagctcgcgaaggcctacttcgctgggctgacggagtcggtgcggcgccacttcaacggcaacggcgtgatcgcgagcatggagcactgcaacgacttcatgctgctgggcacggaggcggtggcgctgggccgcgtcggcgacgacttctggtgcaccgacccctccggcgaccccgacggcaccttctggctgcagggctgccacatggtgcactgcgcctacaactctctgtggatgggcgccttcatccacccggactgggacatgttccagtccacccacccctgcgccgccttccacgccgcctcccgcgccg

SEQ ID NO: 82092 - DNA, 1245 bp, Oryza sativa
agttggcacaatgcatcttaaaaggtgtcacacagtaagcctttatatagctgccccgctgtctttttaatatagtcaaggtcctgtttgggtttatcaaccaattgattgaacacaatatcattgctttttgccacgtaagtgtgcatttttattgaccaatattatggcttaggttgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttcgaaatttctttattcacagcattcaagcttctttatagttgttttgctatgtgaactttcaaagatgttgtcaactttaggttgtacgcatcatattttgccaagcagtcggtatatcacttggatcatattattcagggattcacaccgcatatgctatatattggtatcaagtcacttggttgactataattatcaaaaaccactcggttaattggataatttattccttgactatatgtttagtttgttcagctaatcacatagtcgggggctacacctattaggtgcatctagtcgatgcatctgactttattttttcagccctccacagtcttcagacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagtaataggggataacatatatgtatggaatatgtaacagatcatgacttgggtattacgtttcccctgtatattatggaacgggcctaaaatcctggtttgataagattgtaaagtagatttaggaaatcggtaccttattggttaaggtttctattttgtaatcctgctcccaccctatataagggggcaggaaggcctttagggggcatgagacaacctgatcggcagatcaatacacacccggcggattctatttcccaaacaggagtagggtattacctcttattgagagggccttgaccttgctaaattctttggcttcacattcattcacttctaggtctcgtgcgctaccccgttttattattggcgaaatcatgtttcgaca

SEQ ID NO: 82093 - DNA, 570 bp, Oryza sativa
tctcgcattacttgctcaaaggggtggctcacatcaacggccaaatctagctcccagattataatttacaatctagcaagaaactgcagaaaagaaaaggataaaaagagaaggaacagtgctgtaaactaagactccattatttttccctctcctctgatctttgccgtagattcttgatccgacggtacgggagtgcgcactgtatcctcgtacctcgtaaagatgcacatccagtggaacatgcagaggctgatactctgatgatactatcattggaaatgttgcatgagtcatttgtgacaagtgattcagacttcatgagggagcatagtgcactttaatttttttttcatgcaggctttggtgctctagttctcattgtctcaaagttagatcaagttaaactgtcgctttggcacacaacctgaccaacccaatgcctgcatatgctttatcaaattgctttgctttgctttagcatgcttgtgatcagtgcattagatctactatcatctagcttggcttgcatatattggccccccaactcactgttgttaattgttattt

SEQ ID NO: 82094 - DNA, 1011 bp, Oryza sativa
tgggggcacaatcaatggatttgtttatgccagataaataattctgcaaatgatttggctcagtttaatgccgtcagctgttcgtgcaagcacaaccagaaccagttgcagtgtcaactggtctgcatcataatataaatggctctttgcagtacaccacgaactaaaatgatggctcaccatgaacattgaacatgtatacaatcactcaattagactgatggctcttccaaaaaaaaaaagactgatggcaaggtcaacattctgactatctgcttttttatgcgctacagatggagcaaccgcgtgaacgcccaaattggtgaagatgattgaccgcatcagttatatacttatgttagcagtgaatttttcagaagattcctttgcattttagaactaatacagtgcctggtggtggctaagagcgaggggcaaagaaaacctgggcacagattgctgccagattgtcctcagataccctttgtcaacagaaaaaatggaaagtgcgaagggtacagttgagctacttatctgggctaaaactcgggagcgaaccccgcgaaccttccaccgccgccgccgccgccggcggattcgaacggtgtgggcgccgcggcgccgcagcgccgccggctggagctcgctacggcgcggcgcggcggcaatgcccttccgggctccggccttcccctatctgatccttcgcctctccttctcttcttccttttagcgggccgagcaaacctatgttggcctgccaaaattggcccatgatgctgaaaagaaccgaaaatccagtctcgtcatcaggttgactcgtcatcaagatcaagaagtatttggttcgcttgcaaagtccgggcctgtacaaattgatggtatttccaatcataccattatttggtaaaattgacaattatgtggctacgcttagtttgttaccaaatattgacaatgtgtatagaattttggcaacattattaagctaattctaccaaaattttggca

SEQ ID NO: 82095 - DNA, 11585 bp, Oryza sativa
attttagaaacacatatgtaagcgaagataatatgcagtgctatattctttagtccgggttcttaaccctaactgggtttaaaaaaaatttgaaaataccggaaagatatctttagtcccggttgttctcatcaaccgggagtaaagatccgggggtatatatttttccggtgcgccctcgtcttctccaccaacacttcacgttttcggccgatcgatctctctcggcctctctccttcaccgccactacctagggcaaatccccgcgccgacgccaccgtatcttgccgtcgtctcgagctcgtcgttgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtgggcaggaggccctctagggggcatatatatgagacaacctgatcgtcagatcaatacacactcggcggattcaaatccccaaacaggagtagggtattacctctcattgagagggcctgaacctgtctaaatcctttgtctccacatccatccacttttaggtctcgtgctctaccccgttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgccggtcatggactcgaggcgtctcagctttccggtcgatcggccgcgagtccactctgccggcttgtcttcgccactgacattgctgataacaacaacgacttcaccgccggcccgcctccgtcgccgccgactggtgtcctcgcctatgcggttggttggtcacaccaccgttcatgggcatccacgtcttcaccgaccggctggcctacgccgccgccgactgatgtttccgcctgtacacggctggcctattatgccgccgctgttgggcgtctacgacttcaccgccggcctgcctccgtcgccgccgagtggtgccttcaccgccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgccacgctggctacccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgtcttcgcctatatggttggttggtcacaccaccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcttcgcctatatggttggttggtcacaccaccgttcatgggcgttcacgtcttcaccgccggcctgcctacgtcgccgccgattgatgcttccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagttgtgcctccgcctacacggctgggctattatgccgccgttgttggatgtctacatcctcaccattggctcaccttcgttgccgtcgactggtgtttccgcctacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataatcgcaaaagtacccgagtagtaaactccgatccgtgaaactttgttccattaatgacgaactcatgtcactcatatgcatgtttgggaagtgcctcggccgactcccagtgcttggggctatgactagtcggacagagcgtttaaacgtaatgagtcatctgctcggggaaatcaaaattgacaagaggagaaatatatatttataaatattttaaaatacttgattttttctcgagtattatatttatatcagatactactcatcctatatgtttgttctgcaggatccagatccagatatgcacaaaagggattcatggctttaagcttatctcttacgctccaggaatggatcagtcagaacatcaccaccggcttgccttcgcagccgccgactggtgttttcgcctgcacggctggcctattatgccgccgttgctgggcgtctacgtcttcaccgaccggcttgccttcgtcgccgccgactggtgtttccgccagcacggctggcctattatgccgccgttgttgggcgtctacgtcttcaccgaccggccgcctcgtccgccgccgactggtgttttcgcctgcacggctggcctttatgccgctgttgttgggcgtctacgtcttcaccgatcggcttgcctttgccgccggagactggtgtttccgcctgcacggctggcctttataccgccgttgttgggcgtctacgtcttcaccgaccggcttgccttcgccgccgccgactggtgtttccgcctgcacggctggcctttatgccgccgttgttgggtgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaaacaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggggatgcacaattaatgcaaaggagtacaaggggataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttatgccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggggtatgtccaattccaccataatccaacaattccatagtgtccaaaatgatatgagacttcccaaagtctaaagttataaaaccacctaatgttgcctaattaaccagcgaagcatctacctaagttcatactagtggaaccataaatagagtactcactagttggggttttgtttaacctagggtgaacaaagtaataataacaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgtaccacgcttcgggaacctccggaacgacgaaagctacgcgaagcacacaagcaaagctacaagcctataaagaagcaataacaatacataaaaagaaagcacagggttctttaggttatagcaaacattaggagacttgaacgggtcgattcagagttcgtatgaccaagatatgatcatccgaagtttagtgctgttatatggagatttgcggattattataattaggttttgcaactataaaacaggtgtaagcgctagcctggaaaagacaggaaggctgcgccgttgacatgcggaccccacatgtcaacctaaaggaccgcgttagaccgagtacacagagtcggtccacgggtcgacggaagcggatcccgtgtgtcaaccgaggcgagtggccgacaaacggactccactagacaccacacggactgcacacgtggaaaccacgcggctaccgagcggacacactaacacggtcaccacgcgcacaagcgaacgactgccgacgccgatacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcgcaacggagacgaacggcgaggggacggcttcggcggcgatccttggacgaaggcgagacgcggccggcgcgaggcttgacgacgcggaggcgaggacgaagacgatgacgggggctgcagcgaccttgacgaagcgaggacgacgaacgagaacggcttgacggagggacgaacgccacgacgaccgagaacgacgagaggacgaggacgacgacgaccggggccggcgaggaggctacgagggcagccggcagcggctgcacggcggcgaggatgacgtggaacacgccgctacgatgacgatgacggaggcggcgccgcgagacgacgagccgggcgaccgacgggacgtcgacgacgagaacgatcggagacgacgatgatggaccgcggaggggtttggatggaggggaaatgatgccgaggacgaccttgccgctgcgatgccggaggtggtggaggtgtggccgaccggtgcacgggcgaggagggacgggcggccgaacaactccggcgaggcggatgtagaggttcgcggcgatggcgttccggcgaaaccgaggagtggacgaggtggagggctacgccatcacgcaagggagagatggcagcgccggctgacgcatgggcatggcgaaaagggcagccgggggagatgccgccgaggaggaaggagaagccggcgcgggcgacggtgttccggcgaagttcgggcgaggaggaggtgatgccggggatgagagcggcgtcgtggagccgaggaaggtggtggcggcgtcggccggcgctccggggacgtggcagaggcggccggaggcggagaagtggtggcgacgccactggacgccggcgaggacgcgtctccggtgctttccccgcgaaacggagggctgaccgagggagagggggcagctgcgacgccgggagaggtggcggcgcagccggagggtgcacgggtgaggcgggaggtgcggctggaggtggccggctcggagaaaagaggagggcgacggcgggaaggcagctccgggggtcacctcgcgaaacggagggcaagccggggtggaggaggtggcggcgacgctggaggaggcgacggcgcggccggacgacgctccggcgaggcgggagaggcggctggaggccggccggcaacgtgggagagagagggcgacggtggggaggtggctagagaccacgggagagctcgggaagaggctaaaacggtagaacgtaaagagggggttctattttatatgagagaagagggagccggccacgggagaggtcggaacggcggcggaaaagccggccggcggcaatggaaggcggccggacttggcgcggccgttcccggcgattgggggcggcattcaaaggggaaattagggggaaatgaagaggagtcaatggggattaatttcccctatttaatttgggaatcccatgcttgattcgcgcggatttgagggaggaacgaagctaggttttcggggagagagagaggaggccggctgggaggaggaagaaggcgacggcggcctgacgcgtgggccccgcgcggccaggcgcgcgcccagcacacgcgcggcgcacatgcgcggcagggaggcggctcgggcttggcgcggcttgggccgattggccggcccaagaggagaggaggggaggcggcctggggaagagagggaggaggagggagtgggccgggaggggaagaggggcccaagagaaagagagggaaggaaaaagagagggaggagggaagaacttcggccacgggccgagggagagagagaggactttgggccagacttggcccaaaggaggaagaggacattttttagatttttttctttttaataaactttgttaattgttgttgttgtttaataattatttccggcgctctgaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgaattttatttcgggatgaatttatcaggacgtgacaaatccaccccccttacaagaatctcgtcccgaagattcgagtaggctagcaagaagataggttggcgggtcttctcttcttgtctgacttctaccgctccgtcttatataacaaacttgcctagcaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttaacaatcacctttcgacctacttctttgttcgataataaacacctttgctggtatcttctatcaatcacctcttaaactttgtcaaccaagtactcttcactccgagagttgtggatgcttctggtgacgatgaggtcctttggcttgctgcctttcagtgaaaccttgaagtgttttgccaaaagctatactaactgtcgttgcctttgatccgaaaaggactcatctgtaacccttagtccaaacaaatgtctctttggttaatcacttgattttcttcttttccatcctcaggttggttattagctcgaggttagaatataattcctcggaaatgagaccctaggtctcctttgacagtaaacaattatacacataattccatatcagcatcttccaaaatgaccctcctagaacttgcttttattacacatgtctccctgattacatgaatacaaggcactgtcttaaacaaaaagggaatgtgcttaacatcggtacattgtttcctctatgggttagaattaacaggaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaacccttgctaacattggcatcagcggtaccatcgttgctatcaccattggagtctttctcagtgtcaaaaattgctaaggttgtcattctgggttccaacattgatactatcgttgacatcttggcgaatgctaccgacattgcacgctttattcgagtggtcactaatggggcaagaaccatggttgttggtggtatcatcattattagtattgctagtgttgttgtctgcattgcgtccatcttcttgaggcaggaactctggatacacaacagaagatccggtgatctgaagtggctcagtgcgctgtctttggttaccacctggaaatactgggttgttaaccatccttctcttgcaattcgtcatccgattatgctcactttcgagttgcatggctttgtccacaagtttctcaaagtcttcataatcctctagaagtagttgcactgcgagctcatcttttaacccctggagaaacttctcttgtttgtcttcgtccgtttccacatcttctggtgcatagtgagccaaacgatagaactcgtgcaggtactctgcgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacattggttgcccctgctgggttgttccgattctgtaatagttgaaaggctgttgccaacatgttggtttggttaaccacaatttggattagctctggtgaggtttcgttgatgcttttctcattcccattggcttgggtttttgagtcatcggatccatcattcccatagcctttgttaccagtgttatccatctgtcacaaggtaggggttgagagaggaagcatacaaggaaagaatagaccagaaccagggacaagaccttaaaggaactaattcttcttgctgatgtgctgtttgtttcacttattctgcaagttgattaagcaaacaacctagcatggctacatcaccacccaccgatgcaaaccatgcgctacacacacaagcaaggaaacatactacaaacgaaacactagagggtggcttaggttctgcgacgggttctccaagatcttagcttcagcttcacggctggcttcactgcttcctacactttgctagcggatcctgcagtcttccggagcttcggcaaacaactgacgacatcttcttcttcgcaaagctgaccatctagtactagttgaaatccgaagaaggaagaagggagtaaaccttttgcaaatagcattaggggaaggagaaaaaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaaacaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggggatgcacaattaatgcaaaggagtacaaggggataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatgatgagctacgta

SEQ ID NO: 82096 - DNA, 1542 bp, Oryza sativa
aaattatcagtgagcccattgatactcaaaccgagaaaattatcagtgaccccattgaagcgcaaagtgagaaaattatcagtgagcccattgatgctcaaaccgagaaaattatcagtgagcccattgaagcgcaaagtgagaaaattatcagtgagcccattgatactcaaaccgagaaaattatcagtgaccccattgatactcaaagtgagaaaattatcagtgagcccattgatactcaaaccgaggaaattatcagtgaccccattgatactcaaagtgagatgttggataattttcaagatgacactggaagggaaatgcacaccagggaggtcctttcccatgttatttttgaaacccatgctggtgagacaaacattaccattggtaagagtgaggagatttcacagtttgtcactgtaaaaacatgccaagattgttctgatgcaaattcacctgtttatgaaactgcaggtttgtcaagtgaaatgcatgacatctcttcaattacttctgctcaagatgcatgccaagagaaagtggtcattgtcagcagctatgagactgtggagacctcatataatgtgcctgatattttggttgacaaagtttgtcatgctgttggtaacccactggatgattctttacagcccaaagagcagtcgggagtctccattgaggaaatagaacatgtaagttttgaggacaaaccactgtcatattatggtgcttccagcaatattgaagacatgactaagctgggtattcaagaccaacaggtgccagtctttgaggattccggttcccaaaactcccaagaatttgttccagacaaggatatttgtgtggatactgttgttaatgatcgtagtgcccatatagtaaatgatttagcttgcaatcatgattttgtttttcctgctgcttcttccagtgttgaagagatatcaaattatgtgcctgataatcatcttcatgatgtaacaaaggacttcattgtggaaaataaaacatgcaatggagagcttaacatttcccttgtccaaacgtcaacaacgggagatgagaccacagaatgcatttctccatcagctaatattcctaataaagtagaactgcaaggttcacagattatttctgatctttctagtttgagaaaggttgaagcagaaagcaccacactagaagatactgaaagcagatctagttctgctagtggagtcgaaattaagcttgtgcctgaggctatatacgagccaagggaagaagcagaagcagttgtttcattctcagagttcgtagaagaaattcaatttcagtttagtgacagtgaaagctttgctgatcgaaagaccacagatgatgctgcatctactaaagaggcaggtgcagtagaacatgatgaatctgattgtgacacagaacaacagggagggaataatacaggtcttggaaataacctggaaaactgttctgattcatcaaggcctgagactatccctgttcctattccaggaagtgagtttcactcagatg

SEQ ID NO: 82097 - DNA, 5327 bp, Oryza sativa
tattatagagaaaagttaacaatagctccaacattttggaaaattttctttgaatctatctcttatttaacttttgtgtttttcctttagtctatttaaaatattgtttctattttttcttgtgttttatattttttctgttctgcacttgttttctagtaaaaatcccatgtttttcttgttactccgtgttctcaattatatgtttcgaaggatcaaagaatctttagataaaccttttttaggaatggcccctcggatcggtatcagagccattggcatcaacaaatagcgagtcattatcatagtgaagtagaacctctgtcctatggatggttgactatgtggtcagacagttcagttagagcgccagtggcgttgagatggaggtccgtcctttaatataataatctaggatcagaggacttcatcgtttcgtttattgacggaataagcgaaacagtatatttgcaaacgaaaaataatttataaataagaaataagtatatttgtacgtataagaaataagttgtcaaaagtttatttataaaataaacttttatagaagattcaaatgcgcaaatattgccagcatttttgagccctgaactatctgggtttccctaacttgacatatattctcttttggaacagacaataagttttatatagctgtagaaacgaaaaggatgtgacaatctctgcccaaaatgtctcgtgtgtgtgcatgcgcgttctccctgttcccgacagggtgagagcagcatagtcactgcttgcaaacaccaatcaataattctactgcccaaacataaaaccaagccaaagattcgccaagatgttgtacagaattattcacaggtacattcaactgtacacatggccggatgatatttacaatgtcggacagtttcgttgtaccggtgggtatctgtaggatcgatgtgcacaccggcttaaaaatgttaaatttgttcgaatttagaaaataaagtaagattcacgtaaatctgttgaaatttgaaatttccaacgtataagattggaccttttcaaaagtggattttctatatagtaacaattcgacggaaaattgagggagaaatctatcgagtttttaacggttggatccgcgctgagatccatgttcaccgttggatggcgcatgtggggactcatcccgtgattggtaggatctcgtgggcgtactttcgtactggattaccgtgggttttgtatatttagaaaattgagagaaaaatatatcaacatttaaaattttggatgcgttcatattcatcctcaccgttggatggtgcacctggagactcatcccatgattcggaggatcttgtgagtgtgctttcccactggattatcataggttctgtatatgagtatattttccatccttgagaaggtatcatgaggcaccaatctaatctaatcgttgatttagcaggggtatgatcggactaacaaaaagaggtgtcctttcttcgtcgtccatgcccatccagcgtcgtcgtcgccaatcgaggccaccgccgccgtcgtgcatccagtcggtcaccggccgccgccgtcgcctatccagcccgctgtcatcgtcgccgttgttgccgtcgcccatccaattggccgcctgccgccgccgccgtcgtgcatctagccggccgcccgcgtcgcgcgtccagccgccatgcatccagccacccccgccgccgccaccgccgcgcgtccgtccgccctccaccgtccccctcgagcttgccgcgtctagccccctccagccgccgcgcatcccgccgccgcgcgtccgtctgctcgccgccgtccccctcgagcccaccgcgtccagccccatccagccgccgccgctgccatcacgcgtccaagcgcccgccgccgtccccctcaagccagccgccacgccgccgctgtgctctctcgacgttttttctttctatcgtgaaacagtaaaggacagaaataccctcccacccatagcaccacttcaatgaggaggtgcaggaccatgaggtacggacgatttctgaccgttggatgatgccagatcaatggtcaggatttggtactgcacaacctaaaggacagtaaaaaatctctttatatatagttgtacgtaacttgcagctaaattatattgtaattatatactatttacattacaatggtattataattatattgtagttatatttggtataattttaaaaaactttatgtttatcagctcctttttttaaaaaaatatccagattgtgtaccagataattttatgtttcaccaaagcaagtttatctagccatcgtttctctctcgttgagcaggcccgcacggcgcggcgccactcgcgcctcccacctgccacgtaagccgcagactaacggcgttcggccgtcaactcctcacggacagggatcagcgacagcgagcgtggagctacataacgccgtcgtcgtcgtcgccgtcgccgctcgctcgcgctgcgcggcgcggtgacgtgacgagctccgatttgtcggccgcggacgaacaccttgtcgtcgcaactcgcaagtacatataaacctcactgtcacacccacacttgccgctgctgtctgcagtagctcacctacttccaccttagctcaccctctccaccgtcgcagcgacatcgacggcgagctcgagctcgagctctggctggttcttgttggcaagctagctagctagctcagctctcgccatgggcaagtacctcaggagcagctgcaagcagcagcagcagccgtcgtcgccggccgccgtggcgagcgtcgccgccgcggcggtgtcgtcgtactcgtacctgacgctgcggagcgggcggcgcgtgccggcggcggcggcggcggcgggaggcagcgcctgcaggcggcgtcaccgccgcggaggacgccgcgggtgcgccaagaacggcgccgggagcgcgcgcgcgtgcggggcgaggtcgccgacgtcctcggcgtcgtccgggcagcggcggaggtgtgaggcggtggagtgctctcacggcggtgggcgggcggagctctcgcggtcgccgccgctggggaattccgtcgtcgtcgtctccggtgacgtcgtcagtggagaaaggtttgggtttaaaaacttatataatcatgtcaatttgacgccctctcctgtcatcctgtgtagtcactaataagcacaaatcttatatttcaaaattaaaccatacgtaagtcgaaaattttattttacaaaaggtaattcgtgacaattttttttctagcttagtaattaattacactgtcagtctgtcacacactcacactcacactaattaactcttgcttctactctctccaattcagaaagtctttgaagccaaattcttgttcccgcgaagtggcggcggaacacgccggcgagcacaagcacaaccctgcagccgccgcggcggccggccgccggccaccgctgtcgccgccggaagcggagatcgaggcgttcttcgccgccgcggagctcgccgagcgccggcgattcgcagagaagtacgtatacacacacacataatcactcatctctctctagcttgcaagcttaaagctaagctaaatcaagctaattagttaattaattaatctgcttaatttgcaaactaattacactgcgagctgccggttttgcaggtacaattacgacattgccctcgaccgcccgttgcaaggccgctacgagtgggagccagtgagcacgtgaaagggaggggtagaagtgtcaactcaactcacacccatgtctgcaactcacaagtgatgcaaagctagcttaatcatcagcagctaattatctgggagaggctggggatcgagttagtgaccttgtttctcctgctaattctcaattagggaattaattaattactcctcaatcctcatctccacctgttgtcagttggatctcactaccatatatatctcagctctgtcaattaatcttttgtatagttggtaggaaataatcaaggataatccaggtgatttggaggatgcttctgatgagctcccctcttgctaattactaatatgtatcttccacataatttcgcctaatttactgtttattactacttattaagccccttcaaaaataagtatttcatccgtttcacaaggtaagactttctagcattgtacacatttatttatatattaatgaatttagacatatgtatgtatttagattcattaatatctatatgtatatgtgcaatgctagattgtcttatattgtgaaacggagagagtaattgactttttcttacctatattctgatgatatgtagtagagttgatatttaattacacgtaccctagtgaggttagaaacagtagttggttgttggagtgaactgaaaatgcagacagtgccaaattttgatgtggccaaggatgtcactgacatgtgaaggcagttttggcctgaaagaagagcatgcaaaagtcagatcgagtacgtattcgagtgtaatttgttgttttgcaaaaatttgtgcgaggcttctttgcctgatatgcacgcatgacgatcacaaaatggctgcatgtacgtatgtatatacgtacaagcaaacacttgcacaggcatgtacgtatgtatatgtagctttgctgggtttgtattgaccttttgtgagtaaattcacatgaagcctttcaaattctctctctctctaacttttgttttcgttatagccctttctttttattctctctctattccatccagcacctgttgttgtaggagttaggctttatttgagtgagaaaaaagctattttcctatatggtcatatggaaaagattcaaaagtacatttatgctatattttcctagatggaaaaagcttcaaaagttcatttatgctattttcctagatggaaaagattcaaaagtacatttatgcaaggaggacctctaaaaggagaattaattccatgcttttccactcctctctagccccaatttgcttttggtcctaaaagaaaactctagactgctttcttttcataacctagccatgcatctatatatgcactggatttcatcttataattactctcttttttttacataattcatcttttactttgcttccctattttcctatgaattaagcagaaaatgtggatatacaaccctttcttacgcaataattaagtcaaagtgaggattaaacactttcggttcggtgaaccgatagttatatattatcgttcacccataattattttaaaattttcagac

SEQ ID NO: 82098 - DNA, 14394 bp, Oryza sativa
  unsure (1)..(14394): unsure at all n locations
gagccgtcttcccttctgtttttgtttgctgtatctgagggagaagatgtgatggtagattgtgtgagaattaggggtttctctctaagggtaggttctagatttgcaggatgagttgggcgtaaatctcaagtgtgaggtttttggtggcgaaatttcaactatagatctataaattttggatggggttcctcgagaggtttttggcctgtatatagctagctctagcgagatgtgatgtgcgacttgctgtagcgagatgcgtgctgtcttttcatgtgtaactggtgttaatgatgctgatcctgctgctatgtactgtagttggggtcaactgcgatcgggttgaagaccaaggatggtgttgtccttgctgtagagaaacgtgtgacctcgccactgctggtaattgcatcttatcctatttcttctatcaggctggtgcaattgttcaatagcacctatgattgctcactgcattttgacaatttagttcaagatttgactgaatttatctagctaatgtttgaattatcgatttcttaccagttcaggcaagataaatcttatccttaggtagacctgtattcttacatgattccatcaggatgatcctgtaaaacatggatgttgctggtgttgttcctcatgatcttgctgctttcatttttcacaactacatgctttttgtaatctccaacaaacaaaaagatgtagattagataatgctgtttagagtaattctgatggagtctcaatcttgttgaattttatgatttaataatatgatcagtttttctggcatgtgttatttttatttatgcaaatgccaacaaaacaaggacattcagtcaaacaaacacagaaatccaagtatttcacatgtcaaagcctggaacctaatggttcatggatatttttatttaaaaataaacaaggaatatattgcaactgaactctgaagtgctcatataggagttctttttcggttaatgcataaacaattcttttctttcagcaaatagcccagtttgtttttcttgtacgtcagctttatgggttgtgacaatctgacaatttattatatcttactctctgcgtactgtagtactttgtatgtcagtgctgttgttttttttgtttaaatgatatcatgtagaagtttttttacaccctataggcctattgcccatatatgtgttatgttaattaagaagttacgtaatacctctgcataatttgtaaaagttaactacttgattctgacagaacttgatgttagactcccatttcactcccaagtttctagtttttgtgtgtgatgccactcaagttatcttttctatgattatgcaggaaccaagcagtgtggagaaaatcatggaaattgacgagcacataggctgtgccatgagtggccttattgctgatgctagaacattggttgagcatgctcgtgttgaaacccaggtacgttcttatgcaattttctacatgttttacatattatggtcattgtatgttaatttcacctaatgtgtttataatcagaatcataggttctcatatggggagccaatgacagtagaatctactacacaagctatctgtgacttagctctgcgttttggtgaaggtgatgaagagtcgatggtgagtctcatttgcatgaaaacaaatattttgtgaaggatcaagattcaaaaattaattagcaggggagcccttttttcacttttgcattttgataaataggattaacaccataactttgcatcagtgtgttatctttggaggaaactacgcatctagaaattttgggtgtttcaaataatcccatgatggccactaatactgaaaattatgaatagataggctgtaaattaatcattttttctgcattttgttttgtcttttattatgtgactattgtcttattaaggcttagtggacatatgaattagttttctaaggagtaattgctaaaatacctgactataacaattttgcttcaccccactgggccactgcaagttactttgctgcattcttttcacccttttgtcgacatttcttgttgccaagcttaaactaatatacttgtttgttttgtgcagtcacgaccatttggtgtctctctccttattgctggtcatgatgagaatggacccagcttgtaagtatttatccctttttaccaaaggaatttccatacattagcgatatctagatacctcttctgtggttctgccctatgcgaccatttgttcccacttcccagatcgcatgaactaacctttatcgctccaagttattttgagtatttgtcgaggaaataactctataacaaaatggtcaggacaatagccattttcattcatcttgttttgttccattgctcttaaattaagttgatgtgagtatcatcaaatttaactttgatggtttctagaatagctagttatttttcgcttgaagattcaacaagtttttcaaaactcagccacagtcggcatttgaaaacctggtatatcaaagaagagttgtccaaatgttgcccatatgaggttctatagactatatacattgatacttttatttccagtttcttcataaggagcagtgtnatgtcatttttttcctgaatccagataagtgataggtattatgtatttcattgtagctgaggttctttattagtggtaagtagtggtaatgctgccatcatggcatctctatccagagacaggctcatttttcccgtcatgattgctttacaaggccaactagactctccttgtaccaatctgtggatgaattcctatgttttgcaggtactacactgacccatcaggaacctttggcagtgcaatgccaaggcaattggatcaggtcctgaagcacctgatagcttgttacaggagcagtacaataaggtattaactgttaaactaatcacagttgtgaagaacaatatcaaataatgatggactataaggaggtgttaaactaatcacagttgtgaagaacaagatcaaataatgatagaatataaggaggtgcaaaccttacaaggcactttggtttgagtgccacatcaacatgaaaactttcccaatataatcttaagaggactatgttttgtgcgagccatagtaatagaactatttaacaaggttgaatccaaatctaaagttgcagtcagacctatatggctatatgacatatggcatcaaactgatcaaagccaactacagttgctttcatgacagctgagaactgaagccttaattaatttctctatccaggtagcgcccaaataaatcagttactacacctgatcaaccaaccaccaacaaacagtgtgcacgagccgccagccagaaatggaagtcccaagtctatgatccctaagaacactaactacaaagcccctgcccacgtatatacatcaggcaaaaaatcccacaatcagatgcgacgacgaacagggggatgaacacacacacacacttcaggcagaatcgcaggcaaaatcaacgatgaacttggaaggaacagggggatgaacacacgtatgcggatacccaccccacgttacacacacatcaggcagaatcacaggcaaaatcaacgatgaacttggaagggtagggtctgcgcttgtcctgacgaggccaggccctctcacgcctcccggagtgcgcgtcgtcgaggactccgacggtggcgccaccatgatttgggttcttgctgatcggcccccccaggtactcgaagctcatctcgtcgccggcgtgggctcgcctcgccgccgctcggtggggtggatttgggggaaacgggagagagagagagaccaatgcgatgcgtgtgtgcgctcctcggttgaatggatttcactttttgaggtttttcctgccattaaaaaaagatggtgcctacctctttgccacaaaaaagtttgagcctccctctatgccatcgtccaactttatcgcgtcctccacaccaactttattgcgccctccacaccattccgtcactattctgtttggttttaactgtttagcagctctgacatatgggcccgagcaggaaaaatgttgctcttgccctttcactctctcttctctctcgattcccctctctccatggcatccgcgtctgcgtcactcccagccggcacccagccgagcgtggccgagctgctggacgcccgcgccgccacgccggcctccccttccctcgtcaccgccgtctccgccgagtcgagcggacagcgccaccggccacccctccaactggcgcccgaccacctcctttgcccagcggcgacggcggcgaggtggaacggcgcgccggcggtcgttagcgcggccttctccgtgtcgtctccgccgctcctgcatctcacccatgtctgcatgccaatggcagcttgtgagcttcacacagacacacactgtggtcaggagctccgatacctcggccatggccgccccggtctcatctcgattcactatctggttcacggcgagtaatccctgcacctctcagtgaacacaagaaatgttaatcagttcactaatctaatcactcctgctaattgctgtagctaattatttcttgatcttagttgcagatatatcgagagagagagagagattgcctgaagagcgttgcagaggttggtgacctctccggagccgcggagccgcagcgcggtgctgacgagctcaagcacggcgaggggggagctcgcgtcgtcggggtcaaggatggggaggaagaggctgccctggatgtcgtagatgagcgcatagctaatgcgggcgtactcgccgctgccgtagcactgcacgttgggcgtccactccagcgtccccgtgtcaaacgccctagcgggaagcccctgcttgtcggcggcggcggcgccgccgacggggaagacgcacgtgagggagacggtcctgtactggaacaggcggtggcactgcgacgccaggacgaacggctgcccccgcgtggcaagcacgcgccgggcgccatccctcaccggcgcccacacctggaccatccacccgccacctttgccggccagtgaaaaaaaaaccgccaccccaccttactcattataaattttacaaattaccacttgagcttcttaatattaaaaacaatcaaatctaaatgacaggcacataaaataaagttaaataaagttaaggctacaggaataacatgtttcatgaacaaatatttttatttgttttagaccatattataatatactgtctccttctctaaatatatgacgttggttagttcaattttgaactaacttacatcatacaaaaagacatggagggagtatatttttatctgtagcaaagcacggacatttagctagtcaagacaaaatctctacacataaataaaaagaatattggtatacatttagctgtgcaggaactatctagatatttctatgttatttacaatgtctttgcaattcattgaattgtctacttgtatgtccatgcattttcttgttcattagatgtcggatatgcattcgatatgcaagatttaagaatcataattattttttttaaaaaaagttaaaatcttatcataaatatgcgtgcaattggctgcacatagctggtatgcaatttataggttcaaccatggttgtgtccaaaacaattaagaggtcaaatgtcacactaaaactcaatgaaagtggacagataaatctacgaatttaagttatcatttagcagatccacccatgcatcagatcgaagcagagatgatcgatcgcggcgtttcttcatccaagcgcagccgagtagccgatcgatccgttgcactagtcagcgtgcttcgtcccttggtcgatttcaggcgacggtgccagctgctaattaattgctactcccttcctgctatcggtgccacgccatgctgatggcgacgaagccgacgatgcactattttctgggatagatactactttttccacttttttttcaaacaactatactccttttccatcgatgataaaagtagtatcataacatactgcttttgttttgaatatatatatactatcttttttttcggggcaatatgtatacatcaatttcatcaagtatacttcattttatggttcggtatatataccattcggtgaaaccaagtgatatacatatatactattttcttaattatttaataagtaccactcggtgaagtagtatgtacttcatcaattattttgctaataatctaataaaaggtacatgcatacataccttctatcgacgatggatactgcaattaaatagtatataccgcttcaatgagggtttcagtatatgctggatacttttaaaaaacagtacatactcattaaccgattgatttagtatatactgaatactaaaaaaaacagtacatacttcttaaccgagtgagttagtatatactggatacatgataaaaacagtacatacacctaattaaccgatcgagtatatactggatacttgaaaacactctacatactcctagtaccatgtactgaaaaattagtatatactactagtttttgaaaagagtacatacttcgatctactaactaaataagaaaataatatatcttaaattttgaatatggccattaattcctcacggaccgttgtgcatgcatgcaaagaattgaaaagaaaaacaaaagaataccagccgcatatgcagaattttgaaaataaaatgaacattaccttttttttgtttctaactcaactatccattatcaactaatggatatccaacaaaaaagagggagtacatacacctgggtgtacaaaacagtcgtcctataaatattggcttatctggatacatatggttattcaacaaccaagcctactcagctgcatacatggacatcatcatataggtggttgatagctacagatagatagtcgacagttaattaagtaaactaacagtagatcactaagctaagtgataaaacgtcaccctacatgctcagttggaggcaaggttaaatccctcatcaataattagatcggtcatctcggcgtcatccagaaagataccctcagctttggagacggcgactctcatctccaggttgttgtcgacgacggcgtagccgcccttgccatggcggacgcgccgtatgatcgcctggcactccgcgagcttgtcctcgcgcttcttgttgtacctgtccatctcccgcacgctcttcctgagcaacttctccgcctccgacgggttcgggtcgccgccgccgccgccgtccttgaggaggtcggcgacgtggggcagctccctccgctccagggagaggatcttgtcgaccagcttcttcgacagcgcgagcttcccgcgcgggaccaggatcgcctcctcgccgtcgaccggcaccagcgtaccgccgcttcgctttgagcctctcgccgccatagctttgtcggcggcgaactgctccacgcaatgggcggcggtgcagggcatcaacgcgatcttctcgccggcatcctccgccgccgccgccgccagcgcgacgacgcaacgcttgaggtaagcccgcctgtcggccatcggtggatggatgatttcgcgggaaatctcgatgattttgcagctaaaaattggggaattcgaaaccctaacgattcgaggatgtgtggggggaagacgaagggtgtggtttatcaaggcggaggcggatcctggccgtccgtttccaaagccgaatccttctttctctgctagtttcatcgcggccgtccgtctccgaagtcgaatccctcctcggaacgggccagatgaggcagcccctacgtgagattatgtgggctgcaaactgggccaggcccaataggggaaccagcaacgaaaagcgaaggaactcgtcacagtcgtctcttctactactactactattttggagaagttgggatggttttcccaaattttcttttgctttttcgatctaaactatcgatgtgtttatttgaactagcaaaatacatgtatgttgttacggaattaaaaatgacatcagcatgatgtagagatgaaatctattttaaattttagagcttaattttacaattaattagaggtttttgctcaccaaaatttccctcaatttattgttaacttgcaaggatgatcatggttgaaagctccagggtctacccgtgactttcattgttctaccatacattttagtttggacgagggatggacggtgggcctacatgtcagaattttggaagttggtggtgggtggtgccatggtggcagattcaacactcgctaccaccactaccttttaaaaatgataatagattttgatgcttgaatgggcaacagcagaagcagcagcgggcacatattggggagattcagaaaatgcacctgcgcgatctgatgcatgatgttgagcgctgcaaagcaatgacagtgtaagggttgaattttctctgctgttgcattgcatgtgttggtttctgctttcgtttctcatgttcttgttggttgacagggagtatgaaggcatacatgtggattgctcgaggcaagatgacctcactctacctgcccctgcagcaagccgttgattgaatcactgatgtacaagctgccagatccatgagggaagatgaacagcggagggatggaggaggaagacaatgggcagtttggtccaaaattttagaaagtgtgttgaaagagtaagtacactggtggagaagatgtttttactcccggttcgtaacctgtagacccggtttttcaaccgggactaaagatcagatagtgatctttagtcccgggtgcaaaaaccgggagtaaaaatccatactaaagagactagatccgattgctactttattcttttcttttcttcattgtttttaatatattgattcactctatcctatcccaaaatcccaaatcaatcatccccgaatagtctccaaattctcaaatcgatatctccaaatacatcacaaaatcttaaaaaaattacatcacaacttctacaaaattcatcacatattcacatcacacacaaatctcaaatccaaatcacagattctacaaaaaaaaagaatagaaaaagacgaacagccaccggcgctacgcccgcggccgccggcgtgccgcccgccgccgcgccgcgccggccggccagccctccgcgcctcgccgttgcagagagagatggggaggagggagaagggaggagggagaggaggagaggagggaggagggagaggaagagataagggtgtgactgtgtgaggagaggagttaaagaagaggaggagattgtatccgatccgcgtgcatccactctacttatatcgttcttttttcccggttggtgttaacaaccgaggctataagtagatctttagtcccggttggtaacatcaaccgggagtaaagcttatatcgatcttttttcccggttggtgttaacaaccgagactataaatagatatttagtcccggttggtaacatcaaccagtactaaatataaaaaaaatacctctgagctttcaaacctggactaaagatgtttttagtcccggtttttaatacaaccgggactattgtgacatctggtcgactgaccaaagatggtttctccacaagtggtagtggcatacatcgaataacgttataattatagtggcacgagttcaaataggtgaatagtatgtgtatctttcaaaattatgaaaataataatggcatggatccaattaactctttctattttgtgtctaggttaccacaccagtataggtgggacaaattcaacgtgccacatgagcaaataccaaatagccaagggaattgttttgctcgattttaatagttgaatatgtcgatatacccgactttgcggttgaaggatacgaataatatccgaattatatttgattgaggaagtcaaactacaccttttcctttcgtggctgattcccctattgggcctggcccagttggaagccgttttctcatgttgggccctacctcagctgtccccatggataagagggattcgacttcggagacggacgggcgcgatcatatagaagtatggaacttagtatggttcaggttttgtaaaccaattgttgctgataaatcatcgaaatctcccaagaattcatcgaaatctcccgagaaatcatccatccatcctctacgttcccgatccaccgatggacctggacctggaccgcaagcaaatcaagcgttgcgtcgtcgccttcctgccgccgccggaggaggaggatgccggtgaggagatccgtgtggtgccgtgccctgccgctgctgcggaggaggagaggcggcgatcttccaagaggaaggggaagaggtgcgcctccaatggaagcaagcctgcggggacgctggtgccggccgacggcgaggagatgatcctcgtcccgcccgggaagctcgcgctgtccaagaatctggtcgacaagatcctctccctggagaggatggagctgccccacgtcgccgacatcgtcgacgacggcaacccgaacccgtcagaggcggacaaggcgctcaggaggtgcgtgctcgacctggacagggacaacaagaggcaccaggacaagctcgccgcgtgccaggcgatcatacggagcgttcgccatggcaagggctacgccgtcgtcgacaaccgcctcgacttcagggtcgccgtgtgcagggccgagggcgtcttcctgctcccctgccatgtcgccgatcttatccccgtgggatttgatcttgtctccaattgagtactccctccatcataaaatttttatagcaatcttataacggatgttctactacaacaaatcctagtatattcagattcgttgtactggatggatacattctaggacaataaatcggttgccatattttgagacggagagataaaggtattttgggtgaacgtgacatattctaagacaataaagctagacaaattctcttaccagatttattgtactaatgtgacatatgcacctaaaatttcttataattttcacaatgaatgcaactaaatgtatttccatttactagtacatggtcttcttaagtaccacgatttgttaacataacatggcacccatgacaaacaatgggaagaaatcccacatcatgaagtaaacaaacacttttggccctgttttttttctccaataaaaattagattaaattttagatacttgtggcacgcttttcaaattgttaaacagtgcgtttcgtgtaaaactttatatatgaaagttgttctaaaatataagattaatccatttatcaagtttgtaataattaaaactcaatagatcatacgttattaccatatcgttttgcgtgacacttaatcttcatctccaggagatttaaacatcatcagtactgtcttaggcttgatagaaaatatactacttcctcctttgtgttccttcgatccaaagtgtaaacatttttatatgttttcacataattaagaaattagcactagtaaaaaactatcacaggtgccggttaggaactatgatcggcaccaacattagcaacctgtattaaaaataaaaccggcatctataggtttgcacaagcaaaaaaaaaaagaaaaaaagaaaaaaaagagccggctcgaatcgagccggaactcacaatcatcgtcactgcgccatgccccacatcgagttgtttgaaatccccaattccccacatatcacagattacagatcgaaacatattcaacaaccaaatcatccacaaatcacataaacatataaaaatttctacaaatcataaaaaaaaatccctcgggcactgccgcctgccaccgccgcccatcgcctcccctcccaccggatctgatggagggaaatgtgcggccagcgccgttgccgtccccgaggtccgctgtctcccctccagtcggatctagcagaggggagggcgcgaccaccgtctggcagtccctgaggtccaccacctctcctccagccggatccggccgaggggagggtgctcatgttgccacaggccacccgcccgcattgccgccacctcgtcctattgctcccgccgaaactaggaaaaatagaataggaattgaatgagaaaaggtagagaaagcttctagaagtgatagtgaagaggaacatgagagagtaagggagggatagagattgacgaggttcaaccgaaccaagtcgccgccgtcgtggctgaagctgtcgatgcctgatcttctgttcgatacctccctaggattggtgccttttcttatatatgatgtaccatggacttgcttgagagcttgctcttgggttgcctcatgggctgggccaatcgatcatcaggaagcttagtgggttcttaatgctacagtgtccagattatcttcaatcttgttcgatttccctttaagtgagctgcactatcacgctgctgattttcattactttcatgctaaatgaataatgcaataagaaattacgaactgggagaactactgagatcatcagaactaatttactactccctccgtcccaatatgcaacaacctaggatgggattagaccattagaccatcctaggacttcgaagtcctaggatgggtccagattcaaagtcctaggatgggtcccatcctaggttgctatatattgggacggagagagtaaaacattatctatagcaagtgttaccttacatgtaattcaaaggctgacatcgtttgaaggagtaccgcactaaaacagtgacactttggaatgccccaaatgtgcattcccattcatttataaaagaggtagttgtaacggagtgtgagggtggttgcaagtaagataatttttttataaaaaaatatgtggtgattaacagtataaatactacttagagaattgccaagatgcccgaaattcatcccaaaattctgtttttaagattcctaattatgtaaaagttgactcaataataaaaagtggaaccgtcctaaaatactaaacagaaaaaaaaatcgttattgggggccgatgcgacacgttttctcactaatagggagcgagaagaacaaggaagatgattttagtttctgggaagctggctatgagaaccatggaagccaactttttttactttaaaaacactgcagagccacccccacaaacctacatgtgccacaacttaatagcgataacgttggccacccaaacttttactccctccatcccactaggtgcacttgagaggagaaaaatgagagagattaaatgagagatgatatgaaacaggaggataattgagggtaagacgaagataaattagataaatttaaatggaatgtgattgatgtggtaagcactatgataaagctatatttatttcagaaaaaactattaaatatagaattgcacgaattgtacttagtggaacgaaggtactccctccgtcccaatatgtaacgatccgaaggtactcctaccatcctaatatataataatctagaataagattaaacccatcctagaactatgaatctgaacacaagacatacaccttatgtttgggacgtaggaagtagcaatgattagcaatgataagaactgtacacacataaaaaagtacgaaacagaggaatattggatcctggtattaagttattactacatccgttccaaaataagtgcagtcgtgggaatccgtgtccaacgtttgaccgtctgtcttatttgaaaaatttatgagaaaattaaaaaaacttagttgcataaagtactatatatgttttatcatataataacaataaaaatattaatcgtaaaaaaattttaaataagacgaacggtcaaacgtaaactgcacttattttagaacggaggaaggaggtgggacggaggaagtaatatatttagtcggctgacgtaaacaagtcgaatcgctttgctagtttcatcgcgaccgtcccctgtcgcccaaaccggccaactgaggaaggtccgacctgacacaacacaacgaattcgaattgggtcagggcgtcaggccaattggccaaacatgagacggaaagcgaactaacttgagacgcccgcttggcggcactaccagttattttctatatgtatactcctactttatattgtatcaaaaataaactatggttgggaagaaaccgaagatcaagatgactgtcgaaatgttgcaaccaaatcttggaaaggattgtcgttctctttttgatagtacatggtctcaacactgctgaaaacaagcaaatg

SEQ ID NO: 82099 - DNA, 71031 bp, Oryza sativa
tgcttctcccacccgcgacatcgccccactccacccgccttgcctcgcttcgcccgcctgctccgccgttctcctcatcgcccaacgtcgcggcacccgcccgcgcgggatcgcttcgccgccaccgacgacacagcaccatcaacgccattcacgaccgggcgccgcccttgccttctcccgtgtcgtagccgccgccgcctcgtcgcccgccatcgcctcctctcccgcctcaccccaatggcctcctcccagcagcgtcggccggcttacctaaagaagagaagagaagagtgagagagaggaggaaggaagaggagggggaagagggagggtgttgatgtggcatcctgacatgtagggcccacgtgggttccttgctgattcagcaaccatataggacaaaatcggggtaaaaccaccgaaggacctaacatgaacggtttttataaatcgagggatgttatatatctatttttgtggttgggggacaatgttgtaactcgatgacaagttgagggaccttcggtgtactttttcctttcttttaaaggtatattggtttggtatttctttttctttttttagagagaaaaatgggctggtatttcagctgccagatagtcagatactccctccataaaaaaaatcaaccttgtactacgatgtgacacatcatagtacaacgaatctggacgtctataatgtgtcgcatcttgtcttttttgggacggagggagtagaccaaggatacaacttagctacacaaacacaaaattcatttgcacgaaccccactccatgtgatccaaacggtgtgattttgcgaagttggtgtagcttttctggttagtttgtttttgtggtgaaacttgtttactggatcaaacagatgctcaagtttacggctaatcatttttttagtgttaagactatgtgccgttgataacgatgtgatttcgtcaatatcaacatatgacggcctaatcttgccgagatacttgtaaaaataggatgttcatgtgtgcgtgttcacataggtgagtgtacgtgcgtctgtgtatgtgagtctttgggtttgtattgtttgggtttgtattgtgtttctcacataagaacagtgtgattttaaaattcattttgcctaattcactaaaaatgatccatgaatatcaattttcagaaaagaaataatattatgagtttgttggaattaaagggacctcaagtaagaacaaaacaccataaaaacaattctataaactttagatacgaaaactgaagcgtaccagtcaccacttgaaagcaagagctatgttttgatcttccgaaacaataggcagatctaatttcttcagctactaacagtggattggtgtgtacactgttttgaaacctggccttgtatttgtataggcaaacatgacgtgttggattcgtgttctaacttctaaatcatagtactccctccgtattttaattttaatgtatgacaccgttgactttttaaccaacgtttgatcattcgttttatttaaattttttatgcaaatacaaaaatacttatgtcatgcttaaagaacatttgatgataaatcaagtcacaataaaataaacgataattacataatttttattttttgaataagacgaaaggtcaaatgtttgttaaaaattcaacagcgttatatattaaaatacggagggagtggaaaataagcaggcagccggtctacaaatacatgcatccatgctcctgtaatacaactcttgatcgccttattttttggcctattaacgtaacagccaggaaattattctaacgccaacccctccgcggctccgcctgttaggacaactagataaaacccgcgtattgctacaggagttattgtgataacaaaagataaaaataatagtatgtaacgtagattaaataacataagcttatatatgttgaagtgatttaaatttaagtagtatatagaatgattattcaaatttaaaagtaagatgatttggccagagaacaaaagaaggaagataatttagatcatatatctaagggttaaaaaattgagttgatatggcttaacgagagaaaacagagataacattaatgaagtgaggatgaacttatatagccatatatgtatacctatataggatattataaaaaataataaaaattgagttgatatggcttaatgagagaaaacagagataacattaatgaagtgaggatgaacttatatagccatataggtatacctatatactccctccatttcgaaatgtttgacaccgttgactttttagcacatgtttgacatttcgtcttattcaaaaacttttgtgagatatgtaaaattatatgcctacataaaaatatatttaacaatgaatcaaatgataggaaaagaattaataattacttaaattttttgaataagacgaatggtcaaacatgtgataaaaagtcaacgccatcaaacattttgaaacggatggagtaggatattataaaaaataatggagagatatatgtgaattatgtggggatgatttaacgtgtttgcattttaatttctaaaatttaataaattataaaattatggataatatagcatgctttcataatgcttaaatataataattgttattggatgatagtgggtgatgatgcgacatctttgcatgttaagctttagaatttagtgggttataagttatactaacttatactaagtgaggattccaacaaccttttgattgtaccagtttattcagttagagagatactcgcgtttgaaattttctgcatgaaacgatcaaaatatagacaacactctgatttgttattaatttcatttagaacatcacggcatagcactagtagtaacagtacacacgagctgtaattttgtcaagcaaaaccaagcagcgccacgccaagcttggcgagcttgaaggcggcgtcgtcctccgccgtcaccggcgacgtcgcgttgcccccgcggaacccgtcctcgcaccgcctcgccgcggccgccgactcctccagcgacgacctcgcctcgccgagcctgccgcccctcaccgccgcggcgcagccgggctgcctccgcgcgatgccggcgtacagcgcccggcacgaccgcaggcaccgcgccgtggcggcgtccaccttcccgccgcctccgccgccgcggagcagggcgtcgatcttgaccgacgtgctggtggcgttggccgtgaggaggccgacggcgacggcggcgaggtcccggtagctccgggcgccggcgccggcgccgacggagcccagggcgtcgaggcagaactggacgtcgaagtaggtgctcccgccgccgacggtcttgcacgacggcagcaggatgccgtcgccggtgacggtgacctcggccggaagagcggcgactacgaagaggagcggcaagatcatcaggaaggggacggtgacgccacgcgaggaggaggacgccatggccgtcgtcatggctgaattttgtttctgcctggctggccgagccgtgcgcgtgtgcattttgaccttccgaaagactaaacaaaaaaagaaattgaatatttgaattgactagaaaaaattgctcatgcgttgcgagagtgaagactattttaatcttattattattatacggtttagataaggtgaaattcacggtaggaatttacttggattttttttttataaaatcatgagctgcaattaagagtctaatcatctcaaggtagcatgtgcgagtttttttaaaagagatttcttatatgtctccttctaaatttctaaaagtgaataaacttaaaaaccgattcaaacacgctttagcgaatgaactaaaaactgacttaaatacggatgacgtaccaaagtaccggtaaaaatatgttcaatttttataatgtttaatttccgtaacgatcaacatttgtctggatacttacttattttagctttacctggccgatttctttcgacttcggattataattatttatgtactttatagtaacaaaattataaaaatttaaatgtcaattcaaaggtattgttttcagcaaataaatattaaaggtactttatttattattttgaatggtagaaagcacttttaggctgtgttcggatgccccttttctcaacctctctctcgttttccatacgcacgtttttcaaactgctaaacggtatgttttttgcaaaaagtttctatacgaaagttgcttaaaagaatcaaattaatctatttttcaaaaaaaatcagcaaatacttaattaatcacgtgctaatggaccgctccgttttccgtgatcacgattctgaatgggaacttcttctagcaaacacagccttaataggtcttcccgtagcgtcataccggtatgcatatgtataaatagttaaatatagtataatttttttataagatacattaatataaattaattagtccaaaaatgcaattacaaatttgatcaacacttgaagaaaaaaataacaaatcgcattatgtagtgtcaaattttgttgttttttctctttctagtaaatcaaattttcacgtgcatgtttttatatacatctaagagcaagtacaatagaaaattataaggtagctacaagcacatatgaaggaaaggaggagaggagagagaataaaagaagatactacctccatcctaaaatacaaagcattttaggatagggagtgcatatttatagtcaagtgcaacacggactataagaaagtatgtataagaggtgagaccagtattaatggtgtactacatatttatatatgaaactattatatgtgtaaactactagattagctctatataatatctcaatttttagagctagcgggctattaaacttgctctaacaagacaatcgtttttttttttcggggaaacaagacaatcaatttaacattgcatttgcatgtactaagcaaaatatgcaattgcaccggtatagaaaatttatgttccttttgaaatttgaattgaggtttgatactttcaaattttgaaaggtgtgtctcttggcccacctcttttaatacaaaattgaagagattgtggagagtgtgccaagaatagctggttgcccatcccagctttcccggggtggttgcacaagtgtctgcaacccaaaaacacttcggtgctcaagcgtaggcgtagctctgcagccctgttttgaccatttgaccaaccgctaaaccatgaacaacgttcttttgtttatctgaaggctaaataatggataatatatttttcaactatacgaaaaagaattactacgtaccatgatatctgaaagctgttggatctagcgaggatgtcatcatgcaaggacgcagtggcggcggaaggcgggtgtcaggtgggacgacgaggcgaggtggggagccggtgcggccgtgcgggtgtggtttccacctcgggcaggagggctgagtgacagagaggctgctatgtggagaaaggttgcataagtgcggatctgacgaggcatgacgcatagatatagtcaccgtggagacgtggcagcggtgagttccctcgtcgacggtcacctacgtggcgatgggagacggtggctgagggcatggtaggtggttgttggcagtcattaagcataaactttaaccgtcaactactgtataaaagatatcagcaatacattatcaaaatttagtgacaggagtttaccactaatcattttcactagttttggtaaatataatggacctccgacgaatcaagtgcaggcacacggattgatgtgcccacaagtcagcttaaaccgacttaatatggggccaaacatctgtgtaccgccttaggagcccacttgctggtagcctctggtgaaaggcggtggcgagaggtggggcccatgggtcggccgaacccttggttcgaccaaaccacccgtggctcctctcatcgccaccttacacgtggacatctgtgatggcttcccaatgatggttacaagcacaccaacctccacaactgccttacaaccgccattctcaagctataaaaagaggaggcttccacacttctcaacacacaactttaagctcaagtagagtacaacttgaaagtgttaattaagcctagatgggggtgaataggctaattcaaaaatcaactaaaagcagaagcagtaattttcggatatttccgaaattttcggatatatccgaaaattttcggagtcagcacaaacaggaaagtaaatcctagatctagttgcctacaacaagaatatgctagcacaaacagcaactagacctatagcggctcaaacaagcaaagctagaggagagggaggaagtaaagtcaccaaagatgaagctcacgaggttgttcccgaagttcgaattcttgaggggattctactctccgttgaggagctcactaagagccgggtcttagctaaccctttcctcaagaggttgcactaagcactcctccttccactaagggtatctcttccctttcagaggtgagatctgaccttcacaaacttctcccggccaaccacaagtagatcggtggctcgggagcgacacctagccgcctaggagttctcaacctccaagagtaacaaatgaagcaaagaactcccggagatgatgcaagtgctcacaaatcttcatgaagtcaacaacaagcactcacacaaactcaaatccacaactctcacacacacaccaaatccaaatcgaacacgggtgagaggggaaacaagaaagcaaggcacaaaagtgctagagagagagcaagccaagggcacaaatgattggaatggaaccagcagccctcacaagtgaggggagggggctatttatagccacagcccagattctgcccgttatgcacaataattgagattttcggacatgtccgaaaattccagctcagcaccaacagcaaagtcaacgaaggatttttcagacattccgaaaacttttcggacaagtccgaaaatttctagtaccaacaacatcgttctggatgttctcagaaaagtccgaaaataactttcggacaagtccgaaaatatacagaagcgaaattgactctactgatgattttcggaaaatccgaaaatcagtttcggacaagtccgaaaatatacagaaccacttttgccttcgcagtctttttcggaaagtctgaaaatcactttcggacatatccgaaaatttccagaagcgacaatctggttctgtgtgttttcggaaagtccgaaaatgagtttcggaaaactccgaaaaaatccagaacacaccaaactgaggagaaacaccttttaaaaatagattttgagcactttgatcactcctcgtatgtcaatgcatcatccctcttaatagtgcggccttcctattaactcaaggaaacgaaaacgtacaaaataccatttgctcatttgccgcatcacatcacatcaacgtattccgcgggatatgcattacgctaactcattattgaggacataacaaccttcacatttgcttaaataaaaatattagtcctctctaatcgcattgtaattaatcaccaaaatcattaggggcctagatgcactttcacaactcacttgtagtttcatatttagtatgttactttggtatagagtgaggggaagctccggaaggagtgcctcgaaatatcggagttccttcgagaattttatggaggagtgttggagtgtcagtattcttggaacggagttccggagaaaaccaggattgtcggccttcttctctcgcttatatctcggcggatactttctttattcaagtaagtgttcaagtttctttatgttctttaattaatttatttaattgagatatattctcatcggtgcgggttcattgcttagtgtgcaattaagtgctctattactagaactctggataaagaaagaagttcctgcgcaaggttagagtagtaattaataacttaggcgtggtgtctaggttaaaaattaccttcgtctgttgtgtgctcaacggaaaatgaggtaagcggcatgtggtgatagccttgtccgtccttcatattcctccaccatcgggtacatcataaagctcaaggccaaactaatcctggcagaccaggggagggacggtgcccgaagcattcaatagagttgtacctttaacttaattaattaattaaaagatataggaatcctctctagccaatttatactaagttgttgtccttggatcgaatcttgatagttgattatacacacattgtaaggggaagtgctacaacggtattccatgccctggccatggcttcttcgagcctagtctagccatgttcctccccttgttgagcctccggcggctatcgtcgccgaccccccgagtccaccgctggttgccatttttctgacccagtcatctgaccaacattggtgatgcatgtggatgccttttccttttctctttatttctttgtttggattgtccgattggatttcaatcggatttatggacaaaaattttcatggacgatgaaagcaaattgaatcggactttcctttttttttgttttaattttttcatcgttattacggacgacagaaatgttttcactttttaagtagtagagatacactttgataccatattgttcaacccaaaagcttaagctgatgagaaaaggtggacaattcactttatattccaacactccctcatgcgatgtcacaccctgtagttctcctcccaagcctaaaatttaatttataaatgaccctaagaaaatgccggtgcaaatcaagagaaaaccctaagaaagtaatacaaataataatcgaatctggcatgtggaatttttagtggaattttcagagccctagaaataatttttagtcactaacaggatttttagtggaattttcagagccctagaaataattttaaccaattaaaattgagcaaacaatattttaattccagggaaaatccttttcttcctttttctttttctttttcccccttttcttttcgagtgggccgccggcccattctccttcctcctctcccctccgctgggccggccgaaggccaaggcccagctaggccggccgcctccctcctcctacccgggacgccgacaggtgggccccacctgtcgggcccatctcctacctcgcgcccgcgccgccgcgcccgcaaccgccgccgcgcccacgcctccgcctcctccgggccacgtcggtcacgcccgcgcatgcgccgcaccttccgcgcccactcccctctctctcccgcccgcgcccgcgcccgagatggccgggattcgattttcgaatcctgcctctctctctcctctcccactcccccacgttggccggcggaatctcgcccctaccggccacgttcgagactcccctctcctatttaagctccgccgtcgccccctctctctttttccccatttcgccgaactccctcgtgctccccatcgctcccacgccgtgcacccacccgccaccgcctttcccgccgctccggccgccgctagccgccgctaggctcgccgccgcaccgcgccgtcgccgccgtcgggttcgcaaggacgaactccaccccgtccgcccttcctccgtcgggattcatcgccggaattcgcatcccctcgcgctccggtgagttctacctctaccgccgccttcggccgtggatgccggccgccgtggttcatctccctctctctaatctctctctcctccttccttagggcaccccgaagcccgtccgccggttgccgtcgtcctcccgtggcttgccgtcgccgttcgccgtcgtcttcctccgcgccggccaccctcggtgaggcttcctctcccctctattcccctccctctccttcctagccgccgcttagcgccgccgccttcgcgtcgcctttgcgccgtcgccggcaacgcgttcgcgcgcgcgcgccatcgccatcgccgtggccggtcggccggccttgagccgagccgagccgggtcgccgccgcccgtccgatcaaccccgggggcgatctgggccgtcggtcccgtggaccggcagtggaccacccacgtggtcccggtccacggtggaccaccctcccttgagccgctgccgagtagggcccgcttgccggcgcaccttttccctctctcccgagccgctgaccggtgggccccgcatgtcggcgccgcgcccccccttgatgacgtcagccctgggaattattgcgcaataaatgatttaaggactttttttatagtaataaacacagtgaatcttctaaaattcataactaattcatctgtgctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgagatagtcgccgaggtttctccagcagcagagcaaggcaagtcatgcttgtcacttgaacatgttgatcctatattgcaaatgctctattgtttttcttcaaatattgcattgttttataatgttactatggggtgtttacctattgttacagccatgccatttttgataccatgctcctttgttagcttgggttataacatgaatagattttggactaggaattgcttagccatgcttagttccactagcacacaatggggaaagctcactaaaatatagactttaggttcaattggtaaggttggtttagtaccaccgttttggtgttggtcaattaaaatgaatcacatggtgggctgtgggtgcatggttctgctagtcgcacccatggcagttaaggaccggttcgcgggatgccctggaagaacttatcatacttaccacaagccagcatgggcaacggctgggcttgtagtgtagctttcctctagctgacgcatccaggcaagggtgggcgtgatggagcggggcgggccctgcgacggcctctgtcgcttctggattcacctaggcacgagaggggactgcccgctgctttgcaaggagtgggggtgaaacctgaggtgtggtgtgcttggttagagggggttatgcgaagggtcctgtcacggcctctttccggtatgtcgtggtggcatgtcggcgcacggaaacgtgttatggggctgtgtcttgtgggtatagttgtacacctctgatcagagtaaaactattcgaatagccgtgcccgcggttatgggcggtcaaccagattcaccgtgattagtcttaccctagtttagtctaatgaaattggatagtataggtggatggttgggcctgttgcaacgtgggatagcgttggacagcggatgatcaatattaattaattattgcaactgtttaattctttcaacttctgtttataaatgcttgctttatgcaaatgaaccactctagctctcctttgataatttcctgcatcatacccctattccggtatgacttgctgagtacagtgggtagtactcagtcttgctctattttttccccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtgaatctgaatgtcaacattgtcatttgtataccccggccggtcctggacggggattttaatgcacattctgcttggaattctattcgggaatttctgggcatgacatgcgaggccctttcaagcctccaacgtgggatagaagtgggctgcaattttttatttaattgcacgccagccagaattcgaacttgagacctttagctctgataacatattggatagtataggagggagagagatatactgcgtagcgtggatacattgtatcgagccttaggggccgatatatatagaagtacaaaggagaagagataagaaatgattacagatatggaatgaatccaaataaatcaatcctatcctaatataagtctagctgccatatactctaacacctatcttgaattgtcaaaatctgaaaaattttagaattttagttaccatgctaaaatattggtactgtcaatacctaggcaaattttgatattgttaattttttggtaagttgtgtgtgatgattggcatgttttgttagccaaaatactattgaaagtgctatcaattttgtaaggcatattttgacatcaaaccaaaataacccttaattataaaaattgtaaaattattcagtccgaagtaaaaagatcagtactaaaacattaacaataataagtgacacaaacgttcactgttcaaataagagtgctctatggctccgttcggcagtacaagttcccaactcctctttctcgtttttcacgcgcacgcttttcaaactgctaaacagtgtgtttttttaaaagtttctatacgaaagttgcttaaaaaatcatattaatccattttaaaaaaaatagctaaaacttaattaatcacgcgctaaaccactgcttcgttttgcgtgtcggagagtgaccctcactcccgaacagagcctatatacttttatgtaatatactatttaaagtgctctatactcttatgtaatagtcaattcatagtatactattaatatctggtcccacctatcatacataaattacatcttggaatccgtactgcaccgctacttttctatctctttctttatctatacctaataaaaaaattcgtaaggcttccgtgaggtttttttcgtccgtcggcggtttcctgccaaaatacgttttaatccgcttaatagtcggtcggaaattttccaatctactccaaaaccttgcttaatatatgatatgtatcagtcatgtatccatcaatcacaagtagcttgcccgcctggttggtggagagaaaattttcaatttgcccaccagggttcgattcccatcatctctcctttttatacacggctatattgctccgaataagtctactgtgcctcccacatctcattacttcacctttcctaggctgtattgctcggaataagtctacgatgcctcccatatctcaaatcattgctcggaataagtctactttgcctcccacagctcaaatcctactcagaataagtctacttttccctcccacttttaaatttgaaaattaaacataattatatttttcttttcatcatctgcaaaacacgacgacatattagagtccgcgccatctatttgcacctctttcttcaacagatagtgataaatcttataatgaaccagattttaatttgaaaattaaacataattatttttttcttttcatcatctacaaaacatgacatattagagtccgcactatctatcgtccacacatgagccgtgaaaatgattcgtctccacgcaagtccgtgttcgattttagaaattatatcaagcgcttaccatgaatccgatggctaaaaaatcagaagtttttgcacctctttcttcaaaagatatttagtgattctgaaatcttataatgaaccattttttaatttgaaaattaaacatatttttttttcttttcgtcatctgcaaaacacgacatattagagtccgcaccatctatcgtccacgcatgagccgtgaaaacgattcatctccacgcaagtccatgttcgattttagaaataattatattaggcgcttgccatgcaagagttgagagagagtgcatgttatgaaaatatgagtatatcaatatgcaatagtgtttcttatcagtcctgattatcattaacccactgaataatttatctattttggaacattattatatacatgttaattgtgtatttatagcatttaaccttttattatacccgtagcgaagcacgggcattttgctagtctctttaaaattttataactggtttataggttgctattgtacctgctcttactctagtgctgtgcaaatttttgagcccaaactttcagaagagccggaaccgatgaaacgagcgagtcgccgtgcaaactctacacaggatacgcgtcaacgcgggacggtaaaatccgcgccgtccaaatgaaatccaacgggtgagacggccgactgtttcccaagtcaccgtacgcggatttattacccggggtgtcagaaatccaggcccacccgtcagcgacgcgttagcataataagcaggcaaaaccacacccccctttcggcctcagatctcctttacccgcctcgccgccggtcgccgcccgccggcgccgccgccgtcacagccagggaagaactccgttcgccatggagggcgtgggcgcgcggctcgggcgcacctcggcccgctacggcaccacgacgacgttcacggggcccgtcaggaagtggcgcaaggactgggtgcccgtcgccgccgccgccgccgcggcggcggcggcggcgtcggccgcctcctccacggcgggggccggatcccgcgggaacaatctcgtgctcttcaagtggaccccgatgaacggcgccaacggcaacgggggcggaggagacggagaccaggcggcggcggcggccgccgccgcggaggaggagaaggccacgaaacggcggcggtacgtgccggtgaggactctcgatttgattcttgggatttgtgctttctcggtatattccttgggccatcgagggttcgatttggtgtccggattggatctttgcttgcttgtgtaggtcctggcagcttagatgattggataattctggatcttggttgatgcgagctcttgtggaatattaattgaattgacgcttttgaattgacggtttgaaaagaattagggttcgtatgtttgaaaaacgattatgaacatcaggtccccaaatatgttggagaattgtattttggctaactcaaggaaaataattgtttgttaggagtctagtaactgtacaatttgtagcgttttggtgtaattaggttagtgcttaggatatccctggttataactatagattgtttcattacgtacagtaatttcgaactagttggtgattagtgcagtaagcattatggtgggggtgctatcaaacaggatagctaatgttcttggttaatgagaacagatctgggctgcaccctcaaggctgcaactataattgggactattcatagtactatcgttgacataattcttcatgatttccagttgttccttttacactacagtccgatgaagtgtatgcgatgcattgaagtgcgcgggacttaattacagcagcaagaaactcagcattaaactatctaagtaacaagtaaactactaaactactgacatcagctcatgaaacaaagatccaaaaacagcagtataaattgaaaatattctatttacggtaaaaatccataagcacttattgtaaatttcatagatactgtaaattttggaatttttatgtgaatttcaaaatagactaacataatcatggaaagaactgtaaaactacaaattatttgttagataaattacagcgtaaatccatcatatatacaatgtaatccaaccaagagggaccagtataagtctagaagaactccggttaccaattatttccacaatcttgtccattcaactttatcactgcttaataatgaccatattaaatatttattcatctcagtgggaaagctggtggattatcataggctcatagcatataattggaaaaattggtagagtatcatagatcctgatagcataactggtgaataggtcctgatcatgcacactgctttctcatggtctagactcctcatggttagatagatggtcatgctcctcccttgtggacggtggggcagcagccagcaggcagaggcatgcagctcaacaaaagggttgcagacttggcaatcaaaacaattgtagcacacatgcacggtaaatcagcacgaatctaaagaaaatcccaagggacaacaaaggccttgtttagttcccaaaaacttctcccaaaaacctcacatcgaatctttggacacatatatggagcattaaatatagataaaaagaaaaactaattgcacagtttgcatgtaaattgcgagacgaaccttttgagcttaattaggccatgattagccataagtgctacagtaacccacatgtgctaatgacggattaattaggctcaaaagattcgtctcgcggttttcaggtgagttatgaaattagttttttcattcgtgtccgaaaaccccttctgacatccggttgtgacacccaaaaattttcatttcaccaactaaacaggccaaaactactgcaattaagctatatctgtgtcgacacgaatatggcaaaccactttaattaatgggctgcgggctgccactgagtgaaaagaagtggaacagtttaccatccttctgaataggtgttgcatcaggtttagtcttggatgttcatttgtatacttgcaggcttacttcttaaaacttacaacagtcgtttgctagttttttcattctattgtattctagtgccaatattactaagttcactatattctagtactcatcatgaaaagctcttggattctataggctcactcgtgttcgtgtgctgaaatttcctcataagttggttcatttttgttgagaacaaatctacttttttgaggaatagtgtgtcaccatcttctccaatgcttgtttatgtatatttgctgattctggtttggcaggtttctgtagttgaagatgaaaggcaagaatctggaaaatctgacgatgaaaataaggcaaatgatggagaaccattatccgccgaaactgagccatctaatggaaaaactaatattaatgatacaccaatggatgaatctcaggtaagatgtcacttagcattcacattgttgctacaccgttttctaatataaaccagtgccaattatacggtttgtgacaacctttgtcatgtggttttgatcctgttgttgccatgattgtttgcatgcaagcaatgttatagtacaaattgttgttataatctcatgcataatatttgcttggtaccttattgaaacctcttttttgatctaaactcgattttattatctgcccccattttttggtgaatagtaagcagccaaggcattcagactatgactttgctgactatgaatctttttctcctgtttagtgagatattttctttccctattgactagacgttcccttttttaattattctgcttgactgttttcttgtcaaccattgtacaaacacatttttacacgtttctttgtcattgatctttcctccacgtccttcaggcatcagatgaggcccgatattctggcaaaaatggcggtggaaccgacctaaatttaaacttgggtctgaaggaccctgacggagacaatgatattgatactgaagaacaagatgctgaaaacaacacacacacagaaaataggctgaagaggaaatctgtagctcctgaccttgagatgagaatgtaaccggctgcttcatttattccttggattctttactatctgcctttgggcctattgtgcaaactttcttgacatattgtcatatttagaggcaattcaacacgatagcttacaggaccagctatagtaaaatgtctgaactgaacattattaagtcaaaattttctcggtctgttgaacatctgaaaagtagtagttttatgttcatcttcaagtccctgcatgactggtaatgtttcatactacacttttgtgcgttccactctggagttgccaattctagtgtaggaaagtaaatgtagtacgtgtgaaagatgatttaagaaagaaagtagtgcaacgtgtaattgcagggtaaaggcaagtgacgagagaacagcagtgactgtagattgtaggcagtggcactgatcagagtttctatgatttttttttttttttgaaatctgaagtgtgattgtactagtagcatgctttgttgcttttctgattctgaattaagtgctgcgcaatcgttttaaatgaacgtaaaaacatccgtattagtaatggtttatcgctttatcataaaatgttgcattgagtctatctataaaataaaatgtagcattgagtctatctataaaaaaaaaacatttggccgttcaataggatatgatgatatgatcatggctaccattaatacaaccattgttcacatcaagatcaagttgtacaagtgctggaatctaattcagccgtctgctatagtactgacttcaaatggccgcaaaatgtatatatatgcttcgttttggatccataataagtacttaatggaaagctctttccaacggatctaacatcatcgctaaattccatctatgggcttgtaacttcttctggaattttttttgaaaataatattattttaatagaaaatcgcaaaattataggtcggctagacgaaatcgcaagtttagcgccctgtcgaactggggcagttcgataggtacccctgtcgaactggggcagttcgacaggggactgtcgaactggggcagttcgacaggctagttgtccaagaaaacaaataaaaaagtacttgctacagtgcccgatagggacgtatcgaacagggggagttcgatagggcgcgtggcatggacgtatcgaacagcggaagttcgataggcagtgtcgctacagtgccgctacagtgtgcgctacagtgcgctacagtgtttttcctttttttaagttattttattacctgtcgaactggggcagttcgacaggtaccctttcgaactgcctccgttcgacaggaaaaaaaaattgcgatttcgtctaactgacctataattttgcgattttccattaaaataatattatttccaaaaaaaactcacttcttctgggacttagacccagtgagcctatgtgggtgcgccccaatcaggtggagcacccagtgggcccatgtaggtgcgccccaattaggtggggcacgacggacccctaggttatcctcccacttccttaaatagatccctaggtcatcctcctgtctccttaaatagtaagtaccacctctttaggatttctcggattctatttagatgattttgtttaaattaaagtttagtcatagctacttgcttgcagcgcacatgtcgactagaccgcttgtatgttcggcttcaaaacctcaacttatcgtgtgtattcaattgtgttcatcttcggaacccaacttatcgtgtgtattcaattcctatttgtaatatcaaattgtttttattttgttcttacttgtttcttcgatttgcttgtaagaataaagttgatctgcaccggcaagatccaaaactcatagatcgacacgcccgtctgttcgtcttcggaacccaacttatcgtgtgtattcaattcctatttgcaatatcagattgtttttattttgttctagcttgtttattcgatttgcttgtgagaataagattaatctacaccggcaagatcaataactcatcgagctatttacaatatcatattgtttttattttgttcttgtttgtttcgtaggaataaggttgatctgcaccgataaggtgtatcgatcgcaaagacgcaacactaacatcttgtatggttgtatcaggttgtcaacgtttctttcaaatcatagttatctttcaacttatcgaaagatcgagctcaaggtttatcacatgatgaaacggttcgatagatcatcgaatggacggttgatccatttatttcctgtagggcataaaatcagtccgagcaaacaattgttttatgcaagtaaggagagagaaatttgactacaaattgccatttcaggcgtacacatggacatggctttttttttattacacagtgatggctggatatgcctggatcaatagaaagggacggagtctgcactaaattatatcaaacagaaaggtaaaaagaagacgctcatcacagcaaaatggcatttcgtattacaaatatccttgaaacaagtaacctatggatcggcttatccaactaaaacgggaaaattgttgatcggttgatacattagtgcaaaactgtgtctgccatgcccttcgaagttccaaagaaccgtaatgttttcatgcaagtgcgaagcacttgtctggctgcctagaaaaatccctgaaggacaagtcgatatctaacttaatctgacttgtcagatttctcctccggctcctcttcaattggaccaccttcagtgacaccaacttccgcaggacggagaacacgatcatgtagcatgtagcccacctaaaaaagaaaagaaattgttaccagtactatcaaggtagcagcattggaggactgaagatattggtgcacaagtagaaatctgggctggttgtccagggaatcactttggatcattcccattaggaatttctggggtttcgattgccttggtaatatttcatctttaaacagatcaaagtgtcaccaggagctgtgggggcatcaggacaagataaaaatgtataattgaaatacgcaatggttccctggtaaccaaacttgtcctaaactaagagtataatatgcattgactagcattagctctgtaaaccttgcccgtatgtactcctagtaatagaggtagtttcctaacaggtgccatcttttagcagaaagaagcataccggcagacaaaatcccaacagaaaatgaataaaggagctacaaatgtgagccatgtttaaataatagaataacagaaagcaaccggctattaaaaatcctcatctaccttgagttatttactacacatacctccatacatatacttatgcagttttaaggatagactatccacttaatgttattctgatggtgtaatattggaagtaaccttgcttagtattaaaaatacagacttttaagtcattcttaggctgttgcagtgtactttcctcattgttatcttaactaatgatatgcacatgaaacaatttattatcatctctgtatttcatctcattctgcagcctagacaaactctatcaagtgatttgatcgacataactataatagaatgtgatatacaaataggcaactttaaaccaacaaacattgaggttaagtaccggacttgaatgagctcttatttcagaagagaaagggggtaaaaaccctataccaaaattatcggaagagcataccttcacaacagccgcaacagttcctgatggttttgaaggatcaggaatttggaaaagcgcagcatgcttatttggatcaaatttctcattaagtggatcaaacttttccactccaaacttcttgaagacctgcacacattaaatgttattgcctttttgctgcataaagatgtaaatttgtgtaaacacgcaagcaacaggatcaaaataagtttgaatgcatgttaccaacaaaagatatgataatgtctaaatcattggcagcatataatcattaagacagggaccataattccaattcacagttgttacgaccaatgcatggaaagttgttgaaatacctccccaagttgcttttcggtcatctcaacaccctctaatagggtgtttagtagcttcactgcttcagcagattcattagatgtatctatctttgagaagctctcctttacaacagatgatgccctagataaattgtctgcaacatctaacaagctcttggagaagccctacagggatgaatagacgtgagctcatttccaaagtaaaacaagattctaaaaaatcatgaccagacatagaatacagacctgtactgcatacttctttgcattatctgattcacgctttgttctcgcaatgacgttctccatctctgcatagctgcgcaaaactttatccttcatgtctttaacttcttcattcttagatttcaacaattcttctttctccagaactagctttgtcaggtcctcctttgacaggtcaaggtcttctgtatctgaatcagaaaatgcagttcgtttagtacctctcctcctcctgttagattggggcacagaatcttgtgaacctgcttgagatgcattctcggttccaggagaactattggtttcatttgaagcttcagattgagtgcttttattaactccatcctctgtctgtttatttgctgccttatcatcttgctggggagcagaagatgaaaacccaaacctttgaaaggttgaagttgagtacagcctcggctgattcagcagaggcaaggcctgagcgtagaaaaaagggaaaaattatccaacagtccggaagatgaaaaacaagaccaaacaagaataccctgagcaatgctacaaatacaatggatggtgtcagcttattatgcctgaaacacctaatgagccgatgaatcaacataacaggctgcttccagctttagattttaatagctagcttatgccaaaggctatcagaaatcgttatgtcatcagcaacacgttactaatgagaattgagcattaattggtacttcgcaaattttgtactgttattaagtatccccagttgaaacaccgcagtattcccacaacgtatgaacacgagctactgagcaaattaagtttttaagtttagcgcaaatcatgcatcaatcgatcttaaccagtacctcagctgcccaacaaagaaaacattaggacaaaatagcacaaagaacttgtatataaaatcaaacttaaattctattaaaaaaaacccatcaatagcgaatcgagtttagattaaatcaaaaaccttagagaaccccaatgctccccctagttttccacgcacaggatacccgaacaaaaaaaaaagcaacttaatcgacggatgcatctctaaaaccctaatctcgcaccaagattagcaaccccacgacggcttaacccttcgaaaaaaaagcacgacgacacacacacacacatcgctccatccgactcagacgagggaatcgaaacccccacccccaccttgatcgaagagcagggcggggccaagtgccgccccgccgaagcgccgagcagcgccgccgcttccgcctgccgcctcgccgccgcggccgaggccacgccctgcctcgagatacgcgcgaggagacgcgccgccgcagccatctctctgtctctctctctctctcctctactctccttattcggtcgtcggcggcggagaagagaagggaaagaagaagaagaagagaagagaagaaaatcggaggcgaagatttcgcggcggcgaagggtctggaagggttttgggggaaaagctggagtggggatatttgtggacaaagaccgttctacccttagtaggtttaacgtgttctggcaatgaaggcaagggtagttgtgtccgtttcgtttcctcttcgttgacatgtgcttgtcgtgcaagaagggaaagcgtgtggtttatactcctgtgctccaattcaaatggtaaaatctaaatcgaaatgcctctctatttagtcttaactagaaaaaatatccatgcattataacgggtaaaagttattttaatcttattattatttactgtgaaatacactatcagaattcgcttggatatatatattttttaggaaatcatgtaagttagcatacaagttgttttgaaagatttcttatacgaccttatgtatttctaaaagtgaacaacttgaaatccgactcaaatacggatctgcatttccaaaagaaaatgaaatgtattttccaatacggttaaaaactgacttatacacggatgacgtaccaaagtattggctaaaacatcttcaatttttataataagtagagatagaagatgtcacatacatcagataagtactactatacatctatagacatgcatatcttctttgttattatgtcatacatatctttttttccttcttataaaagttttcttaaattacttatctgatccataatctgattgtaccattgtgttcgttataattaaatctttgtaacaagatcttacatgaatatttttatgataaaaatatttatatttgtaaattacttttattatatatgtaagttacttttatcatatatataaattacttttggatttgattaaattacttcttatacattcataattctttgagctgattacttttattactgtttttagccaattttatattttatgttggttaaacttaatttctagatagactcatgtttttatccctataacgaatttacttctaatgttgtaacgacttacttccattttaagttaagttacttttatgatttatgcaaattactttcaaactttattggttttacttttataaatgtatttacttgaaaatcttctctacactttgcttgtggatttactccacatagtttcttacttcaactcaatcagaatgtaatttcttctaatgttatagagagttgcttctattgcatagctaagtaacttttacaattcaaataaattatttttaaattaataaaatgttagaatatattcaacatggatctcattttgtcacatattttgagtagagtacaatgatgtaaataaatcttaaaaataatatgtgatttaaaatatataagtcattaaaaaggttaaaaaaagatatgtaccataggctaaaggaggatttatatattggatagaatggtttccgattaggactaacgcactgccgtgctctacctagtcacatccaattcaaatagcctcttatattcctcgtctcgtttatatacttataaggacatgagcagtgtataatgtttaaatgggtcttaaggtaagtcacacatagacctcattgagctacagcacttatattagaatgtatatgactacgagaggtgttaagatcggacccaccttttaccatctcaaccacttctttttatcttcccattcaatctcttcttctccaccgaacaagagagacacaactcacaaatctagcagtggaaggagctaggtcgtggtgacaacggctacatctaggaggaggtcgtgacgaccgcagcccacgggatgaggtgaagcagcggcggtggtggcctaagcgctcgcaggaggtcatggcaatggcggcctgtgggatcaagccacaacggtcatggtggttcaggttcgcaagaggaggttgcgacggcgtggaccgcaggaggaggttgcagcagcggcaatggctcacaggtgccctcctcccttttcccatggcggcaagcaatgaagagagaagagtgtgctagaggagagagatgaacaattgttttttattccttatggctaggcattagccataagggtagctcaaccaaaagtccgctataaatactactcccacaatgtatatagactacttaggaggcttaagaccccctctatttccacaatgtggtcgctctaagttaaaacttaaatataaagtaattttatattgttttgatcgtagattatttatatcattcgcttttgagtcactaagcactcatacataaaattttacccataaaatatattttgattcctaatagacactatggataagcataagttaaacaatgggatttctaaccagaatcattcaagggctttcaaagtcaactaaaagaattttttttaaagaaaaatcataagcgtggtactaacatgtttgggggagtttctagcagagctccccaaacagtctaagggtctgtttgggggctacagcttctcccataatcataagcttccccccccacccaaacagtttagctttggttccaatttttcaaaagctatagtggtagaatctaggaaataaattagaagctaggaagggactacaaatcgggtgcccgatttataagagaaaattagcgcactctaccgcgttactcctgctcctcgtttctttttttttctctactgcatacattgctcctgctgcatgtttgtttatgtctctgttgcacatcttcttttcccatgctatgcatgcaggagtcctctacacatgcatggctgcacggtgcaccccatcctttatataattaatatgcccccgcctctttaaatgatttttttcatctaaattaaaatcatatttacgaatcgattacaccattgtactccttgcaattaaatctttaaaaaataagatcttacacaattatattttgatgagaaaaaaacttatatgtttcaccatgcttaatcaaatgttccaattaactttataaaatgtttaggaaggtgcaacattagaaaatactgattgcaacatcaacaaccattgtatgaaacattgagtcctaacgaatgaaacatataatatatttgcaaacacttgatattgttgtttttttttgtgactactaaaacattcgaagaacaccacgtgcaacatttgcaatcaactaatgaaacatcctaaaatactagtcggaacatccgagtaaaaccacatgcaacatatataaaaaaaatccattgaaaaaagagctaaatatttttctattagaatataatcatgtaaggttttattggaaagatttaattacaatgaatataacgataaaatcggatgatagatcatataaatactagatgagaacaaatattttaaagtttcttaaagaggctattggttacatgtggaagaatatatagccaaagtggagaaaagacacgttgtaaaggacagagcatgtagagcctctgctgcctttggcgcagcagtagtagcgtgtggggggagggcgcccgatttttcagtatggatcaggaggccgacccgaatcaatctcctagaagatatagtagaagttaagaaacccagcttttctagattatcataagctagctatcaaccatcttcttcttagaatctctccaaataagccctaaattttcactcagattctgagaattataattgtagaatctagaaaatgaactagaagctataagatgtgaaagtcatctttcaaaaaaaaaaagtgaaacccagtttttcataatacatagttgtacaatctagaaaatgaaaaatgatatggaatacgttgctattaggaattcacaatgtgtgagtcatctagcattatttttttggggggataatgatttcatgaaacataattttcacaagaagtgtgctttgcatgatctgaactcatataaattacttatctcatttggttttccaggccgtccatgcctcatggtaggcgactatcaatgattgatcccctctactacgaagttcacttgctacacctatagtccatttacacttcatctttgttggccactagctcagtttagaatttgttcaaacacaagccaccataggagatgcaataaattcgtcatcagcaatgtcactatctaaaggccattgatattcaaggggaaaggaagaaacatgaaagagaaaggaggtagaagtgggcaaaaataaccaaaacagctttttaaatatagggacttctcttatgctatttgtcgaactacaaataatcaaatatgtgtagtgtgtaaaataggtgaatgggttatgtgtgatttgtgatgcccctctttgttttccttatgtttgttatgtagatcttggcgcggaatcttgatgataccttcttttaaccattgaacattaagatgcacctttagatgctttcttgtgaaagtatattctccataataccacttttctcaataagatattgtcctattttgaatagtatagattctatatgaaatagtatttatcagtcatgataagactatcgcaccttaatcgtgcctcacacgtataggaaaaagtggagcaagcgagtgtatgctaattgacgctgaagagatcaagttttcctatattagatccaaccatatgtcacactattatgttttttctctttcaagagcttgaaataacacgtactcctatttcattagagatacatgcctctcgtattcataatcgtatgatcaagtcttctatttagagtacaaacatatacaattaaatgtgtaacagagtagaatggaatggagtgtataacgtgctatgtgcgagataggtgaacgagtgacgtgtgtcctatgacacccctttttgctttctttaggcttattttatatatatatatatatgtatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagttcaaaagtttgaactgaatttgaacttgtttttgttagattttgattctaggtatatagcatccatacatatatttagttaggtatgtaatcatggattgtgaaataaagttaaatttgagttgttttgttgataggtataggtatgaatcgaattattataactaggtatatactcataatttgaaaattttgaaaaatttgagtgattttttgcatttgataccatggtgcccgggcaccatggtgccccatatgagtgtcctatatatatatatatatgtatatatatacatatacacatatatgtatacatatacacatatacatatatatacatatatacatatatatacatatatacatatatatacatatatacatatatatatatacatatatatatatatatatatatatatataggctttgacggggaatattgatgatggatactttttacatcgaatattaatgatgtgacttttgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccaccccctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcaccccgacatggacgtgaagatcagccctccgtgcccccggccggtggtgttggctgtagagcctttgtggcgagtcttcggaacgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgttgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagacggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggccccaggcccccgacgaccggagtcggccctccacccgcttgtcaaacggcgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcgcgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcgacccgaccccttaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcggggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggtgtcgccttcctcgtcggagctgggggcgaacgcaagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttagcaacccgctgctccagcgcggctctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggtggcctcgcggtccatcaagcccctctccacggcgccggcatgttcttccagcgccatggcacgggcctcaagggcctcctcgcgccgccgggacgccgcttcggcttccgttgcccgccgctctcgcgcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgggccttacggcccacctccaccatggcgtccaccgagcgccgcccctcctcgacacgcgcccatgcggcctcgagctccgctcgttccgctcgcaaggcctccacctgggcgctaaatccatctagcaccgcggtgtttgcggcggccaaggcctgcataatgggctcggcgctcactggggcgacgagagaagaggagaaaagccgccttggagaaaaggcgacgcggcttggccccccggaggatgcgctgggctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcttcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcgacctcggactggccggacttggggcggcgggaggaatgcgacgggacatcgctgaagcagaagaaaaaaccaaaagacgaacaaaatgagtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttcctcccagcttcctcttccccggggcgtcggcagggcggctgctccccgagcccccgacgcggggcccagaagcacgaccccctcctggggcagattttttccccgggcggctctcgcccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaaaggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaactttacacatagatggttctttctccataatacttctttgaacactaagatattgttctattatgaatagtgcagattccatgtgcaataccagtatttatcaatcatgattacgataagaccatcacactctaatcatatgttatacaagtataagaataatggagcaaagtgcatgctaattgctgctggagagcttttttttttctattccctctattttatattactgagtttatcctaagttaaacaaatttgtagaaaaatgtactaatatgcacaacatcaaattagtttcattaaatttgtcatcaagtatgtttttttattttatgttaaaaatgttattaattttttatataaacttaatcaaacatgagtaggattgacgcaaagttaaagtgactttgccctcagtcaaacttttttttagaaaaatgtactattccacaacacccaatttgtttcattaaatttattatcattgaatatgtttttatagtatctttattttatgttaaaaatattgcaatgtttttctataaatttaatcttggacaagattaaagtgagttatagggcctgtttggcacagctccagctccagctccaccgggagtggagctggagctcagctaaacagtttcagctccaccaaaactagaagtggagctgggtggagttctctcacaaaatgaactagagttgtggagctgggcttagacagctccacaactccactccagacctaactcctagagctaaacttaggagttgagctgtaccaaacatgcccataatataacaaagtgggcacttcaactctactctatttcctcgataaaatcatatcttactgttgaccgttgattactccgagtgcagagtgtttttatggggaaaaaacgagcggggcatgtaacctccataaataagtccatatgggtgggtcacaattatctcgtgtatgggttacacattttgaaatttactcccgaaatttgtgatatattcctgatcattcaaacttcctggaaagatttatacatctttgaccttttttaccccttttagtttccgttgttttctacacatcagatgcactctttctataaccccatgagctcacaagttatgattatgacagtccattaaaaagagcaaacgagataatagcaatttagagaaacagacaacattttctcattaactaccactgtgcaacaacaaagcatgcagttacaagtttgattatatgcagaactgcactagggtgatgaatcaccatgtgggcgagcaacatgcagatgtatcaatgagaaggatttttcccttcccaataaatagttgtcaaaatcattgcaacatctgatactgcctctacaagtaagaggtcagacaaaaaaccgggtaaacagatttcttacccttttttcccatgtacagcgccaccaattgtacaacagctgcaaagagatgaggaactgatgaaaatatgttagcaccaggaaagccaatccatgactccattctcatctttcaatcgtgttccctcaagcagcatcagcagcaaatccaggagagaagcatggctgtctttctttcatcagataaataaaccttagaatttcctgccacatcaaaaggagagctcggagctccgagggccaactggatcatggagaaacagctcttccacttgttaatctctcaccagctgaacagagatatatgtgacagcaaaagcctttgcttcatccttctggcattgagggtctatgattggtttcctggccgaccgggacttgaagaaaaggattccagcggtcaaagatgatgcgacctccccgtccaattctagcttgccaccggaatggtggagcagtagtaccactatcaataggtggatctagtggtggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatgaatatttgaactatcagagtattagaggcggaatcattagagcagaaacatgctggctgctcgaactggtaatttagaccagaaacaccaagtcataatttgctatttcatgcggttgaccgagcaactaataagataaattcatatacacactatatataactcatagccacggatattatggaataaattcatacaaccacatgtatcattttataattatgacttaaggtgcatttagttgtaaggatgttacttggattcccagtaatcatggggtaatcctagttgattcccatgtttagttgaatcacctggaatgttaattaagaatataggattctaatacaactaagattctggtaatatgtggtattaggatcccttttgaaacaggtagcttggattactccccatcccctagcagaatcttatcattttctttctcacatgtgcatgctataatgttacattcccagtatctaattctcacactaaggattacaggggatgttaagtttcccattaatcttgctttcctgtaactaaaccgcacccttattatgtttgctatactaaacaaatactcaaaaggtagcagacatataatatgtctaaaagaaaatgtccataactacaagcagatagcctgttggtttgccccatgcatgggctggcagtagatagtgggttccaaccctagtccgataggtatttctgtggaatttaccaagcaaagccgtgcaaattccaagaaggttgtgccggttgctgggtttaacagggcatggcctagtcgctgtgtacaggcttttcactgttaggccagtgtaattattggcaatgttctccatatgaatttggtaaatcaaggaaatggtcaccaaagagcaaaatcatttccaccaccaattacgattagcctcactgtttctggttccagttctaacgaatttttattccgatcgattcagttggtagaataaggaaacagtagttggtggatcaggaatttctgctaccattttcatccctattgggaagagttgactaggaatgtattggttagttatctttgtgccttcaatagctccaaaagaagtgactgtatactcatcagtagaagtgctggttacacttagtatatgttgtgtggggtgttggggggggggggtggcaatcgtacacacccatattgcaaaacagtggtaaattctacgtcctctcattgcaaaaatcgattggagttgtgcaagaacaaagaatattgccatattggtattaatgattttttgcccatcatttagacctaaattggtaaggtagctcatttattcatgggagggcagtactacttcagagaagattttatgttaaaaaagaattaccaaaaaaaagcatacccttttgaacaaccagccattctggtggggtcttctttttagctcacgctcgcgcttcaaacgcaatggcggaacagctgatagcttattatcagggaatctaggatgaaaagcaaccgatcgtacatatggttgctcgttggccgtatcatctgaatctgcataatcatcttcacttgatccagcttgctggaggcctgatagagcaatcccatcatcaataagctgtgcctcatgctgaacaaggaataaaattgttaatcataggagataattttgcctcttaaattttatctgttttacagaaagaagtaaagcatttggggaaaaaatcctatgagactcagctacaaaactatatgcttttagacagtaattatggcccgtgtcacactttgagaagattctaaatatttggtagtgccaaaatcttggtaagtattacacatgtttggattgttaccaatgtgaagccaaaatttgatgatacagataagaaagttctagagaataatgccaaattgttcaaaggccttaccaacaatttggatttagtacaaacattcactagtactattcaaactaccaataaattgttatggcacatgttggcatcaatccaaaatggcccctagtcttataggaatttttttcccaagcatataggccgtaccaaaaaggtttacaaatactccctagaaataataaactttaagatgtgcaacaaatcccgggccatacagatcacatcaaagaataaacttatttagctagaacacataatctgatgggagctttcaggatttgccactacattgtaattcaagtatgtcactctgtgtcagtgatgtggattttggtgtgacatgtttgtgaggaagtggcaagttcctctttgtgctttccaacaagacagaatctggagatttgcatgtgatgaaaaacaagaataaaatcaacatcgtgtagccacaatgaattatccatctactacttgaacacataagggcattatgcactatcatactcacaagcaatcatcttcattttgttcgtttcttaaatatgtacactaatctactgcagaaaaaacgagggaacctacatattaagagtaatgaaaattaaacacttgcaaaattgcacttctacacttagatgccgaagccatgtatcactctttttagactaagcagggagttatgctcggaaatgtatgagatcatgtgatgaaaacgtaagtcataaattagcatttttctttccaaaatcaaccaatacttactagcaacatcctgttacacacctaccagaactttcattttgtttgttattcttcaacatgtaaattcaaattaattgctagtgcattaaatggtagaaaggaccaaaggacagaaggcatttcatatagtttaataaagcattatctaccttgtatctcatctggatacgtcgaaggtgaacctcacactccatagtctcacgttttctctcttccctctgcgaagaggatgagtgcacggtttagtatttctcatgccaaaattggcattatttaatgcatttgcataccttaatcaatgcgcccattagtgccttagcctgctctagattgcgccggacctgtattggggttttaaaacataaaaataagcaaatttaaatatcagtgtacatagacaacaagtgcatatttcagatacacaccatgttgcaagcactacagaacataaaatatgatggttatgattaagatcgtgcactacacaagaacacaaaggcaccatgacaagcaaaaaaacagagaggcaaacatactgcactattcatatcaagacattaagagttatcaataattggtccttctctgctttcttgacagtcaagaagtttgctattcaagaggacagcaaaacattcgatatttaaggataagcttgattgcttgaatgtatttgcagtctaagctagtgatagtcaaccaaatatggatcttctctagaaatacaattaagaaatatagaaatatgatgttaagataatatgatcaacccctggcacatttaggttttgatctgaggctatcctggtctgcgggacccaacacaagtattcatcctttccaatgaaaaatagagaacaacaaatacagctaagacaatgtcaaaatacttgtgtaataattagaaccatagtttcaatcaagcctgtgtatatttgtgtccaaaaaggaaaatatctaaagagttcaaaaaactacatatgttttgacaaaactattgaaaacaacgtatttaagcccaccatatcacaagaatacatatttaaacaatactataacataacagcagatttaacaatgaatttatcacaaaactatagatttgtgaatttacgtttctggcactattgtactgatggaacatttaaaattatagtttgcaataactaaagccatagtgacaaattaatgttagtatgtagttctgcaacattgtgttttaaatttatatttttctgacaactgtcaaatagctgtaatgttgtaaaatttactctatctagaaagatgcacaagtcagagacttcaacaagaaaaggataacaacatgccataaaatccttggataaagaagaaatgcctatacatacgcaattccaaaaaccaaacatatgcatatttccataattatagcggctgctccttgaaaacccaactattgctgttacacttaccacacggagtttgtcgaatgattggacactattttctcgtctttgcatctgaaaaaataaatgaacataagtacacaaagaaatataggcacacgaagatattatcactcctgtgctttcttgatgactcaaaattgtccaggagtagctattgtcaaactagtttcctgtgactcaccctccttgtgtgaagacgataagccttctcccttggtctgaacacattgtatggatttgtgtcattaactggcggaggcggcttcaccaaaagaagaaaaaaacagttactctaaacagttgtgtgatcaagaaagcaaacatataaacagcggtagttttgtggtaattttctacctgaccacagttaatgaaagaaaaagtccattttactcccccaaactagtttctagtttctagtttggggtgggggttcaaatgagccaaaacctagtttaggggcttaggtgataaaatgcaatagttcgggggagtaaaatggacttttttttttctttaatgaaatatgaaacagaataataactcaagaatgtgagccaactcataaatagtgaatttaacttgcttttgaacttttccgcaactaacgaaattcttgaaactaagacctgtcattgggcagagaagcacttgagtaataataaacaaacaccacatgtttatccaattactttctttcatttttgtagacctttgtccccagtttgttcatttgaaaatgcaaacatattataagcataagccatgatgctaggagcaccttgcaggccctactatcatttttggggcaattgctcatttgaccctgttttgaagtctaactaccaatctgaccctactttttctagtttgcttatttgaccccgtttttcaaaatcgaagatgaagattgaccctactctgtgaagtcaagataacagtgttaactaagggcaaatagtcccttttgcccttgcttattttgaccctgttatggcagatagaccagcgcgctgctccctttctctgcacaccactgccgtcgcggcctcctcacctagtgccagccgagagggatgaggttgggagtgaatggatagggttgggtcctcaagggtattttggtcagtttgaatagtaatttgatttttttttctttttactaaatatatataaccctaacggtgtaatggaaatagggtaagacggtacctttgttattgaaaagtggggtcaaatgaactaactagaaaaggtagggttacattggtagttaggctctgaaaaggggttaaataagcaattgtcccttcattttttttatggtacagtttatcatatttttcactatactaaaggaaaaaaattttaaaagtagtccatcgtcccaaaagctttccatttctcctggcgaggagaaaaacagaaactgaacccagtggtcacagaagatcttgaatcctccatgattggtgaaagccatgaggaatctgttggaaaggacctgttaagatggagaaggggaagccttccaagttgaagataattactgtcaacaaaaccgccatctgccgtccaagcttcctgctagaaagctttccagtcaccataaaagtcactatccctactggaatcatccactagaggcttccttggtagagtagcaaatgtcccgtgacttatccttgtatggaagagatctggttagcaagatgggagactgggaaatggaactttgacaagcctgatggtttagttaggtcaaccctgcacctcacacagcctgctgtttcgaccatgtgcagcagcactaacacagcccgacctagttagcagcctagttattatgatttggtccagattgggctggtaggttgctcttcaaactttgaaggaacccatcaacaacagcaaaagggattttactctagagaaccactttgatcttttcaaaacttgtagtcacaaaatctgtcaattcagtaaaattgattgtattttgcgcctactgctttaaaaagagcttagataatatctacaaacatactacagtagttgacaaaaaaagttcatattatatttaaaaagtaactgcaataacaaacacagaccaaatattgtgcacaacgataagctcagatctaaatctgtacatcaataagaagtgtgtgaaacataaagatagaaaggacaatacaaggacctaagctaacctgcaaacgtcgcaaaataggcttttgccaccgctctctctgataaaggaaaaacgaatcagtacatacaatgaataatattcatatatatcaaaaaaaacatattgctattgatgacaacagaacaatctcaaatttggttttgaaaaaatataacatgttatcctgtagaaagagacagttcataatgttgtctagaaaaggaagatgcacatgtcatatgataagaatcaaaaacatataccatgttctaaagatggaatatacctttgatttccagtagttatatacagcctggaacacagcataacgaacagacaagtactgcaaagcctggataaagaaacaccttgtaaagagcaaattatagataactagcaaagtatccatgccttgcaatgtatttcaaaatatatatctaaatttcttgacttggaaattgtatttgtcaaacataatttgcaagcaaacatccaataataaaccaagccacacacacaaagatatatttatccagccttagaagatcccaacaactctaagtgatggcagattatccaccacctctaggttcttctatatagtagagattccattccaatttcaagtaatagataacaccagcacagtaatatatgttttgtgaatcttgaatacccgaagccatacctgctagctaatagagcagtaacatcagcagtgacaattctgattaaccaacccggttctccaaacaggtgtgatgcacaaaaaaaaaataggaaggccttaaagtcacatccttctagagcaaggtttattccaattggaaaggtcctctccccagacctgaccagattggtgtagaatatattcccctttttttttctacggttagttaattatcaatttgttacatctctagtacttactacattagcagatctgcttatctgataagctctgttcaggtgttttgagactacatctctagtacgttctatggtaggagatctggtaagatagaaagtactaaagatgtaggctccaaaaggaacgaaaaatcatcaaatctaacaaaagcatccttctacagaccttctgtatctattcctccatcccaaatataaggacttctagtgtttgaactttgtccacaaatataaggatttctaaagtactatggacttccctgcatcaaccacccctcatgtaattctcacccaaccttacccccaactaccctcatttaatgaggggcatcatagtgttttcccttcatcattaatatctccaaaaaaaaggcttgaagtccttatattttggaatggagggagtacatcttagagacttttactgtcaagtccacttcttctctaaattcttaatgcatctttcaggaaggtataaattaagccacttctgttggcgactctacaaaagacaaatacatctggagtcgcatgggtaaaaaagaataaagctgtcatggcattaaaagaagaagaaaatgatttgtttatttggaaaagataatagaaaatcacaaaacattcagaaatgaaaagtgtgtactttatgaagaggtaggcagattgataacaagaaaatatttagtctactgattgaactaaacttttacattgttccagatttaacaaactctattgtaatttatatgctactcactcttgtgttgctccattctgagtgctatcaattgttccttttacttttcaatgacacagcacatatacctttttatccctttttgtgccttgatggtaattggtgaagagttcaaatgtttttggaagtcatgtgactcaaatcaaactgataaacaagaaactcgccaactcaaccaagaactgcaaactacaagtgaccatgaaatttctctatgaaatattacctccatggcagaatcaagctgcagaataactggtattggtcctaaaaaggtgggggttatgatgcctgctctttctcgagctttgtggtccaatgtttccagtttgaataggaggacctccaacctgtaatgtgtattcttattagtaatgtagcaaataataccttctattcagttactacaaatgatataaggcaattattttcatgtcaagattattttactatatactagagagaatgattggcatgtgtggcatggtatagaaatgacatgcaacttttggttacaaaaaaaaaaaaactttgtcatcacttgacattttctttccacccaacattctctccctcaccactcccatttgtaggacgattagtggatggtagaaaagatggtgtacactgtatttaagtataagattgccactctcataacttattttgatgagcaatttattccttacttttcagggttcagatttttccgctcattgttatagtcttcaagccaatcttcatcttcattgtccaaatcatattcaacaaactcaccaatctcagccctggctgcaagcagtaatttctctaagaaatgcaaccactgaagatatattcaatttttatttccatttcaattattgcggtaacaagaaataaacctcctctggcacgtatgtaggatgttggctgtgcaaaggtacgagtatagtccctttcgtatgtatcaacatcatcatactgtggtgtagggtatttcttgcacattcttcttgctggatgttggatgtgcctgcaaagaaaagaagtgtttatatctgccaaactgtaaaataaggatatcatattatgatcatgcctgtcatcaagcaaactgaactatggccaaccaactagtttattctgatcttatttttttagtgcagcatctattataaaatttctcattataattaataaactctgctaggaatttaaaattagattcaccaaaaaaatatcatggcagaaatagtggctcagctcacataaggtcaagatataaacataatggctggcttgcagcttatggatgctaaacatgtcttgaatcttaaaactaatgatacaaatttaatattaggtcaaacaaaacagcaacctctggattttggggcttatactgtttgtgctttgcatgtgtccgaaacaaaaagaaaaggtttgcactttgcatagcattatcagcagttttaacaaacaactttcaaattgtcaatgattagcaagctgatcaaatttattaaccagcacccccaattattccatttctgcgcacaaaaatgaattagcaagcaactcaattgtggagtactggcagtgaaccactccaccaaaacagcaaagaaagataacgcaacactccgtgcattacctcgccatcagccgcgggctccggctgggagtgccgcagcaccggcggcgcagcccgaagcgctagcgtggtctcatcgtcctcaagctcacgcgcggacttgacgatggggagcttcttgtgaatgtcgagcgggcgcggcctgaaggagagcctactcatggccgcaacttcatcagcgaggcctcaatggagagccttcccttcccgcggggggcacgggagagcgcccgcgcgggacgagccccccgcactacgccgaaccccgtgggcgagggggtgaggggtggtcgagggcacggccgcgggcggcgcggggagcgggcgggagcggaggaggcggcggagatggcggagaggggattccggggcggtggggtggccggaacgggcggattggggagctagggttagggtttcgggggtggaggacgtgccctagggtttgaaacggggagatggagggaagaagcgggggatgaagcagcgagagagaaagagtcgaggggaaggggaaggacagagaggcttggttcggttgacggcgtattccacgagtacgtttccctcgtgtggttacgtatccgtctcaacggtccatatcctatggacacataggcttcccatgtatgcgaactatcaaataaaattctaaaataaattggacgcatactttcaatagtattacacctacatgtgaaatcttatcttcaaatttattatattttagccgtagcaaaaacgacaaaattctgatagaattttacccttaaaactattagaattttgttgatacggctaaaatataatgaatttgaatatgaaatatgtgtaaaaaatatatattttgtagaatttttcgtgatactttctaattggtgtgcacgggaagatatgttcccctttccagacaggtggtgaaaatccttttcgcgtgttattttggttacatttggtttgggggagtttgagaatgctaatggaagcataggagattagagcattttaatctttgaagaacatgggaatttgagagagattgaaatgggaaattgatcgaactcccatcgattccatcccaaccgttcatcataaattatgataataatttcttatctcaaaacccacaaccgaacaaataacataaattcccttttaaacatcccctattatttctctctagcaactaaataaggaattgacagcatgtttggttagggggaattgttaacagggatggaactttgagaggtacaacctactgtttggttggtggatgtggaagcttgtgagggatttgagaaggagtttaaagagcaaactcccaattgggtaagggcatgtaatttctagggaatttcttttctaagtatgacgagataaatctgagctttacatcatcacttaaaattcaattatcatccatactacccatgattctcatctctactaccaaataaaagactgggaataaaaaaatgaaactcccataactcactcctctaaaacttccaatcccctttcattctcttggcaaacaaaccatgggactaaaaattaaattctgatattaattctctttgtcaacttccatagttatttttcatgcccttcctgatcgttgccatacaagctgaaacttggatattgacaggaagaaatccaaataaccccatgagcttacaccctagagttttatatgagcatacccccaaaatgaaaccaatcccaacattttggatttcctttttttttttgaaaaatcggctccaacagttcccctctacagatatgcaaaaatttaatttgcaactccatatttctcgctcttcacaagctggatgtggtttctcactcccaatccgtcgatctaagggtgttagacatgtgcaggaggggatcagggactcgcaacgcacggaaagaggccaccgatcacaccatacgcgaggaggacagtgaaccaatgattctcttggtatgggatggacctatttttttattactgggagttaacatttatttatcttcttacagggatgaatctattcacacctaaaaatctgattacggattcaagaatataattttgggatgtatttttgggctttcttttggcaattatctagaccattgactcttgaactaccttatttgatctaataactcttctttttaactcataaaattttattgtatattaagcagtgtacattggaagcgaagaacattccctaaaacatcaccatgcaaaaaattaacaacagcaaacattaaggaccatatttctgaaagaaggtaaagagattgaatggtggaagcaaactctcatactatctgatacaacagtagtggatacaatcatcgggggcccatggcattgctgcgatgattgcacccaagggcctcttcaaacatgattcccgcttgacctgccagcaatccctccgactgcctccacagatttggcactaattgaggtttggggttgagtcgtagatatgttggtggcttcaccgaactcaaccgatgattgccatggaggtcaacgtcaaatctaaggaacactatcagcattcctgctgaccaaaatcttaagcttttgaaatagaaatcatatattttacattttccctgtttttgttttcatacatgaaggccttgctatcgttccatgtggagaatgccccccttatggcacggtttagtctgttattttcttttgtcagaatggattcggaccgccacttctctaaaagcatggttcttacctccctctctcccccctccttcagggtcgtccattcggtgggtgatcccttgctctcaccttcggattttgatagttctgatgatatggcgaattgcagttatcttggtgaattgacttacatgagagtcgaccatgtagacaaactgcttataccaccaataaaataaaagttatataccaagagcggatgtttactcattgactattctttttaagccatatgtgacaattttatgttctccttaatattgcgtcgtggcccaatgagtgcgttggcatgacaaaaatgttgagtcacatgttgtgcgggcaaaaccacttcgcaaaaccctagagggtcatttggaccaaatgagaaagttcaaggaacttaatacccactttaacagttcatgatgatacatgcctccaagataaacgtttagggggtatatggactttttccatattgatatgtatcgatgttgtaaatttgcttccaccgctaactaagggcctattctaagctttaactccaaacgacagcttcctcgttttctgttagcatgcttccaaactactaaacaaagtattttatgaaaaaaaaattatatatagaagtttttaaaataatcaaataaatctatttttattttataatacttaactaattatgtgctaattagctttctcctttcgcgtacactgaaaatctccctccatcgtcaataaacaaacacatcctaaataattgaagttgtgtaagaataaaacatatatataacagttaataagaagtaggttacttgaactattatatgtttctttttttaaaaaaagaagaaataacgtactcagcgcataattcaatttgaatatctggctacaaaacacaagcattttaaactctaatgaaacaacatgttatcgtacaaacaaatctaaccctcagaatataataacaaaaccatttccttaaaactaaacatttttggtgaacttagtactactaataaagttggatatcatagcattcacaaaataacttcatcctccatttcacattataagatgttttgggttttgaatagattctttcatagatccatgtatatgcttcacatatgtgtctaaatgtatatggatgttagtaaatctagacaagagatgaagagataaaaatgtcttataatatgaaacggagaaaataatacttagttaacaatgcgtctcattttgcatgcaacttataagctccctaactcagtttcgaactaagcctaagccaagagcatttacaacgctccactcttgcatgtggccttaagtatccacctcagagccgagcgatcatcttagtggcaaaagtggtcttacccaccttcatgtgccttacagaagacacaacgccctggccccaaaaggactaggatgagaggggagagaggtggctggtgacatagatgaagaaggacgcatgacttagctagatcgacgatatcagctcctagatcgaagtgaccatgatggattgatgactagacctggtggattaaggcaaccgcacctgattgagggacccaataaccacctgggattggaaagagagagcttcatgattgtgagttgcaaggggagagatggtggtggtagtgactgaggatgctgaggagatgacgtcgttgatatttggttgtggaagaggtgagggcaacacccggggatcatggaacggtaaaaggtgaatacgaataaagagaatatgatgaaggggtaagttgctccataaaatggatcattacaaaccaacatgatgttccgatatgttttttttttcaagttcttataactacctatatatctgtacctgcttaccaagtttatcatcagcataatctaatctttctttgtatgcagctagtatacgctttagatcaccgcaactacggcccacaagaccattcaattccaaccgggataagtctatttttcctccctcaactcatggccgtgtatgaatagcatccctcaaccgcaaaatcgggtataacccatcccccaactctgaaaaccattgcaaatcaactccccgggcggttttggaggtggttttgtcctacgtggcacctttgaccctattgacttactgagtcagcagggggccatatgtcagtgacaaggataaaagaaaaaggtggggcccactgtcaaccacacttatcttcttctctacgcccttctctcgctcctccggccgatcccggcggtgatgtgccaccccaccccgccgccagtcgtcgaggctgcgccccgctcttgctcggccgcccttcagcgccacgctccgctccgcctcctcctccccacccccatcccaccctatcgcctccaccgctgccgccatccccctcctcagatccagagcggaggagggcgaacgagatgagggagctggccggcaacccttggacgtggagtggcttctcactgcaggtggaccagcgcagcccgtcttcgccgctgcgtccatgtgcatgacggcctcccccctaggcttcgccgcctacactagtgcgtgccatatgggtttgcaaatatttgcaaatcgattggggattctctggtgacggtgttttgcgtgctttggcagagtgatttagtgctgatcataagcatcatagtatcatacacgcttgaaaaatcatgatacagtcgaccaaattgctgatcgatagcttagtaaatttggtcagcatggtatgccacccggcaattttctgattgatactattgttggggtacctggctatctgcagctttgttgatggataaccattgatcttgcattgttttatatccgactgcttgcttcctggagccgtttgtagatgtaactggagatggaattttgcagcaattggtcttgccactgccgtctcacgtgctgccccagccaagtctcccccgaggccggccgcacgaatcacgctatgccgcgggccgccgccggcaatccatgtgcactgatgtgcagacataggtgcaggaggaggaggggaaagagcggcggggagaagttgtcgtacatgacggtggtacgggcggcgctgctcctcctcgtggcactcagcgcactctcgctgctcgccgcggggtctcggaacgaccgccatgccggcctcggtctcgccacgcttctgcccatccacagctgtccccggcaagcctcccccagcaacatcgtcgcggtggctaggcactgtgatggcggcgagctcctagccgtcaggatcggccggaggagcgagaaaagggtagaagaagaagtgtggttgacagtgggcccaccgtttttcttttatcagtcactgacaggtgggtcccacctgctgactcagccagtcaacagagtcaaagatgccatgtaggacaaaaccgcctccaaaaccgcccggagagttgatttgcaatggttttcagagttgggggatgggttatacccggttttgcggttgagggatgctattcatacacggccatgagttgagggagagaatgtggacttattccattccaaccagacaacgaagggcccacggcgcagtcagacttgttgttcgatttcgcctcccctgcaagccagcccgcatggccagatcgccggcgccgacgcgcaaacaccctgtacgtacgcacgcccattgttcgtgacctccccaactttcccacgggcggccacccagtcccagccaccccaccaacaccaagctttcgcgtctgccgaccaagacgaacccaatttgactgccgctgacctgtgggccccacaaccaccccataaataaagcaacacaacaacgacgccgtaacgaaggagcagcagttgcagcagcagcagtgtcttcttgcagagaaagaaggaaggaacacgaaggaaggaaggcggcgacgtcgagatggtggtgctggtggtcgccacgacgtccgacgccgcgtcggccactccggccgccgcgttcctcgccatgcccggctggacccccggcccctccatcccggtacgaatgcctcgccctcgccctcgccaccgccttcttccctgcctaactcttcgcgcggccggcgcaggacggcgtggagagcttcgcgaacggcgcgggggtgcggctgctgcggcacgcgcgcgggatcgtggaggaggacgacctggacctgcggtgggaggccgccacgggggagcgcgtctccgaggtggtcctcctcagccgccacaccgccgtctccaaccgacccgcgctcaccgtccaccccatcggcgtcccgcacctcagggacggcgtggacgtgccgccgcagggcgggcgccccgggtgggccgcgccgcccaacccgcggatcgggccctggctccgcctgctccgccggatcgccgccgaccgcggcctcgtgccggagtttgaggtgattactttacttgtgttttttttttaattttgcttttttaatttcctttgtggaattggggatcgcggttgtttgcattggttgattgattgattggttctcgtttctgcagattacgctggagggcactcaccatgggccagtgaccaacacgccgacgctgtttgttgagattggtacgaaattctccacaccttttctttctggggtttaatccactgtgtttacttaattattgctcgacagccagacatatctcacaaattagattattcatagtgatttctggataatgttttgtaacttcatcttagttgatcaacttaagttcattaagtttattctttgttttttctgttcccctgattcatttttggacaggacagtttatctgtaagttgcataggctaggaattaatgcctgcaccccgtcattgatgaacgttgtattgaatcctaaaattatagggtgagatcttggattttatactgacggccgaaaggtcctctttgttctgacaccccaaagtatgaactagttcaatggttctcttcctgaatctactatatttgaaatgctatccagcagttccctgaataaaaataatataaataagtatgatatttataatagtagaaagagaaaataatcttcaaattgattcttcaggcacacagatagtttgaagtacaagtaattatgtcctctctctcaaaagaagtaatgttgtcctgtaaatgaacagtttgaatgataggtcacataaaaggatatatctgggcaacttgcgaaagaaatgtgaaaatacaattcagatgacaataaatttcaggtgatattgcacatatagcaatagtacataaacatcaacgatttgatacttaactcattatatcatgaaccattgagttatcactttttctattgttaaacaatatattttccttgcatgcccacgtgacattgatcaccaaatacgtttaacaaatttatttctttaacttgtgtgttgtaggaagcactgaagaatactggggtagacaggatgctgctgacgcagtcgctctggttagttttcccgtttgtgttccatttcagcatctgggcgtggacaatgtagatgtttgtatggtctaccatgattttcatgttctttttccttagatatctggaattggttccaactttatggtgatattattgttcattttgcatctttgtgatgctaaggaaaggacatgcatttctgatccttagtgtcctctgtgattttgagttcgtgaacacattgtatttatggtgaaaaacacaatggaactcagtcttataatacttgcagctgctatggaaaggacttggtcttggagaagaagaatctgttggaaattggcatgggtatgtttgcatcccctctcttgctctccctctctattttcgtgtgctttactatgaaaactatcaggtggagtttacccagtacaacccccccatacatcaaacatctttagaaactgttgtcctgagtggcaaatagaccgtgtttgtaccaataggtgtgtctctcgagcacttagctcttatttgctatggaagacaagcaattgttctttttctttcattcttttcatgccattgatctcagatatagacatctagtccaatgtcgatttccatactagtccaatggaaagtaagcataattttagtacatgcgaagaactctcgttatattttccaataattagcatatttgataatccaccacaactgatattattccctggaaggtaggagaccaatgtatcaccgtttaatgctaaaagaactaatttttggcacttttttgatagtataatgcacacaccgaacgctttgagattgtttctgttagaatcaaaatcagctctctgttgagaactatacataaaatcactcgcccaagcatgctcccagcatgggtactcttgactatcttgcttgtatatgtttttttaagtgaactgtttatctattataatgatggtttttgctatgaatttgagctgcattaagtctgctatattttcatgtaatgcaggaatggtgaaaaagtccttctaggcataggaggtggtcattatgctcctcgtcatatggatattgtaacgtaagcgccattttctttcattgattatgacacaactttcttagcaggatctaagagcattgatttaagggagtatatttcttcaatttttgaaagcattttcgtcaatgttatatcttgaaaatgtttcaggaaagatggtgtatgggtgggccacttgctctctgggtattctttgccaatggaggaaccgaagcagatgaatggtaaaaatgtggctgacgttggcggtatgtggaagcattccattaaagtttcatatgaagcaacaaaagcggctttcccaggaggagagattattgcacatattgatcaaaagtaagatggcttaatctatagctaacttgtgttccattagaatacactatcttttaatgaacattattctatttcatgttttgggtacacattatttaaaaattggccatcctgattcatcagtaaagattacaaaacaaccatttcaaattttgccttgacggtacacatatataattgtatccagcaatctagaaaatcatcaaatgcatcagttgagggcattcttatcactggaattttataaattgacatttcagtaaaaaggggcttccttctaagggtatggacttcttcaattgtctgactgttctgttatgttccatctgtctgcttctctgattaaaacatttgaattctaatcatcatatctgctgatagtatgcattcttttgagaaatttggcagaattttttcatttcatttttattttgcacgttgctaaataaaatcttgtttagctgcagagcacacatgcatagtgtttatcatagtaggttcaactaaaatatgcagtgtatggttgcatccaatcatttcaaacgatgcatcatgcattgatttgaattttggatagaatatgaaaattgtggtttgtacgatagaaaacttacatataaataattgatactgctgcaaaaaaatcaattaatcataagacaagtctacttacggatatttaattacatgcaaacagtgttctaacaccaccagatcaaggaagcttgcaagtagtccactaatccatatagttggcccttttacttggctaacctatttatgtgactgatttgcagtaacctgaattagtgatagagaactgctcctttgtttggttgttctaaccaaaattttgtttctatttcaggagcttcaaaggatggcaaaagaacgcaattacaagttacttgcaggagttgaacatcagggtaggaaaaccaaatgatttcttttaagaagacataacaccggggtagcagtactcttttggtgttattgctaggtaattagtatgtgtatgctaaagacctcgcctccacggccctgagataataaaattaatattttgagccctgaactcgtgagttatattgcctgtgcttccatactgctgagttttgatctctgcaccgcatgagcatcacatattcacatacgtatgttcttccatcctgagaagtcatttttgtttgttagcatcttgtattgaattgtgtggattttttacctacattagccctgtggttttggttgagggcaccctatcgaagaagggtacctataccgttcacccactgtatacgaccgttctctctagtctttctgaaaaggttttgaaatcttgtgggctctgggctcccgtggaggagaaggctctcataatttccaccttgaaattttgatgagttcttgaggcgttcttgctaccaaccttgaaagagaagtgctacgactcaacttatttgcttatgtgataatgttttgtccagctgaattcttcgtgcttctcacctcattatatttttcttcgcgattgaaaagaaggttagtataatcaccacatagtaggcatctggaagaagcttcatgtttcttttgaataattggggtcaaagaattgagtatggtagtgttttgttggagctctagcttattcgacatgactgccgtactaatgaacggcctcttttagggcattaggagtgcgtcgcaaaaatataccgttcctcgtgtgataactcagctcaagaacaccaggaacattgttagctacatgctccatggtgcatatccctttgagtggatcctactagtctttttttatactctcactttttctctcctctctcactcctctatcccttctccaccagtcgaaccgaacaaagcgaggcactggaagtcgatgcggcggaggaagcgaggcggcgaccggagtgcggcagggcccgggcggcgacggcgctgggcggtggggcggacggaggcggcgccggtgggcagtccgagcggcaaccccaccaccaccctgatcttcgtcactctcccacgacggggaccaccccttctttgctccgacgaccggcggctctcctcccaggccggcaacgcggatctggcggtacaggatgacctcggagcggccggcgagctctgggcggcacggcggtgacaacagctcgatggtgccgccctccttgtccccctcgactgccgacgcctctcctatcctctctccacaacggatctgggaggcgacgacgacgacgacagagggcttggcggctcgtcggttgcagacggcgacggcaggctaggcggctcgtcggcaagaggcgacgtcgacggtgggctaggcggcgcgcgcttgagggcgactgcgggcacgggaaggagggcgacgccactcgctccacagcgcggaagcaacgctgtgcctagcctcacgcgccctctttttcgcccaagaaccggtggccttatttggacacaagaacctcattttggtgggtccggaagcaaaggcggtatgtgtcctccatctttgccgacgtgggatggcaagggagaatgccatctcagtgtactgggaaagcccttctgtttcgtccttttggggagaatatacaaaaatttcatgtatcattgcattcagagtgaaatccatgttctgggcttttactccaatactttgagaattagactcccaataaaaaaagttaaatccatgaccataagttttacatgcatgggcaactttcttttccatttagcttgatgctggtgtgggtcctaaaatccatatatcctaattttgtttgcaaggctataaccattgtggtatttattatcttattgcaatattgtgttatactaattgtagtatctactatatcctcataaaaactattttgtaaactaaggaacaatagcttcttcttcttcttcttttctttttgtgagcatcctttgcctttgcttcccttctggtgttactgcattaatatttggtatctgcactgttcggtcaaattatttccgctacttacatttatgagttgatatatatatatcatcagaaagtgatgatagattgaaagatattctgaaaggacatgtaaggcacaagccaaatgtgaagctcttgcatcatatctcaaactaactcctgcaaaattccccgtggaactggtgcaacgtaatcttgaatatttgcccgtattggtgtacatataaaactgggtatctattatatggctgcattagaatactccgttggcattatgttcctttcaggttctataaagggaactaagcaacaagaagctcccctgggagatagaggctcaggttagctgtattgtaaatttcagaaaattgcaactatagagacactctgttattgcagcaaactgaaataggtcactaatgttgcagcaaactgatagttttgtcactacgttgcagttttctaaaatttactctttcataaatgataaatctaaagaatgatttccgttttgcttcttctgtcatgaacttctgcattgcctgtgcgggcgcaacaatctatcgtcatgtctgttggcagcaataatttctaaatgaccacttgttattgctacgtgttattcatcaacccatacaactggcaagcagtgattaatatgcgatgtaatgcgctttatttgtcatgaccctgttgcccccatttttattcgcacactgcttttcacgttaactgctggaaaagaaatttatacaaattcatattcatgaatatgcaccattttggattctaaaacaaattaaggacatgagtacattgttggagttctaattacatgatcttaagctttagtctataaacaatcaccttttgcttatgcggaaaaataattgatctactgacctgagttagaagccattaccgttcttctttcttcttcttccagagatgcctcacgaaccccttccagtgcctagatcgattgggcgattaattagggtttgagattagagagagagagagagtttggtcgtctgcctctttccttctctttctttatataggcgacactggtggggctcgggggttatctcaattagtttaggattctgttttctgtaccgatcacataaaaaacaaatttatctcttagtttgtttcttgtcaggataaggaaaccgatggtttagatcctctcctaacccttatcgacacaagtcgacaaaatcaaccaacattctccccttgattttgagacttacttacgagtttattaaataaaatagctccccaaggcaatgtgtcttcaacaacattatgcgtcactgagacaacaagacctatagctcactatagtactcaaataaactcaagcttaacttagtgggtgttgattgaaaaatttagtccccctcatccaggatctcagtaaggctctaatttacatatatacctggccagaacataatcttaattaatcttatttttatgagccttaagagtatggatccattagcaaatgcttagcttaataattcgatcctgggacatgtctttcacaaccatatcaatgtgttaggcagaaaacacacaatatgttgctactagaatagaaaactgtgtttaattagtgcacaactctcactaaaatcacatcctaagggacaagatatatactgccaaacttaatgaagagcgattgctagagcctgccaccatagtaatatagtagagcatgcaagttagcagatagtacacagatattcaagtagatagtactacatacttattgtcagttcacagagcaatgtattactaaatagtacagcatgattcatgccaaaaagaacaaaatatgagctgtacgtgcaccaaggcacaagcaccaatgcactttaattatcagcactataatgtatcatgttctatttggtaaaataacggacatgacccgtttctcatatgaatttaaaaaattaaactagtaaagtttctcttaatagagtgaacaaataagacattattgcaattgctgtgaaactaagtgtgaggtctccaacaacacttcactttcatcttcactccatcagttactctgagtgttcactcccctctttgctaccgtttggacggtgcgagtttcctgtaatgagttagaaacatgcacatcggcattgagtcaaactcactaagtattaagggaaaattcatcacaagggatttatttaatttcatttatacctttcttgactaaccacgctgtgaagcgtgtgcaatttctctgccaatgtccatctgacgcacagaagtggcagtagggacttgtacttaaaggaacagctgaagtggaggccttgatcccttcttgcttctgctcaccctctggctcactattcttattagaggattccccttgatagacctttttgcctttatcaaaggcattagtgaggttgagccggtctttaatcttctgcttttcagctttctggcgctcttcctcttccacggagtgtaagatcaattcttgtatggtccactcctctttctgagtattatattttgttttgaatggatcatagttaggaccaagagatctcatgatgatgtgcactaaaaatccatcagatattttcatatccatggatctgagttgatttgccatatgagtcatctcaaggatgtgcttccttataccacttttgccattgtaatgactagtgatcatctcatttacaagcatattggcatgagtgtcaggtgcaaattcaaaactttcttcaatgtttgccagatacatcttaatgtcattatagtcaatgattcctccaataacttctggagagatggcacccttgacataaattaagcacattctgttggacttctcccagttggctaacttcttattgtaggcccacatgagattatcatattcttcctcaattatattgagttcttcggccagttgaggttcctagggaggatcctctcttatggctaagtcataatccaacatggctaagttaataagcacattatttctccattcaacattcaacgtaatttgatccatcacgaagctgaatagccttaagttgtcctaatgctgaaaaattaattattaattaaacattagtaatgcaattaatttccattggcttaattaatcacatacaaataaatcttaattttcataatcaaacaccatagggtagaaaagattatgaaatggcagagaataatgaattactgaaaattaatatcctaaatcaaattaccaaaatcaggtagatatgatatagggcataatgctattagtaaatgacatgaaattaaagtccttagccatatcaccgttgggcagaaatggtaaaggaattaagcttagtaacaaattagagatcattgatcatatcaccgtaaggcacgagtgacggaggaattaatgcactagtggcataagtaaaattctaagtcatatcaccgtaaaggccaaaatgacaaagaaaatgaaaataatgattgacgatacttagatgtttccttaattacatcaccgttgggcagaaataattaaggaaataacaatcttaatgaaatcatctttctttctagataaacttcccgttggttccattaatctagaaataaattactcagtattgcaactgatcttaaataataagcattgccaattgcataaagttaatttacattggcttaatcgatcatatgcaaaataaacttaaaatttcatagtcaaagcaccattggtcataaataattatgaataatcttaaaattaattcctcaattatatcaccgtttggtagaaaataactaaggaataaaaaattataattgacacgcaattataataaagtgggttaaatataacttcacatcttaatgctttctagtcgaatttctcgttggttccattcgactataaataattaatatactaaggaaatgaccatcataatgatgttgacatgaaatcataaatactttctagttaaatttccattcaactagaaataaattaagtggcttaaggaaataataatcttaataaatattgacatgaaattatattaacattggtcaaatataatatcatatcattaatttctttctagccaaacttcccgttggttccatttaactagaaataattttctaagtgatcaaataattgaccataattttccagaaattttaaaatagctaagaaagctcataaatgaatttatggaaataaataaaacattaaatggcgggcttaaatataataatgcggccaatatttccttagccggcccataaaaaaggctaaaatcaggataaaatttagctaataaagatataacacattatgagaaattaaattcgtgggcttaataaattaacaataaaggcccactcttatcgaaaatccggcccaaaa

SEQ ID NO: 82100 - DNA, 3611 bp, Oryza sativa
cttttgcaaaggagaaagaaggagaagaactagctcaggggcgtgatccgatcgttctatctctaaactcgcatctaaacagatcaagcagtagcggggagactgccattcaaaattgggactgatcgggcgccgccttggttcggctgaaccctggcgggtccggctggccgccaattttttcctaggcccactaattcctaagctaagcacaaaaatgacaactttgcatggtttttagcatggaatagatgagaccattatggctcataatcgattaattcaataacatccacttcttcatctaaagtttcatttggcacaaggaaaatttttaagcgttgaccgtttaccttgaatatattacctgaatcatcacggagtgtgattgccccatgtgaagaggtgtcgatgacgtcgaacggtccttcccatttgctgcgcaattttccgtggccgaaaagcataaccctggaattgaacatcagtactttgtctcctggcttgaatttcttaatgtttatccttttatcatgccagcgcttcgtcctttctttatatatctttgcgttgtggtaagccttctctctccattcttcaagttcagcaattttcatttttcttcattctcctgctccttcaaagttcatgttctagtttctgatggcccaatatgctctgtgctcgagctctacgggtagtcgacatgacttcccacagtgcgtctagcaatctatcctttcaccatgttcccattttgttgaccgtcttctgcacaatattcttcatttgtttgtttgatgtttctgcttgaccgctggtctgtggatagtaaggagtggccacattgtgtttggctcccatgtcttgtaggaggtctcggaaggttttgtcgatgaagtgagaacctccgtcacttatgaccatcctaggggtaccaaatcttgggaggatgatttctatgaacatcttcttggcatgcttcgcatccgcggtgctgcatggcatagcctcaacccacttggagacatagtcgactgccactagaatatactcgcagttgcgggacttagggaaaggtcccataaagtctataccccaaacatcgaatatctcgacttgcaagttgtatgtgaggggcattgcatcacgagcagtaattcctccttgcctctgccagcttgtgcatcttctaacgaatgcttttgaatcttcatacattgtcggccagaagaaaccacttttccaaatcctgacccgggcgcggaatgcatacaaggaacaatcacaagagctcgtgcctgttcacttcattatcaggcagtttcgttcttaaggttacaatatcaggatttcttgaaaggagtacaactaaataaatcctgtgataattcacgcgggaaagattgcttgtgataatattattgtgcttaagaacgaaggagaaaaaacgaaggagatgcacatagtaaaaaatgattatacactacagaaggtcccaatttggcctgccacattgacccaagttgaaaaggatgcccattgattcaaggcttcgtttggtgacatgcaatggtatatacgatttagcctcaaaaataaaattaatctagcggaccgcacttgcaaaaagagtgcctacttttttctgtaaacgagtactacgatcaaacctgcatacatgccatattgactacacgatactatttcttgcgcttattctcgtgattctcctgtggccatctccagttatgtatcaataagacagtcttttcccctaaacaaaaggacaaaccatgttcatctatgaggagattgatcattctcttgattggtgaacaacggacaatattattatcatttctttagtattacaggcttgataagccgatcaagcaattggtttgcaatttgcctcacaggcttgcaagctagggtagcatacatttctacagcagaccttcgatggggagaaaatgttgcctggtacgggtaccaaaccatttatattgacattgttgcgtccttcattcatggatgcactcctggtgtaatccagatttttacctgaaaaataaaaaatattttactaggaaagcatgaaagatacagaaaaaccatatgcaatacatggatatgtgaagatggatgtccagaagaaaattggaatcacaaattttactctgaaagatatgtttctttaatacatcgtgattaccacagaagaattgaataattgtgaaatcaaaataaaccttggattcaccattgagattcaatattagatagtagattaccatacacgtggccaggaatgctaaaacagcctagaagggccaacaacagaagcagaagtccacggctacagttcggcatctgcttgcccatttgtgtgattgctttgtatgaagctgtggcttgtgcttcttctttgttttacgatggttatatagacagcacaactgaaataaataggcaaaagtaatccaatgattaatagtatccaaatataaggcttatcctaaacatatgtacagttttgttatatattattgaaatgaagtatggtggatagtcttatctaatcttaccatttgcagtttactcatattgctaaacatggacggtggcctatgtaacgtctactagacactcattgtgatagctaaatatttattaatgtgtttattctgcacaatctatgcgaagttattccctcgtgtaagaaatataagatcttttgcacgatgatacggtctgacatattaaattttaccactaatattctttccagtatactcggtgaaaagtcactagaattacaacactataaaaagatgattgtaaaagtagttaaacatattttaccgttcctataatctctacctcccaatgaaaattttaaaaacatttacgtgttgtttggtgataaatctgttttatgatcaaagcaaatttctttgtattatataatcccttattttccatatgttacctgttaatcagtggcgggcccagctttttaaacttgggtattcgaaatgggaaggggtaaaaaaatatccatacaccaaaaagccaaaaaatgggcttgtatattatgatacactaataattataatttagagcgtatagaacataaaattgatcattagttcacacagtgatagaattgatcatcactagaaattgtttaacttatagaaatactaataccaaacatatcaaagtgtcaaaatatggaatacaaaaatgatagaaaataataagttaggaagaaaacttacaatttagatattaacttttcgacgcttgatattttggaaataattgatgatgtccttgtccttagcttgcaaaaagaattctctttcaatgaatgtaaccaaacaatcattcaaatactacaaatttgctaatatggtatgaactatgaactactgcccagtgtccaatatactcaattactcaaatactcaaataggcaactagtcaactacaatcctacaaactaaatgtctaaatcaagcaagcaagcaagcaagcaactacactaaaatactaaatgtctaaatcaatgaatttttgtgcttgtcccgttgtccggagtt

SEQ ID NO: 82101 - DNA, 4040 bp, Oryza sativa
agatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgtcgaagctccagaagactgttggatccgtcagcgcagcaaaggaagcagtgaagccagatgtgtagcaagagtgaagatcttggagaacccgtcgcagaacctaagccaccctctaaggtagagtcgttagttgtgtgtttccttgcttgtgtgtgtagcgcgtggtttgcatcggtggggtgtgatgtaaccatgctaggttgtttgcttaatcaacttgcagaataagtgaaacaaacagcacatcaacaaaaagagttagttcctttaaggtcctgtccctagttctggtctattctttcctggcttgtttcctctctcacctcaatccctgtaacagatgtttaacagagaaaaaggaaagaatgtcagcgggtatgcctccagtaactcaagttttcaattcaatccaccactggcctcaagagagttaaccagggcacacccttggtccattccaagcatgctgcttagttcacagctaccattagttggaagtcaagaccaaaatcagtatgtgtttgatcgagcgtttgccacccaggtcaatgagcttccaatgccagaagaggatgtccccttttgtcacgattgtagagagcaaggacactatgccctgaattgtccatgggtatatgtcaaagaagccccttcctttggtttagcagggcagacatcgctaaaccagcctcctcgcaccaagtcaagtttgcagcctagtgtgcaaagtgaagagcccaatggagacaatccattgaatcctagaaaatgctttcctcctagcctttcgcaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggattatgaagatgagtccccccgacatctcggcgaggaagagatggaatcaaaagcatgcccccgttgtggagaaattggacacgttgctagcatgtgtttcacactttgccctcattgtgaggaagaccatccaccaggtgaatgtcccacccgcaaggtacatgttttctctgcgcaggtacaaaccatgtgcccaaggattgccaactcagtgtgttgttgaccaagaccgcagatatccaacgaacaaccctacgattgtctcgtcagttagtcagctccaacagcaacatcgacgatataatccacagcaccaatgctcctcttggtgcacctgattctgcagtgaatcatagcgataataccttcagcaccaaccattctttgcaccgacagcctcagcaaagaattgttatcgatgaaagcagttgtgtctctccccgacatactccaggccgagcaaagggcaatcaatctcagagggcgataccaagcagaagaccatcatccgcttcaaacagcaatcagaaggaagcttctcctgtgaatgatagcaatatgcagtcctatcacatatcacagaccaatcaaggatgatgcagtcactagaacaatgccagctatatctctccagaatcaaaatgagcagccatgtttgtggttttcagttcgctacttatcatggtgtaatcgaaagtttgcagcaatcatgtaatacataaatatattcatgtctataaacagtgggtttgctatgcttatggatgattcatgttgaggatacaatgtaccgatgttaagcaccgtcccttttttgtttaaggcagtgcctcgtattcatgtaatgagggagaaatgtgtaatacagacaagttccatgaggattcttttggaagatgcgggtatgtgattatgtgtataattgcttactgataaaggagacctagggtctcatttcagaggaactatgttctaaccttgagttaataaccaacctgttgatggaaaagaaaaccaattaaactgtgttgggttaaaaggccaatgagacagtagttggggataggagtttggatacgccttttacagatcaagataaggattgttggatgaaacccataagggtacccgccatgcctctacattgataagttcggatatacctgcaaacagtaagaagatccaggagacatcaatatttgagaacataatagtcgatggttggtaattagtctatcaggtatcagaaaaaggtcaaaggtgatatggcagaagaacaatatggatgctccccatctcgaggaagcactcaagatgaccatcggcaattaaaccctagtggtatagatacagatagcaggcaatgtatttccctgaaggtagtcagtgtagctttttgacgcaccacatcaaggtttcactgaaaggcagcaagccaaaggacctcatcgtccccagaagcgtccgcaatccacattaaagaataccacctgttagagataagccgaaagatgatttataaaagagattggcaaagatgttctctagcatgaaagaagtaggccgaaaggtgattgataaacagaaacatgctctgcatcgctcaaggacgacccctgatagtaattgccccgcaacagtcaccttgtcattaagtaagcgagatgacctaggtaaaaatgtttctatgaaggcaaggagtgaaatcttcaactcggtatcagatgctacacggagtgaaaagtgcaagcaccggttaccaggtaatgccatgtcttgggagatgatccaatgggaaagaacacatcaaggttaaaggtgtaaaggaatacgttgaatgctaactgaggacaacctgaagataataatgggaagtaaactgaacataaagaaagtgaatctgcgttgcttgttcgtgggagctattcccagttatgaaccaagtgatatgatcgaagatagtctacagaggtcagattaaaatcacctccaacaacgaagcttcaggtctggcaggaccacgatcagacaataacaagtccagcagcaaagtcattcgggaagacgtcaaagtatgtcaagtgggataaattggttctcttgggaagcataacttatagttagagtggttgacccttgcatcaaatagcagaagtagctatcacccggagaccagggaagctaatatgaggcagttggtggcgagttagaagcaaataacaagcatggtatcctagtaatgataagcaggttacgacgcatgacacgaagttgataacttgtccgaggttgactccgaagatatgaatcatgagaagttctggaacggaagcatcactgcactaccgcaacctagtctgagtcagccaaaaggtgcaccctggtccaagtcaggtgaagggaagattccatccgcaacaggaggtcaagccaagcagttccgagtggtgaagttttgctggaagtttgtcaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattctctaaaaggaataatagaattaattaaaattccaaaagaaattggcaaaccttaaaatacgt

SEQ ID NO: 82102 - DNA, 8507 bp, Oryza sativa
cataagttatcccaaaagtgagctaatgtttctaagcagggctaagcaattaaatctaatatctagttgaaccaacatatagagctcaactagtcaagttataataacccaaggtatcaaggaataaggtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgccttgctggccttggaactcttcaaactcttctccggcgaaaatggactctccggaaacgacggaatctaagcagaaagaagcaaaatcaccaaaacagcacataaacaagcttgaacagtacatgtggatatttttaacatgtacatctcaattttagaaaaatttagagacttgaaccaagtaaatcggagctaagataaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggctcacgcgaacggacggccgagatcgacttgatccaaaacggacggccgagatcgaacggtccacgaccggctcacagcaaacggccccgatgacgtcggcgatgacgtcaccaccggcggcggcggctcgggcttgcatgctcgccggcgaatgacggcacggcggcgcgaacggaaggcaccaacgggtagagcgcgacgcggtgaactcaccggtgaccaaaagagcggcggaagatcaacggacagcgacggcgacgaggaggaagcggcggcaaacttcgggtcgtcggcggcgacggtgctccggcggtcttcggcggcggcgaaggagcggacgaggacggcgacgtgacggcgaccacgacggcggtctacccgagcgacagcgacgtctggaacggcggcggcgcacggctggagcgacggctacgacggcggcgctaggttgcacggcgctagagctcttccggcgacgagaggcgaaggcgaaggtggcgacgggtagaggagacaccggggaaccttttaaaggggctcggaggcgacggcgaaggcccacggcggctggcgatgagaaggaaggtttagggttcggaggagagagacgaatccgattcgacctcgaatcaaacactttccaagccgttttagccgatgtttccaaaagggaaaaggtagaggagatcccgaggatcatttcccctctatcaattcggccggagaaggaaaggagcggccggatttggaagggaacggcggcagcgcggcgctagggttttgggaggcggccgacgcgaggaagacgacgacttgacaggcgggccccacctgtcagcgagcgagggcgcgcgcgcgcgggcggctgcggactgggccggctgggccttgagagagagaacggttttgtgccgactttcggcccaaagccaaaagagactttttcaaacctttttcaatttaaattattcatgaaatgcaattccatttattaaaaatagttccttagctcaaataaatctcagaaaaatctaggaattatagaattaagcaaagtatttaatgaaattttatctggccccattttatgttggaatttattaattaaaattagatcttctcttcaagacttttaaaattatttctaaaaattccaattaaacaacaatttatatattttgaattttcagggtgtgacaaaattgtttacgttctcccttcatgagagagtgaagcaatggtacacatctaccgttggatgtgtaaacggtagttgggaaaagttgcgagacagattttgtcttgctttcttcccagttactcgtattacaaccctttgagtagaaattctcaatttccggcagattgaaaacgaatccatcggtgtagcctggtccagattcactaatttagtgtagtctggaccaaccttatccttacccgactatgtgcttttgcaacattttcatacgggtctaaataaggaatctgcattctatctagacataaccgtcggaggatcattcatgcacaagatgccatcagaaggaaaagtaattctagacagcattctagaaaatacttccttcatgacgcaatgcgatgaaccccagctagaggcatccgtgtccaagatagaggaaccttcaacaatcgagtcacaacctgaaccttccacctctaccgactcgattgatgaaaaagttcccgagccatccgttgagactgaagaaattcagactccggatcgtgccgcaatcatgttcagggatggttttgatgaagactatggtaacaccctgaactacttcggtaaaaagaaaccactcgtccccttgccacctcccgatcctatggaacttgggttcctaagagaaactgtccgggagttgaaatctataatgagtgacgaatggctaagggagacagagctttcatctgaagtaattcaggggcataagccaaacgacttctccttctggaccctttttcttcaactgaggtttgattgaattaaatcctgtaaaattcataactaattcaaatgaagtcggaatgaggccgttcaagtctctaaattcatctaaaatcatgatctacatgtttgtttactttttatgtactatttatttggtttttcttagactttttcctcgttttgcgtgatatcttgtcttttccgtcgttacaatggtttgtgagtgcgtcggaagtattcaagaagattaatggaagacctattgttgcaaggcaagtcacacagatcctaaacacaattcctttgagcatgttgatcctatatttaaattatctatttatttcaactgtgcatttattttagaatgtcacaaggtggtgtgaaactattccttcgttatggccaattcgcattgattaccctattccttgataccttgggttataatttgactagttgaactttacatattggttcaactagatattggtataattgcttagccatgcttagaaacactagcacactattgggatgattaatgtttcactattatttatggttatattgaatgatagctcacgattgtcaatcgtgattggttaattaattatttgccaacttaaacttgacaatggtgggttgtgagcatatagttttgaagatcgtgctcatgacaactaaggaccggttcgtgagctattgttgtgagacattaaccgtgccaaccacaagccagcatgggcaatggctttatttttttgtataccatggttcattgttgtgagacattagacgtggtgtttaggtaattgttatccagtaattgctgcatatcccacaatatgttttaggtaggtgtagaggtggtgacagcccttgagattacttaagtcctccctatccgcgtatgtagtagagcgatatatgggaacagcgagttgctagtacctggagtattgtgttaggatgaaacttaagcttaccctagacactgtttctcactagtaaatcttctctatcctatatatatatatatatatatatatatatatatatatatgcttataccaaaggaagaagtgccagtggtacgagagtatctggatgtatttcctgaagaactaagtgaattacccccagatcaggaaatagaattcatcatggagttacttcctggaacgacacctatatcaaaaagaccttataggatgccaattaatgaattagaagaattaaagaaacaaatagccaagttagaaagaaaaggttttattcgaccaagttcttcaccttggggagctcctgtgctatttgtcaaaaagaaagatgcaagcttaagaatgtgtgttgactaccgagctttaaatgaagtaactattaagaacaaatatcacttgccaaggatcaacgatctatttgatcaattaaaaggagctagtgtattctctaaaatagatcttcgatcggggtatcatcaattgaaaatcagacaagaagatatatcaaagactgcctttgtgacaaggtatggattatatgagtttacaattatagcatttggactaacaaatgctccggcttattttatgaatctattgacagaaaactaatcttctctccaacgctgatgttaccaaatttgattgttaacagaatctcatgaacaatatatttatggagtatttggaccagtttgttgtcgtgtttattgacgacattcttatatacaccaaaaatgaagaagaacataaataatatctccgattggtactggagaagttaaagcaacgccaactttatgccaaattctgtaagtatgaattttggctagatcaagttgcattcttgggacataattaccaagaatggagttgtcgtagatccagagaagattaaagctgtgatggagtggaaggtatcaacatcggtacctgaaataagaagttttctaggacttgctggatattatcggagatttattaaggacttctccactattgcaaaacctattaccaaattacttaggaaggacaagaagtttgaatgtacactagaatgtcagagtagttttcaaagattaaaacataagcttactactacaccagtattactcttgctagacatccaaaaagattttgagatctattgtgatgcttctcgacaaggattaggatgtgtccttatgcaagaaagtaaaatagtggcttatgcatcaagacaattaagacttcttgaagaaaattatccaactcatgacctagagttagctgcagtagtacatgcggttaagatctggtgacaccacttgattggaaatcattgtaagatctacactgatcacaagagtttgaaatatatttttacccagacagatcttaatcttcggcaaagaagatggttagaattaattaaagactataatttggaaattctataccatccaagaaaggccaatgtgatggctgatgccttaagctaaaaagcttattgcaatttacgacaggaaatactgtcaaaacaattacaagcagagttgcttaagttaaatcttgacgctattaattatggagaattaaatactgtcgaaacatgatttcggcaataataaaacggggtagcgcacgagacctagaagtggatgtatgtggagacaaaggatttagacaggttcaggccctctcaatgagaggtaataccctactcctgtttggggattagaatccgccgggtgtgtattgatctgacgatcaggttgtctcatgccccctagagggcctcctgcccaccttatatagggtgggagcaggattacaagatagaaaccttaaccaataaggtaccgatttcctaaatctactttacaatcttatcaaaccaggattttaggtcgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatgttctctcgaactagattactctaaagccgagtgcttcaatcatcttcgccatggtctctcgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgataccaatatatagcatatgcggtgtgaatccctgaataatatgatccaagtgatataccgactgcttggcaaaatatgatgcgtacaacctaaagttgacaacatctttgaaagttcacatagcaaaacaactataaagaagcttgaatgctgtgaataaagaaatttcgaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcaacctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgtagacatattaggcctaggccaaaaaatatgccttcgacaccctttaaaggatgacgcatgtaacatactcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctatcaatgaagatgaaagcacccagcgataaagttggtagccatggcagcgaaataattgacgtgatgaagatgacgatgtcggcgatccagttaatagcagtgtcacaactaatgataatgacgaagacgctcatcagcatttgcatagtaggtcaaccgtgaaggtgaaattataagtcggtgaagacataatcatccattagcaacagcggagatgtcagggccgatgaagcagaggtgctgttgatgatgtcagtgataataattcatcaaattaatgttatagctgttgtagatgcttcacttggaggagagttgatgctgtagtccaactcgtctaaaccgaaatatttgatgttgttgaagtagaatgtctgctccgaagcaaagatgaagataatgactcctggagttgacttgttggttgatgaattgatttcttcagcttgacataaaatttgtcaaattttgagccttgtatttgtgtagcccccgactctttgattagttgggaaacaactgaatatagagtcgagaactgtagcttcttgtcgtcgaatagtcattgcttgattgaagatatgtgttgaagatgtccaagtagaaatccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagcaatgaagatggtaaggccaatcaacactggcagaatcatgcagccatggaagtgcagaaaccagtcggcagccatggcaaacgtaggcagcttgtgttgaagatactgatgcctattagtagtgactgcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggtggcggcgaaggcaagccggtcggtgaagacgtagacgcccaacaacggcggcataataagccagccgtgcaggcggagacaccagtcggcggcggcgaaagcaagccggtcggtgaagacgtagacgcccaacaa

SEQ ID NO: 82103 - DNA, 1829 bp, Oryza sativa
gagaatctaaacccttttttaacgctgtctgtctccccttttatttggatccagtgaatgtgtgtgtttacctcacgatggatgtaccctgactgcgacacacatttggtcattttgggggaaacttgggagtactctgttgctggacacatgttattgctactcttcataactgtactgggtagcttaatgtcagaataacactaccttcttcttctgctgctgctcctgtaatgagcttccagcttgccagcagcttcagcagagcctgatcgaaatgccttgcagtgccaaaacgttatttacctgcagaaacaggaagtgatatcgacacatgaattcggttgggcctcgtcttcggccaacctggctagaaatttcatcagttcatagaagcaacgttcagttggcctttggaatcgaccatacttatcaccaacaataataataaataataaagtagataaaactcagctaacacgaaaagcatagtgcctacacttcacttctgaaaattcaggaactactcttcttatgaactatgaaggaaagaaaggagaaataaatatatggatgcaatatatggccagcatcgagcaccccaggccagcatttcgggatttggataaaacagttctcttcaatatgccaggctttcaaatgtcaagctgttataggatgtaaaaactgctcaaggcacgcacacataaaaatagcaattagctattgcagaaaccaccaatacttacgagaactcttggtcatagcctcataggtcacttggaacaatacagactatcagagtcgatgggatctgggaacagatggtaggataacagatagcaccctggaaggctggaacaatatcatggcacctttcatgtaaggaaatgcacagaaagagcgctataaaagtaagaggagcaagaatgccatggtattactattgtttcaaagtggaaaagtagtagtataattcttgtttcgaaacataattattcacaaaagcttggtacattctaattatgaccagcaataaggagcgactcccatgtcccaagcggtcttactgcatagatcattataatttcaaatgacaaacctagagcgccgataattcagttaacaaattgtctcatgaaaccttttggcattatcaaaaccatgaatagatttgacatcatccaagaaaagtgatcatggttttcaagtagtcacctaataccaaacccttccttcaaaacaggtttgtgctagggataacgaagtaacggacatggagcaaaagaagtctaatcacaaaagaagcctgtgataacgacaacagactggctccggaacaggttttaatcacaagcactacacctcatcagtgaaatgggcggggatagggacggcttttccaccaacttgtctcacatcttgctgatatgtccttgctgtcttcagcttggtctgcaggttctcccaggacttcgttagcttttttttgccagctccagcctcaataagatgatatctctgatagcggttttgcgcaatctcttcataaaacttgacaagttttgtgttcctctcagttaccagcgggtcattgctgatgcagtccttgggtatttcaaagacgacttgttcattaaactgttttagagagaaacaaaagcacgttaaagcaaataattaccagcaggaaaacataagaacaaaatacggttccagtaaatcttgattgacaacagtagatcagtcttagttacaaatatcaggtgataccgctagcattcttcctagttagcacacaaacacaagaccaattagaacatgtccca

SEQ ID NO: 82104 - DNA, 8001 bp, Oryza sativa
  unsure (1)..(8001): unsure at all n locations
ttccccccccccccccgctcccggcctcacattggccaccgggtgaataacctgagccacccccgatcctgtagaggacccgacagttgagtgggccccgcagctccgatgaggggaagggacgaagggtggttgcggcgtcacgctttgataggcagggcaagccgacgactcgaaggagaaggagagacggagggtggttgcagcatcacgcgctaatagcccagggccccgctgggttacccgagggtgaatataacctcccccaccgccgctcacccatgggtgtgaaacctgacttggcctctgcccccattagggtggggtcctagccccagcagggaaattggcaccctatgggcaattagttaatttttcttatcttttgaattagtttgtggaatgctttcaattatcacacaatgttctaaaatcaccattttatgttaaatggaattataggaaattttcaaccaataatatacttactctgaatttaactaataaaatttatgctcaagtcatgtttatagtcatgtctgtgtgcgcggatgcacgctgcgtcccttctagttacggtaagatcagatcagtcttcgatacaatatatagacaagtaagcacagggttccgaactataattattagctattggactagtctcaaatagagtaaacaatacagtaatgggttgggggagaatggaagcaaagtacggtcacatggcgctaaccatgtgacacatgggaatgggagacccgtacttttagttcgggtaaacttttacttgtcatttctgttatgaaaaaagatgtacaatggagacacgaatttttacgtgaaaaacccttgcgggaaaaaatcacgggcgccgaccggcaatgatcactatagaggagttgattacaaacgtaggatagacatggagtcctactagaaaattaatctgaatatattatgggtccaaaatttggatcacatatttaacaatttctttatctttttatggcttgcagcttgttgtttggtcgatagactttactctccgtcccaaaatatagtaaccttgtactgtatgtaacacatcctaatataacgaatctagacaggatcttcagaaccaaacccggtactaacaatgtttccccactagttcaaaaatgattttcctaggcaagcaatctaataggttgcagatgggccataagtgtccgcgtatgcaaaaatcggccctcattttcgaatacgactccataatagacccgcacgaaaaaaatcaatgtttccaaatggcccacttaaaacatccgcatgcaaaaataagggtattttcgcaagtgggtctcttaactcacccacacgcgaaaatattcgtccaccccattttttattctaccctctccctatctctgtctctcccacctcacacttcatctcctggcttcactcctctcctctctctcccggccacattcctctcctcttctcccacttggcggcgacaacggcggcggcggttggcgtaggcagcggtgacggaaggggtgggcgacgcctagcgccggcctactgcatgctctcccgtgcatggcgagcccctccagcggtggaggcgcgggatccggcgggcggcggccgtcgccgcacggatccggcggccggctgcttccccccacggcctcaccctcgacggtagtgtgcgtggccactcccctccctctccatctatctcccctcccctccccttccttccctccctgcgtggtcggagggggagcgccggcagagcgcggatgaggcggcacgacctctcccctccctttcctcttgcttccctcctagatccgatggaggggatgggcatcgacagtggtgtggccagaggggaggctggcgtcggcggcgatggggaggcatgggggcggtgggtccggcgacgccctccgcgcgtgcctccgccgacgccctctacccgcgccgcccgtcgacaccctccgccggaaggaaggaaggaaggaagcggaggggagggagccagagggaaacacgagagacagagttgagggaatgagtggtggggagaggataagatggaagaggagaagataagataggaattagttttttttatgtaggcatgattttttgtatgcggaccacataaggttccgcctgcaaaaatcatattttttttaggcggaccacttaagagatccgcctgngaaatannnnnnnnnnnnnnnnnnnnnnnnnnnnnnnnnnnnnnnttcntaagtggtccgcctagaaaaattgattttcgtaggaggatgatgaaaatccaccttggtttacattttcataagcggatattgttagatttaattgggtaattgatccatttaaatcaattaaatcaaataaattccaaggctcattaagctaggaatttatatgtattcattctcttatgggatatcaatgggatgaagagttttgaaaattaatccatttaatcagtgaattggtaacttatatcaatcactcctaattgatgaatggttgatggttgtgtggtgaaggatggttcatggctagttgctagttgatgacaattagctgctctattcctcttcctattccgttggtaacctacatcaattactcataattgatggttggttgatgattgtgtagtggaggatggttgatgggtaattgatgagaattagttactctattcctcttcctattccataactcttactcttcatcttccattcctcctataaaatgagaacggatttgatctctctaaggagaagtgagacacactttcatccatttccaaggctattgctgctacggtaatcccatcccgacgagtgtgtgcacatgctttgggagaataggccttcgaaaccatgcactgctacgacgtttgcatggacgggtgggcgattaggttttcggggagcacaaggcgcaactactcactgttcgtcaacgtctacttcgtcttcaccaacatgtcgaacactggagacaacggcaacactagagacaaggagaaggaggcttctgtcaacaccaacggtgacaatactatctcaaactccagcggagaaccattcttggggtataaccttcttacattatttcaattagaagttttacggttaatattcatcgcaatgtaaacattgcgttattatgtgattgttgatgcttattctacattaagcatgctcatgttgattacatgctactatcactggatcaaatcccattgtaaataacatgtttattatcttgttattttggagtaaaatatgccgaattatgatcaaatttccaacagatatttggctccaagggtcatacccgcctgcggaaaaagagacccaacgtcggcaaaaatgcctttttaagtagtgcttgcttcgtaatttctataaaaatcctgcaaaatagtgtctatgttttaaaaggagtaaattgcacccacggttcaacaacttggcaggtgggtgcaatttgatataataacttgaaaaatgaggattctagtgcaacaacttagtaagaaggtgtaatttagtataggaatttataagtgatcgtataaatacaacaacttgcaaggtaggtacgattttgatacaataaaataaattaagaagtgtgacaacttaattatttggagtattttttatataaattcaaatttttaagtacttattttgacaatatactagcgtggatttgtataagcatatttatatttttatcctaataactaataactctaataactaataactaaaagtcaattaaattggatgtagaaattattatatttcggttgatatttgagaaggtaaagaaacaaaaaattcttaaaggtaactgaatgtaaattgtatgtgcaatataattcttaaagattaaattcaatattataaggtaacatccgtaggattactatgtattggcatattgacatcgtgaaaaacctcacctagcatatgtttagccaaattgattcaccaaaatactaaattgtcaagtacttgtactagaacgcacccacttgtcaagttgttgcagtcagacgtttaattctcaagttctttcactatatcgcacccacataccgagttgttgtaccgtgggtgcaatttatagattctctaaccacaatccctccgatctaataattcatccactatttagagagtcatcattctcttcggattcacccgtattgaaaaagaacatcaggccggttaggtgcatgatgcagcgcattatcttcttaatacgacgatatacatattcattgacgggagtaataaggacgttactttacaggtcaagtcaagtaaagcatgaacgttatcgaatcctgatttgcttctgactcatgtgttgtcaccgagccgacgtcagcaaaccgcgtattcagatggaatgcacgcgtcttccagaatctgttcttcaggaatctccgtatttaagttcagaacacatggcgatgttgtgcttgaagcagaactagctagctcgatcttgcacttgtctccgacttccttctcgtttttgtttcattccatagctgaagcaaaatggtatgtgttgttcttgaatatttgttgctgcactcggttgtctttctggttcaaatcaacattttttttggtgatgtatatatacttggtagggtgacaagaaacaagtgaagctaaaggttcggggtgcaagcgagactgaggtcaagaatgtacttcgtcaagaattcaaaggtttaattaccatcttgtattttctgttgtcgaaaaggaacgagcaaaactcagaggtgtagagaggatcagctaaaatttcagtgacatacaaggaatttcctttactaatacctgtgttgttcatccttctttctatgttttttagaatctatcgagtatagaaactacagcaaaaatccagagagcagcagtttgaaggtggaggtgcgagggactgtggatgtggggaagctgtacgaacgcctcaagaagatggcatccagtgtcaagattgaatcggttattccggtatgcatgtactatttgcatcttaattgatcttgtgcaagattgacgggtacatcaattcgttaatatatcttttgggttattgtttgaatctttcatgcatccaggatgatgtaaaggaagaaatagagagatacaagaaagaccttgaaagaatgaagagacagaaggaagatctagacataaaactaagggaaaaaagggaagaaaaaaaggttctccaggccgacaaaacagctgccgaggaagagcagaaaagattgaagagagacaaagaaaatctcaatttaaaggtagacacaaagaggaaagagaacaggcgtctcgaggaggagaacaagaaattgcagcgaaaaattaaggatctcgagcaaaagcacaaggtattaagctaaatccatgctatgatgctatactgcagggtacagaaatttcggaatatccccccatctccccccgggcaagcaaatgtctcatccgaaattttcatttaatttctttcaaaagcaatcaaaatttggtaaaattccaaataatttattgcagaaaaacaacgaagttcctggaattttggtttttacgaaattgcaaaccctcatgctacagacagatgttgtacattttgcctcagtccatccaagcctgcattcgtgctgctgattttcctcttcttttttggtctgcagggagggacatcaattgagtatcacggcgtggaggtgcatcagaagatgaatcatatgcatcaggaggtacacatgcatgaagtcgttcgcaagcttaagatatcggacaacgatcatggaaacgctaatgggagggggcatggacaactcctgcagcagcttggccacggaagaaattgatccgcttataaatattaccaaagctagatatatgtgtgtgctttgtgggtgccaacctattttggtgtatggtttatttgcttgtgtttctcggttgtgagttttttctcttccataacatgtctaataataaaacaataacaagaaagctgcattattaggaaccgttttgttctactgaatgtctgagctgagcctgaaattgtaatgatgtgaaaagggcaatgtaatgtaatggattgatacgtcaaacgttttctcatgttcggctctctcgggtaggattattagacggcatccttaaggtagtgtttggttctgagactaggtgggatgggatgaaaccatccatgattttgaggttgggatgattccacttgcgtgtttggtttatagaataggacgatcccagttttttgtttggttgaagggacgagggagggatgggatggacgccgtttgccaccactgacgacgccgtttgcaacaaccatggccgccgctgcctctgccctcacctctatctccgccaccgagctgcggtcgcgaagggacgcgatgcggcgggtgatggcgtcgaccttcgcgcggagcagccatggctcggcgacgatgatggcggcgaggtccgcacgggagagggagagggacaggctagcgacggacgacgacgacgacgacgccgagagcttcggggacgacgacggacggccgggccgccgccggatccgtcggcgcagccctccccatcgtcggatccgccgccgccgccttccccgccacaggatccagtgccgccgagcccctcgacgccgccacttccgagcttgtcgccaccgtcgcccgagccgtcttccgtcagcgcagccctccccatcgtcggatccgccgccctggagccttccaccgtcgctcgagccatcttccgccacccgagccctccccattgtcagatccggcgccgccgccttccccaccacaagatccggcgccgccgagcccccggacgccgccgctgccgagcctgtcgcctaccgccgccgtggagtctgccgttgtcgcccgagcctgtcgccaccgccgctgccgagcctgtcgccgccgccgtcgatgagctcgccgccgtctcctgagggcgagcagggtgagcgcgcgagcagcgtcatcacgccgttcgctcgtcccaggtgggacgagtttgtccgccagttttggccggatgagttggtcccggatctgagaggaatattcctttctagggaccaacccatgccactcacccctaaaccaaacacccctgaaagtgggttcatcccatcccatcccacctcatcccaccaaccaaacactacctaagagtctccaagacaagtcaaactagcttcaattatcaacccaaccttgcatttctgggccaagcagatctatttggcctttattttatcagaaagtgtcttaattaattacatcatccttacaaatatgatggtattctcattgctggcagcccgttggagccattggaatactggatgttccatctctcgctctaactacactattcagcacgtggactgaacgaaccaagcatgtgacgctactcaaaagaaagcatttttgcatacaactaaaacctattttttcatgcggtaagactgtccgtctgcccgaagatgtttgtaaaaatcaatacttttcctacggttggtgcacccgcacgcaaaaattaatttcacaaaaaagtgaaaatccaaaaaatcacatccgccgtctccattgccgaagctgagcacagctcatcatcgttgtcgtcaaagcccgacagctcctcattgtcatctgtgtttctgagtccccttcccggggaactccccgccgccgaatccacctctgtcgcacctcccaaccgccaccgccctccccattaccagatcagctgccactgaggtccccaccgccgacgtccctcccaattgccgccgccctccccgttgacagatctactgcctctgtgctccctaccgccatatccaccgctgccgagctacttgcggctccta

SEQ ID NO: 82105 - DNA, 1672 bp, Oryza sativa
aaacataagatgtaaacatccaaaatttgatcaaaaacttgaaatatgatatttcatattttttatccaaattttgaaaccttttctcctaggggtattttggtcatttcgacaaatttgtacagtactaacggagactaaccggacggcgatggtaaattgtagaagttaagcaaaagtcaatggcatattatagaacatgataaagtcagtggcaaatcgtagacgtgtgacaaagtcagtggtatataatggattctctctaaaattttcctatgaagatctttaaaacaaaggattgaatcatattctaatctccgaaaatcttatagagattttggagaaaatttagtaagagtttcaatatcttaaaaactttcctttgagtctatctctcatccaactcccatgtttttctgaggtctaatcaaacggtattcctatatttgtcctatattttgcaatccactgttttggactcgtatttttattagaattctatggttttcctatttctatgttttttcattcctacgattcaaatgggcatagaagtttaagattcggttctttaatatatatatatatatatatatatatatatatatatatatatatatatatatatatatatatatatatatatatatatatatgtgctcccttttatgaaaaaaaaagaagacttatgtgagtgttcaaatacatagctaagattcgtttttttaagatggagggagctcttttttgtaaaaaaaaaaagagacaaacttattttgaagctttcaaagtcaataagggatagtaacatttagagagtttaacattgatgtcttcataaatcttctacgcaagaaaaattacacaagtacaataatattacagaatccttcttttaacaaacatgtctacatcaccttcatacaaaacataatctaagtaaacaatcaagcggttaaaataaatactactactaacaaagacgaccgagaatccgagatagttgatggtcatttcttttagggcttgttcactttactaccattttcaaccttaccttttttttataccaaagttattaaaaaatagctatatttagtttgttgccaaatttttataagtacatatgaaatcttactaaaatttaataatgccaaaacttagtaaagttcaaaatgttatcaaagtgaacaagccctcagataatgacagttgatggcgatatcaattcatccattcaaaatttatgaaaaaatttaaaagcaggtggttaatagtaaacgttagtggcattatcatgtcattgtcattaccaccagataatcccccacaaatctgaaatctatatatgctttcgtgttggaataattcacccgttcgatcccggaatatgctccgattcatcccttcttcttcttcctcttcttcttcctccatccaccatctaacattctaaccccgcattaattccttcctccccacctcctcctcccccaaaatcccactcctcactccccctcccgcttcgagatctccccctccgatccgcctccgcctcgaattggggctcgattcgaggtatcacatcccccaatcatctcggaagaatctcgatcggtgtgtgtggggattgagtttggagttggatttgattttgttgcggattcggtcg

SEQ ID NO: 82106 - DNA, 25804 bp, Oryza sativa
  unsure (1)..(25804): unsure at all n locations
ccaaacaggagtagggtattacctctcattgagagggcctgaacctgtctaaatcctttgtctccacatccatccacttttaggtctcgtgcgctaccccgttttattattgccgaaatcatgtttcgacatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaatttccaaacaattacaagcagagttgcttaagttaaatcttgacgctattaattatggagaattaaatactttggagttgaaacctacacatatggatcagataagagagcatcaaaaagatgacccagaaatacagatttttaaggaacggaaggtgcgaggaaaggctgcagatattaccgaagacctagaaggaatattatggtacggaaatagaattgtcgtaccacaatcaggaaatctaagagaggtaatactaaaagaagcacatgactcagcctactctttacacccaagcaatacaaagatgtatcatgatttaaaagatctatactggtggccaaacatgaaacaacatattgcagaatatgttgcattatgccatgtctgccaacaagttaaagcagaataccaaaagcctacaggattattacagcctttacaaatacctgaatggaaatgggatgaaacagaaatggattttatcactggactacccaaaacttcttctcgatatgactctatatgggtaatcattgatagacttacaaagactgcatgattcattcctgtgaaaacaacttacactggagcacaacttgcagaactttatatgacaaggatagtatgtttacatggagtaccaaaaagaattatccccgatcgtggtacccaatttacttcacacttttggtagaaattgcattatgaattgggaagttatttggattttagtacagcatttcatccacaaaccagaggacaaacggaaagactaaaccagacattagaagatatgttaagagcctgtgctctagattttgctgctagttgggacaaatgtttaccttacgcagaattctcatataacaatagttatcaagccagtttaatgtcaccacatgaagccttatatggaagaaaatgtcgaataccattgatatggacagaaaccggagaaagaagtatattcggaacggaccttttaaaagaagctgaagaaaaagttcgacttattaaagacagacttaaagtagctcaatctcgacaaaagagttatgcagactctagacagagagagttaacttttgacattggagattatgtatacccaaaggtttcatctttactagggataaagagatttaaggtaaaaagataaactagcccctcgatatattgaaccctatcaaataattgctaaacatggagaagtagcctatcaattggctttatctggctacttatcagacgtataccctacatttcatgtctcgcaatcaaagaaatgttgacgcattccagaagaagaaatatcagtaagtactgttgaactgaataaagatttaacttatccagaatatcctatcaactgaataaagatttaacttatccagaatatcctatcagaattttagatgaagtacatagaacaactcgtactaaggcaataagaatgtttaaagttcaatggaatcatcatacagaggatgaagcaacttgggaacgggaatattatttacaattggaattcccgtatctattcgaagactcctaagcaaatctcgggacgagatttctttaaggagggtaggtttgtaacatccttaaattttaaactaatatttgactgcatcatgctggttttaatcttagactagcaaaatcaaaattttctttaaaagttctctttttattcttgattttggttcaagtattacccctagaattcccttaacctagtttaccaataaaccataaattgttgccctatcttaaaccttagtgaatttagcaaatttccttcaaattccaaaacttagaaactttctctagattacccttctattagtgagacattgttatagtgcataatatttgcaaaactcttccaaagatctctagataaattcaaaatattcaaaattcctaaatagttcttttgggccgaaatccttttctctcccttccagcccttctctctgtcttggcccaaatcagcccacagtcaaaccgcgtcgtcttcctcctcctctcctgggcgccgctggattgagcgccaacgcccacagccaacgccgtgccgtgtccatctaccgccgcccacaactctctgccgccgccgtcgtcttgccttagacgctaagaaatcgccgcccaacgtcagcgccacctcatgccactgacgtcagccgccgaaccgaaccgacatgcccagccaatcaccgaacgaagccggcgccgctttcttccgctccactccaccggcgccgtgtttcccttctccctctcctttgcaaaccgacctcctccgcctataaatagccgacgagatcatccttccctcccccacatcactacatcagagcttgaagctctcttctctctctctacttgccatgtccggccatggctgccaccactcgatctctcttatcggagcattgccggccaagccctcgcgccaatatatttgcctcgacgaggagaacccatttcacccctttcccccaacccttccaccttgagttaagccaccaccgccagctcccaaatcggccgaaccaagcacttgccgccggcgttccggtctcctccctctccctctccgccagccaccgccctccataggtgcgtggcgctcgggaacaccacccaccgacggcgtcgtcgccttccgcccgccggagagccagcgcccctcctctccttctcctctgttgctcggctggaaagagaagaaaagaagagaggaagaagaagatgagaggagagagaaaaagaaaagaaaaagaaaggaagattgacaggtgggcccttcaacagtaaattttcgtaattttcctatttaatgtgaattccaaaatttagaagcccatatcttttaaaatataaacccaattccagtgaaacttggaccaaaattcttctaaaatctttctctattttttgaggctatttttgctattttatcattttatttcattttttcctatttttggattttattcgaatttcttttgaatttgaattttacaagcttaaccctaggtcttgaggagtctcctaacctattagataatctcaatcaatctcaggacatcgagcaaggcaagttactatctaccttttgatcatttaagcctatattttacaaattatttatttatagccttctattcaacactctattttataggcataattcaaccatagaacccagataatttagtattgcttatcttgcttacaatttggttaaaatattttatacttagattgggacagtacgtaagaattggatgatttccgggtggctagtactgtctcgatcgatatagttattaccaggtagttatgtcaaacgaacgggtacgactgcagtttctagaatggggacagacctagttattatgttaattagcaatatggcacctctgtatagtggttcttatttttaagtcctcgcgtatgaggcaactatagccgtgaagggcaacttttaaccattaccatgtacaagtaaatggttcgtgatactcgagtataaattatatggtatattctaaaccctgatcgagatgacgtggtgtcatccagaactccttttgctgcaattaacattacgttcagagcatatgaggatataagttcatggaacaggtgccacaattgttaataacctaatactgggccatgactaaagctgatgattatcagcaagtcgtggactgcgggtaaagcgtacatctgctgcagtagaatatcattaaaactattcaaatagccgtgcacacggaattgagtatcgggactcatatggtaccctggttagaaacctaaagtatatgttttacaaactcttgctttaatatttctagattgtctattattgctttctgcaaagaactccactccatgccaacgcataacatatttccatggtaacttgctgagtattccgaatactcacccttgctcttattaaccctttttcatatttgggtcaagaggaggacccctgtgattattattatgatgactgataacttagaaaatccctagaggttataccttcctagtcagaatgtactagaacttccgctgtgtaatattagcacatatgtttaattaggtaagtacctacccttgtaaaacccctagtattgtaaactttaacgtatgcaatgaagaaccagctgtattacatgtatcaatatttattgatccagggattgatacattaatcaaagtcggatccaagttattagttttgggacccgacaagagccgttcagagtcgccggttccgttcgccggtttcggttgttcattcgagtgttcccgtgtcacataaaattgactcgttgggtcagtatctcgtgaggcccgctcacccgtcaggtctcctgcaggggcgagggcggctcaggttattcacccggtggccaatgcgaggccgggagcgaggggaaaatgcgggggcgttcctgcccaacccggtccagccccgccccgctgccacccctaattgccattgggaacatgtaccatgttcataccattacttgcctggtatcccacatgtacattaattaaaatataaccatcaggtttataccatggtcactatccctcgctcagctctcgatcagtggctaacctacaatctctgaatatttttcagacgtgaacagtaactgaagaactgaaacgaagaacagagtttttttggtgctgcgtaaccacctgcagcttttctgatttctcttcaatttattccctcatcttgtgaggttgttacatgcataacaaacaccgatttcaccggatccaaacgagtgaacgcgccatccgacgctccagatctagttctatcgatactaacagaaaaaacgggaaaaactcagctgcccaagactgaatcttcctgggacagccgttacaatgcatgcagcatcctatgcctaagaattcaaacttactaactgaaatcaaacaaattattgcaaatgcacaagattatcttcaggctaacacgctaacggtatataaatagggacacataatatgtcattgtttatagagtcaactgattaaaaagatagatcaggttagcattgagtgtgagctataagcctgttgggctaatgaaatgtaaagcacatgcatagacgctaattaaatgtaaagcgtatgcagaaacacaaccggccactaagttcagatcttgtcccgtgttcttctttcagttgtatcttccaatatctcaggcttagtccgtcagtgatcaactgcaaagtgcatactcgccatcagattccaagagcattcggtacgccctgtctatttctcgtaatttatctggttttgtgtcctggatttatatggtttttttcatcaatattaattcttgctcaactaacacacgtgttagcatcagacgatgcctggatggatggttcgcacggtgttcttgctcaattcgtgggtaatccgggcgttggtagtattcagcttcgcagcgcatgtcaccatcatcttcttggccggagtccgccgtcgtagggctatcggcttgccgataaccatcctgtgggcggcgaaccagctgggccggtgggccgcgacgtacgcgctcagcaagctcgccctcggcagcacgacgcaggagctggagctggagctggtgacgctctggggggcgttcctgctgctccatgccgctggtccggacaacatcaccgcctactccttggaggacaatgttctgtcgacgcgccagaaggtagaaatgatcttgcaggtatcaggagcagcatttgccatgtacaagaatatagtcatcagaagcgggtccggtacgatggtctggatctcttctttcatgttcatcatgggcatttttaagtattgggagagggcgaaagctatgcagctcgccaacctagaaaacttgcgaagctcaatcaagaagaagaaggagacaaggagacgacgaagcttgagaaatattaggcgtccaagcagttcaaagcatgataatgacgaggaggcactgctggttgctcatggcctgctcgacatcaccaaaggcgccttcgtcgattcttcaatcaacgagcatcaaatccctgtctatgctggcaggagacgagagatatttcctaagagtggctgggggatgatgtacaaggtggtcgacatggagctctccctcatgtacgacattctctacaccaaggcggccatggtgcacacatggcatggctacgccatgcgtgccgcctctccgttcgccacatccatggccttcatgttgttttggtttgacagcaagcaaggtcagcggatgaccgatgttttgataacctatttcttgctgggaggtacagtcctcctagacatcatatggcttctcagagcagtggcatcaacatggacctattcgttcctcaatgataggccacacctgtgggttcatcacgcgtttttgtgctctgggaagtggcgccagctccatcgttccattgtctccctggatccgtcgttgatcctcgccaaggaaccaagtagctacaggaagtggtctggaaaaattggacagtataacttgttacacaagtacactcatgacaaggacgaaaggaccagagattacttgagctatgtggtagagaaagtagcatcggaagacatctcgatggagtacgaataccacaacttgaggggtattcatatttctgtggatttcaagaagaacttgttggattgtatttgggactatatgtatttagcatacccagttgaagacgtggaggagaagaagaaggagaaggaggagaagaagaagaagaagaagaagggaacggcggagaagaagccagatccgccgatgaagccggctgagcaccacaatattgagaacattcggaaattggaagaagctctggattttcttcctgaatttcaggagtccattcttatcatgcacatcactacgaatgtcgtcttcatgtacactgaatctgaacaaaatgcagaatcgtccaagtccaaagacaatgtggaggtgaatcaaggcattgtcggattacatgatattccttatcgcggtgcgacccaccatactacctggtctcaagctgcgcagcctgtatgaagctaccgaggatgctcttgccaaaatatggtctaagaaagaatcttcccgctgcagctccagatcaagacaaaagtgtcttgctgacatcctgcgatgcatggagaacaaaaggagagagaaaaggccggataaatccgacaactggaggctaggctacaggacccggaactggcaaccagactatacaaccgacctttacagcattagtattgttctgtccgatgggattaaactagctgatcatttgctgcaatggctgcatcgtaattactgggttaaatttcccaaatctgaatactcgtacgaggcaaaatttgcacagatgtttccgaaattgagaaaaatcctgaacgggcgctcgatgtacgactaccccgataaatggtcgcgactgctggaacacatcttcttagagtgggtgcgtctgctgattaacgcgtccgtcaagtgtacaagagattctcacgccaagcagctgagccgtggtggtgagctcacgaccgtcgtttggatcctagttgaacacgcgggcgtatttcgcgtcgaccgtcaaaagagatgaaactgtttgatgctacaattcctactgaatcgaggggttcatatataagttgagatgtctgtcttctcttgtcctctgtacctgtaaaactcaaactcaatttgtagatcacagggttctcaattatatattacctgtacaatctttttctcatcgatatgataaatctaccatgggtccaaaatattcaaaaatatagcctttacttgtttctgatttaaaaaatcccaaaattcaaacggaaggctataagtttaccaacaaagatgtcaggaaaattttaaacacaaactataattgtacactagaagcttcagcaatttatgcagacactactaaaaaaacgtgtttgggtgccggttggcaaccanccatatgtgctggatttcccaaccagcacccaacaaacggcaccttcgagtctcctcaaaggtgatggtttaaaaaccaacacatttaaggttcccggaatgaaaaaataaacggctcaatgcactggctcaaatcgagccgatgcaccaagtgctccaccctgcttcgcccccgaaatcgcaccccccccaaaaaaaataaaaaataaaaaatcaatcatcaacaacacaacacacaacatcatctaaaaacgaagacacaacaacatcatctaaaaagcaagcccctgccgctgcctcggctggatctgttcgcgggagccaccgccagatccgccgcgggagaagcttgggacggagggggaggagagggggtagaggatcactggatctgcccagcggaaacgccactgccttcacctccgccggatccggccacgggagcaccgatgccgccgccgctgtcgctggataagcttggtggcaaagggatgggagagggagtagaggaccgccggatccacccgtcgaaaatgccattgttgcgtcctccaccggatccgcccatgtgagccgccgacgccaccgccaccaccggatcggctgcgggaggagcttgggggcggagggggactgggagggggtagaggacagccagatccggacagtgggagccgtcgacgccatcgcttccatcagatgtaccgccggtgagggatgtgagagggaaaggaggcggggaccagagagagagaggaggggatggcgggtgggggacagtgacagagataaaaagaggcgcgggtatatgggtggatataaggataaggactgggaccgattggctcgtctcggatttttggtgttggattattaaaatccagtataatatattataggtgtcggttgttttaaaaaaaatggcactatagtatttatgtcggtcctttttttttcaccctgcaggaatagaaaaagtctataggtgccagttttagatattccggtatttatagtgatgtatatactttatgtgtttatgtagtagtgagacttaggggtcaaaatttaccaaccgggactaaagatggatctcaaccgggactaaagatgggcatctttagtcccggattgctactcccggttggaaacccgggactaaagggggttcccaaccgggagtaaaaaaggtttctccaccagtggtagtgtgaaactggaatactgaaacaattgaaacttcaggatataactgcggtttcgtactatagtctatatatgattaagaatcaatccatatgttaggatacacgtgtgtgtatatatatatatatatatatacatatatatatatatatacatatatatatacatatatatatacatatatatacatatatatacatatatatatatatatatacatatatatataaaatatttgaaattgcaaaaatatggaataacttatgataatttctgtgaaaaatgctaccgcatggaccacttgttaccaattgacatgttggctgtcacttgtcatgaaaaaatatagtctgactaccaaagaaacatggtggacttggtaacaatgttatgagaaccactttatctatttatatgtcaagtgtgtttttatggatgtgatagcaatgttgaggatatgtgtgctagccactgatcatgggcctgtacgtacagtgtacactccacgtatttggcaattctatcccgggtgccgaaaaaattagtactttgataaatgtaagaatcataattatttatgtattatgtttacattattgttcctaattcttaaaatcacaacccacgatgaattcggctagctgggttcgtgattctcagtccaaatcatcgacccagggtcatcgacctgcatgacatggagtcatgtccctcgaccgatactttcgaactgggatcatcgtcccagctttatcaggatcgtggtccataacggtcgattggcgtcccgaggaggtatactcccgtcgtaccacacttttccaagtgtcgctcctcgtccgtcgaccctgttcctcgacccagtcgacccatatttttggtgactatgccttgaccacagttgtcgtggtcgcgtgcggtcgaggtctcacgtggactgccacgcttcgtctggatctgtgccgccgtcgccttgatccggtgtcagaacgagcccccaccatcgccttccagctcgtcgtcatcgctgagccttgccgagccctgccttgcctcacctcgatctacccatgtgtcaccgcctggattcgccgctaagccccaccgagccttgcctagatctgccgtcgagccctgcctcagacccacgccgccaagcccgtgtgctgccgagcctcacacctcagatccgcacgcccgagcgccgcccctgggtgtgtcgtcgccccaagcttgagagcgacagagatcgagagggtgtgagggagaagaggagggaggagagatctagagagaaaggaaatgtagctaagggagaggtaggtggctgtttttttatagggcctttagtttattttttatggcggccagttaagagaaccgcttggaaaaatctatttttataattataaaaataaaaattggcttataagcttataagcggtgctcttatctggccacaggaaaaaaagttatttttacaagcggtcgtcttaaaaaaaccattcgtaaaaatatagttttgcaagcggttattacctagggacctccaattgcatcttcacaaactttcttattttcttaggcgaaataaaaatggtgactccatgaaaatatttttttaagtaatgtaacttctcaacgatccaaaaattaatctctacttatactttttttttcatttcgatatagaatgatgcctatattggctgacaaatttcttccaaaattacacattctacataagccaagtctttggcggctgtcagaaatactatacctaccttgcaacctactccatgcgtctgcttgtgatccccaagatctagactgctcacagtgcacagatgcctgtcaactttacaaagattccgacatcccacaaatctgtccaatgagctgactcctttaacgatgacaaattaaggataatgatgatttggcaacaagtgtgccacagatatgctaatgatatccacacattgtccctgttgcgtttctttagagtcgaactaattaaacgccgaaagttattccatatttttttcaatgaaaaatgtattatataatttgtcctaacataaagattatttaattagcctaaggatgccaactagaaggcctagaaactcagttattttagtccccatgtttcatactactaaataaagaaaattgaccttggtttttctttagtgtcgtggtgtgtttgtgcttatgttgactaaggatcatgctaagaaaagagtcaaacacatggcaaatgggcactgatatgatattttcataagttgatatgtattagtaccgaaatgacaagaaaatatttaaaaagtggatatagaaaaggagaagaaaatccattcttcagttcacaagaagatttgtaatcctcattctactgttcatgtcgaactatccatcgcatcacgcatgcgactgatgatacaagcagctgggtcagcttatccgctccaggtggggaattgccggctagccaagtgagaccgtgggggcaatgggccgaaggcccatctagaccagcaaggcagggagggctccgaggttctctcgtgcagtgcgtgtctgccccagcgagtatgtagaatatacgaaaccgatacgatgacggtgttgtacaaaaatttgagataaaaacacctaaaacttttataatagtggagataaaggaataggttaaattgccggtccacacgtaaactgagtgtagagaataattgagaaccctgcaaattagttaattactccctccgttttcatattataagatattttgactttggttaaaatcgaactacttcaaatttaactaaggttatagacaaatatagtaatatttatataaccaaattagttttattaaattaataactaaatatatttttataataaatttatcttggtttaaaaatattactattttttctatgaacttggtaaaatttgaagcaatttgactttaactaaagttaaaacatcatataacctgaaacgaagggagtagtagctacaagtcgatcgagttacacaagtacacacaggagaaatgaaaaaaaaaagttctaactaaaggagatcaaatgaacacatcaatcagagacgctatggatatctgtcagtagcgagacacatgaatgcctagtctatcgtagctatctgctggtttcctcttcgtcgtctttttcacacgaagaatgcgagcgtgttcagcgaggatccacacaacggtagtgagctcaccaccacgagcaagctgcttggcatgggaattcctcgtacatctgatggacacgttaatcaagagacgcacccactctctgaagatgatgtccctcacttccttgggcatttgatactctaattcagtctcagtcgcctcaccggatttcatcaaatccggaaactgccgcttaagtttgtcttcgagtactttgttgtctccaatttcgatcttagaaccaggtttccaatttagcagaagattggctagtctagctccgtcagatagaatataactcgagtcgtaaagaacacttagataggcacctggtgacagtatctcagttttgttcccttgatgccacttgaatgttctcatgggtgtctttccattcttcttcatctccttatcaagcagacttttggcaagacacttctctctcgccatggagttgttgaaggaggaagaattttttatctccttccattgttcacccaaagcatcaaggagagcatcgtaccggctactgagtgcgaggcccgggagcatggtcggtcgcaccgcgacgaggaacatcatgtaatccgacaacgccttgatcgccttcccccactccgattgatcttgattttgaccggattccgtgtgaaagaggaagatgtccgtggcgacgtgcaggacaagaatggtctcttgtaaatcaggagtgaaatccagggcatcgtttagttcctgatcaataccaatagtagctttcgcagcagcctccgcagcaaccgtcgcagaaggaaacggatcctccacatgtatccattttggatccgataactgcacaggcggtatccgttcaggaaacgctaactccatgtttttccaaacacggtcaaacagcttgttcctgaaatctcttgaaatatgaatgcctctcgagttgtggtattcgtactccatccatgcttcttccggtgcattcttcttccaccaagagctccagaagttgctggtcttctcgtcctcctcccgagtgcactccctcaacaagttatactgcccaatggttcctaaccacatcctgtacctagttggtttcttattattggcaaggaaccgaaatagattcaaagagaggatgaatcgacggagcatgcgccatttccctgagcacagaagtgcatgatgaagccacgatcgtggcctatcattcaggtaagaataggtccatgtggacaccactgctcggaggagccatttgatatccaagatgacggcgccacctagcaagacgtaggtgattacaacgtctgccgtcgcctggccttgcttgctgtggaaccaaaacagcaggaatgcagttgctccgaggaatggagaggcgaaacggatggcgtagccaccccaagtttgtaccatgactttcttggtgtagaggatgtcgtacatgagggagagctccatgctgacaaccttgtacagtgtctcatcccaggtaccagagagtgcctcttgctcgtcatcactccttttgtccaaaaaatccatgaaggcattcttggtaatatatagcatatcatgagcaatgagcaggatctgctcatcatccggcttcctgcctccccggctagtattttggaggctgctgctgctgcttcgtcttctcatgttctccttcttcttctcctcctcctttcttgagcttctcatgttctccaggtttccgcgctgcagcgcgtagtatgccccctcgaaatacttggcgatagccatgaggcagacaaaggaggaaatccagagcatggagtcgccaggcatggcgaacatattcaggtacaggatataggcaggcgacacgggtccaaactgttatgaacgacgtatagaaatatgaagtaaacgaaaaacaatcacagcggagacacacgatttaacgtggaaaacccctttaatgcgaaaggggaaaaaaccacgagcaccagccagcaacaatctcactatctcaagagttttgggttacacgcctatggcggcttacaagagaatcaagtctccacgaaaccctagctccggcccaagcctccggcttaggcctccgctccgcttcgtcagaagcccggccaatatcttgaagtgaatttagaacaactccaacacaaacacctgagcaatcacatctaccttctgtcgcagcgagaggacgctgtcttccaaggcgtaggcggcgatgttgtccggcctggcagcatgcagcagcatgaacgccgcccagagcgtcgcctgctgtctctcctggaccgtgctgccgatggttattatgcccagcgcggcggtcggggcccaacgggcaccctcgtttgccacccacaggaggaatgtcgccccaccggtcgcttggcggcggcgaactccggcgaacaagacgaggacgacatgagcaatgaagctgagggctaccactccccggatcgaaaaaagaaagtctctgatgaacatcatggtacccatccatccaggcatcgcccctgctaatgcatgtggttaggacgtaatttataaacaaactagacgtacgtcaaacaatcaaccaagagacgtacgtaccggccatgcgctcgttgaatctgatggcgttacagttaatttgccactgatggactacgcctgactggatagtatatatcactatatatcaagctggttcgaatctacaagggctagaacaacagcaaacaagatgtgcactggtgccttgggtgtacgtgtttaacaatgcttgtagcaatccaggtatacttatagggatctgggcatttcattagtatctcgatctgttattgcacgcttacatttcattagccaaaagtgctacttaatatgctacagtgcatgctagcattatgatcaaaccatttttcatacatctgcgctattctaagcaagggtgtactagcgcccggtttagttcccaaaaatttttgttttgggtgtcacatcggatatacggacacacatttaaagtattaaacgttgtctagtaacatgagcatcaccaccatattagagaatatatgggatcccagttgcttctgccacatttgtattaatttgctaaaactcctcttttccacaacctccaagtgaatatagttagtagttaactactctctccatcccatatataatcacttttggattttgacacggttttcgagatactactttgacttaaaagtaatatgttttaaatagaaagaactgcatattaattatgatagtttgtttaatgataaatccagtaacatcaattttacttaattgatctttttttatatttttgttattaatagtcaaagttacaaatatttgattgggcactatgctaaaaatgattatattttaggacagagggaataatttcctggaatgatgttctcttctcagaatcatagagaaggaatgtttgttcttcatttcattttatcaaacaacatttcaaattacagcatcttaatttacaccgggttttaatattactgcagaaattaaaaacattttctgcgtgcataatgccataatgacggaaatagaactacttaagtttcggacatactccctccgatccatccaaaaaaactcaacttctaaagtttaaattttattttaaaaaaccaaattctaacatcctacctaccctcagcatataaaacgagaagttttatctcttaaattccctttacctacctattaccattgctacttttttcaataataagagatattttgcttatttttactcttcactattttctccttgggatgtgctaggaatagacttttttttggacggcgagagtattctaagaacataaacatttttttctgaactgaaaaaaaaattgctgcaaaaaatatattctgccaggtgggccgacagataactaatatttcaatccagcatttaaaatctgatcgacgtcctaacgaactaattttaggctgttcttcccctctttttctaactcatctgcctcgtttttcgcgcgcacgcttttgaaacttctaaatgatgagtttttttttaaaagtttatatacgaaacttactttaaaaaaatcatattgatccagttttgaaaaaaaaagctaatacttaactaatcacacgctaataaactactttattttccgtgttaagaatatgggttgccaatccaggctgccgaacacatattgcctgttgataaataattggtgttcatctaattcggtaaagcatcgacctccttaattaattatcaacagcttcgactccacatattgcaagagtggcgaggtagttaataatacacctgccggtagggatgaaacggtcggaaattgtcagaaacggtatattattttattatttttttgaaaacaaacgaaaacggtcagaaaattttgatatttatgaatttatctatttaatgtcaacttcaatgtcacactgacataaattaaaaaaaataaattttaaaaacggtaaccatcggtaaaaatattattattatactagttctgtggaaatcataccgttttcacctctaagtgccggtatgccccgcacacgttaactgcctcgccggcttatacatcctcgggtgtgagtgatttccctgtctccacgttaataatacaaggctcaattctccacggatgcatgcatctagtatggttctacacaggccggtagaccatagtagttgactatatatatagtagtagctgctagcttatgttgtttgtttttatatccagctcccgatctaatttttttctccttttcttattcatttgatttcttgcatatgtgccatcacatatatttgagtgtcagctacatgactcactcttagctcctaagagcaatgtcaatagtgtcacccgctaatggctgtaaaaatgactacatcagtctcttatagatattactaaaagctaatatatataataagtagatttacattgactattatttatttttttaatctttagctagcttccccatctaattttttaattttattgccgttgtttcgtccaaccattactgaatcgtgtcagctcgcgtggacccacaatcgcatgtcccaatcaaagctagcctggtgttgctacacttgcgttgggacgtgtgagtagccggtgataatttagtcgcagactcacgctctctctcctgtctagctcattgacaaatccgatgtggcagttttattgctggctaaacaggtttattatactttctctaatgcatataatcgtaggttgcccatggtacatgtaggtactaggtctaattaatatctaacaacacaaattctaattaatacctaacaataccgataccgatggatactagcatatctatatgtaccaggcgtgacacatatgggtatatccgatactcagctaccaagtctgaaactgatatatactgtaatggtacctacgataccaaacataattcatatgggtattatatttgaaacacgtgggtatcatgtttgatacctatatatactatatatgatatctatcagtatcagacatggtatatataggtatcaagtataatacttaccaaccttgatacaataatactataagataataggtctgactaagtatcaagtatgatacaagataatattagagacgataatatgggtatctggtccaatatcttcgatgttacattattatcatctatgcaccgtatggtctctgtgctctaggaagagattttaaattaattaaactaaaaatagtaaatagaacaaacaagtgtttcccttgttttgtgcacccgacagaatttatttgtagcaattgagctcatatatagctcactagctcaatggacacaagccaaaaggcccagagttataaaatccatctattaatctaatgaactaactaaaaaattcacactcacagtctaaaattttctcagattaatcgaagaaaggaaaaaaaaagggtttgagtaggtacacaattcaaagcatctgaaattcggagtaaaaaataaaaacaagagtcaacctggaaatacacactgcaggaaaacccttcattagtcccggtttgcaacccctttcgtcccgggttgcaatccgggactaacgatgctagcgccaatgttttttttctttttttattgtttatttgctgcttgcattttgattttcccaaatcgagttgctccctacgtatccctaaatcaaagtaacaacatctcaaatcatatatttacatcacaaattctcaaaaaaaaatcacgaattctaaaagaaatacattacagatccaatgaaagacaaattctaaaaaaaaaagaaagaataacataaaaaaatctagcgctactgcctcccgccaccctccgcccacctgccacctccctcccatccgcccacctgccacctcccttcgatccgcccgccgccaccctcccctacaccagcccctgccctcccatccgcccgccacaaccctcccctccgccagccgctgccctcccctcccgccgctcatggtgcgccgccgcgcaccaccgctcgccgccgcaaaccaccacctgccgtcgccctccgcacaccatggagagggccaggaagggaaggaggggatcgaggagaggggagggccggggaaggttgcctcggagagggccgggaacgagaagaggaggagtggatcgaggatagttgtggatcgaggggacgaggagtggaggaggaggggcatgagtagataaggatgggatgtgtgcgaggcatatgtcactgcaccttttttttttcaatttttgtcccagttggtataaacaactgggactaaaagtgtgtggggccgggggggctgacacggcctaaccacgttttgaaccgggactaaaaataaacaaaaatcgggactaaagatcataaagtgttgtgccgcttttgaatcggggctaaagatcttgtttagtcctgattcttatttaaacaggactaatgtgatttttagccaacccagcaaagatagttacaatttagaaaaataaaattgtattgtggcaagaaatttttaaaaaataataataagataataaaataataaaataggtagaaattctgtggcttggattatagctgtcacatgaatccttcgtacttggacaaagtggaatgcaacaactgccatcaaatgagacatcattctcaacagtgtcctcaaggacaaggacacaaggtagtaccaggatacaatccaaggtagcaagtactaatggagcacctacgtaccgttggacacaagatcatgactaattaataaaccgtacactgggtaggtgtcacaagtaatggagcacctaccattgaacacaagagcatgactaattaataaagggacaatttaaaccatgccacacaaattttacaaaatttgtgatatgccaccctgacccacatgtcattgactcatgtgggtcttacatgtcattgagatacgggtggtatatctcaaattttgtaaatatagggtggcatggttccaacaaacccaataataaaccacactgtacactgtataggtgtcataagtaatggagcacccaccgttggacacaagcagcggatcgatcagtgtcacaacctacgccagctttcaggagatcccgactaataaaccacgggcctgtttggcacagctccagctccaactccacccctccttgagctggagctcagacaaacaatttcagctccaccaaaactaggagtggagttgggtggagctctctcaaaaaatgtactagagttgtggagctgggtttaggcagctccacaactccactccagactcaactcctggagttatatttaggagttggagttgtaccaaataggcccgtgtcattgggacagaagaaattctggaagaactactcaatgaggcataataacaaataggtaaaacttgctatagaacattcaaaaaacatgtaatttgctatggaacaccgtaagaacgtgtagctgttgtaggacatcgcaaaaactgataattagctgctggacacccgtgacattattttattatttttgaatgaataggagagagaaacaattattaaggacaagttcgccctttgctcaaatcaatccaccatgggccccacatgtaaggccctctttccagatgggacggtggggcggcgacgagcggagtagcaccggatcaagcaggtatgggacagcgggcgtagcggcggaccaatagcacgacgccacgtcgttagccgcaccgcgcgcgttcctcgcacgcaccttgacagcgagccaacccactgttcctgcgtgcgcatttgaaaccgtgtgggccccgccttctcctatgcgcgacacgtcgttgctcctcgcccgtgccatttccctcgcaccgaatgcgagcatgccacgcgtcctagcgtggagaccgcgtccgcccacgcctgcctatgggtcccgcgtgtcgtacgactcccgcgcttgcctcgtgaatctggggtcgccatgtcgccggctctgaagaagagaagagaataaaagagaggagaaagaaaggagaagcaagaagaagagtgtcatgggcaattcaggactctcaacgctctttctctctctattttcatcggaaatagtaaaatatgtcacgagtgtacaccagctaattactatatttctacagtacccacaagaaaataagcattctttagatatctcatagctaattacacattttttgagtgtcctatagcaaattttgccgaaatagttgaggaccaagttccacttgaggagcagaacctgcaccaaagacatagaagtaccaagatcgacgtacaaagacctaaaaaataaagtcagtggtacaaagctactacgtagctttcaaggatcgacaccacccctagttcttagctaggttgcccgccgtagttctcccatagcttcccttattttgaatcttcgatcgggtcaagatttcttttgagtgggtaggtttataacaccccatttttctcatgctattaaaaactatttaaataaaaccttattgtgaaagtttggatctttgtgtctgatcaaggatctaagtgccaaagatctcaaaatctctctttgagacccaaaatttctttccaaactcaaatcttgggattcaaattttgaaatttgaatttccctttgttctttccaaatctcccaaatcctgaagccatcaaatgtctccaacaaaaacatcaatttttctttgaatgcccttccttgggctcctcttgagtttatgagttcaaatgtcaaatttaatttgaattcaaattgaaagtcatgatcatcaaattctgttccaaactctcccttgaaaattcccatgtgctactgtccatatggaccacatcatcctccctctttccttctgatcctggcctgcaacctttttatcctcctcctccgcacggcccatcactctgtctctccacggcccatgtcctcgcctcctcccgcgtgctgcttgctcactcacagccaccatgcacttctttagtgtgttggccaatagaccaggcccaccctgcgcccgatagcggacgcgcggccgtcccctacctgcccaccgcccgttcgacgatgcgagtgtgtgtcggccaccgagccatgcacgaccacgtctcctcccacgcatgcaaggctccatcctaggggtagcaatgcagccacattcggcccccagaccttagggcaacacattcacatcagtggtgccggcgcattagcagccatctgtcttgccattctcccttctccgatgagctcccgttcccattccttcctccttcctctccttcccgaaaataccacaaccaaccatcactgtcccgagcctaatccccacccccaaataatcgccgctggcgaccaaaccccgccaccaccgaaccacttccccctcttgctgcctgccatcccccgtaccctcttatccaatccaaactgtccatcttcatcgtcgaccctccctcattccattatcgtgctctgtttcccctcccacgacgccgttcgctgtaaaaccgccagccgccatcggtcgtcgatacagtcctaggtcaacgcggacccagaccaccgatgcggcgtggttagccatgcgctgcctcactcactgttaacaacgaaattttgtatcagattcggagaagaaggaacaagatcgaagtggatttgatgaagaattgagttgagatcaaagttggaccgcgcattggctggcatcgttattgatggtcgttacaaaccaaattcgacggtcaatataactaaaataaaggagaattagctatgcttgcaatgcatatttgttttaaaataatatatttctatttgtacttggattctatctatctatagataaagagatacaaaatggaggagagccggcagcaaaacactcgaacaatcaatcagacgctgtcaagaattagacttgtggggaaatgggccagaaactcagaattgacatgatcaaataggcccataactcactgatttggattgaggagccaaagaggagatggcctgctgaacagggggcctgttgggccagcccatgttcagccgaaccataggcccccttagcaccgctggatgaagggttttgatctgacggtggggatttactcccaatggcagttggagggtattactaacctttccaactgccacaaccgttattcttcagctataaaagggcttcacctctaccactccttcacacactcaagcaagctcaattatctcttctacactttagtttagtattctagtgttaagtggagtagaatagaatagctcccggagtcatcggagtcttcggaggaattttggtatggttgtaatagctttccttctttcttttgtaagactttaacaattgatgaaatattcttattcatatgctctcgatacttcagttcatctaagtattgtttttactttatatctgtatcgatacaactgtatagttagcctaccagcaaggtacaatggtgtgggtttaatgttcgattattcggttgctctatgttatctcgagggatgtagagtattatttaataatgtagacgtggtgtctagattattaagtatcattatctaggcatatatggtacgggttagtcgaggtgggccgctgatggtgacagctcagtacgggtattcctccacgatagtatatattcctaagaaactttcctagggagggtactccttcgtatttagccccggttggacggccatgacaggttgtcgtaaggaactcgacaagccgcggtggtctctcgaagcactaggagggcactattagggggtattggctatatagttgtatactagcagatgtagactaaagttgggtgtatattataattataggaatcgattgtttttctatttcttcttccacttagtttaggaatgattaaatgagatacatgagtgctttgcttcgtgtcactctacccatataaatatcttaacccctacttagactttgattatgcaagtggcatgtatatatattattagcatagttctctcttacaatcttcccttgggattaaataaataagatactttcgaatactcctgggtgaaatgctacaatggtatatccgtgcacttgcaggttctttctgtaaaccatatatatactaggtccatttctagcatcatggctaggaatttatatttctagtagtatcattaagaaataccaataagcatttttggcgccgttgccggggaagattaataaagagattactataagctaataatttatacacaccacctctgtatatatcactgtcctttgtaggctaaccttggttgttttcacttttcgtgtgaaaatagggtagtgcacatctggtttcaacttgccggaaaatttcaaagacaatccagagtctttcttctagaatgttaagccgcgagttagaaaaatcacctgaccaagaaaccaaccatccccgcgtcaccgagcttgtagagtatggccgagaagacactccgcgagttcactgccccctcagctgacaacgtgcccgttgggccgcaagtcaacttgtgagatgcatactttgatttgaagaccagcctcatcatgatggcgcaggctagcccattctgtggcaagcttaacgaggatgccagtgatcatctgcaaaggttcctggatatctgcagcacgtacactatgaaaggagtcagcccagatgtcgtcaggctcaggctattcccattttcccttcttaggaaagcgaagcagtggttctatgccaaccgtgctacaatcaacacctgggatacatgctcaacggcatttctatctaaattcttctcgatgggcaggaccaacacccttcgcggaaaaatttcaagcttctagccgacgagggacgagtcaattcctgcagcatgggagagactgcaggagtaagtggtcgcctgtcctcatcatgggatggacgatggctgatcctgcagagcttctacaatgggctcaaacctgcatcctgcgaccatttggacgctgctgatggaggggccttcttctccaagacggtcaggggaaccgtcaagctaattaagaagatggtctccaacatgggctggggtgcagaacgactccagacccgccagcgaggcatgcacaccgtcaaggagacggaaatgctcgctgcaaaattggatctccttatgaaacggttcgacgatcaagagaagaaaccttaggtcacgtcaaggctatggactcgtatatgacatgtgaggtctgtggcagaacgggtcactcggggaatgactacattgagacccgtgaggaggaaatgttcatggggaacaaca

SEQ ID NO: 82107 - DNA, 1106 bp, Oryza sativa
atccttgcgcaggggccatgctaatcttctctgtatcgttccaattttatcggatgtcaccgaagtgacggcctggctgcagcgcgcgcggttataagctgcttatcttttctgttggctttcgatgtggtattaaacttgccccacagcgcgcccacggaaaccatcggatcaccatcccacggacccaagtagcaagctccacccgcgcgagcgtgcatgggccacctgcaccttctggtgcggcccaatgagctaacggcccattggtatacctgtttcggcccacaaacaagtccttgtggaaatgtggagctttcctctgtaactttgaaatcctgaattcttcgatttttttttatccccaatgactctatgagaattggaatctccattcaagtgtccagttctgtgtttgggatggtttttcgccctaagttccgtttattttccattggagcaattgaattattcttctgggatagtgattatcccagttccaggttggttcatcattcatcaaattgacaacacaacaacattctaaaatatattttatcttttattttttttaaagcatgagctgctatttcacttaatcagtaggcatgtaccaagcaatccaaaaggcagtgagtagagcaacagaaataataaagcactcatgtacatatgcgcagttcctgagcaatagtaacatattatacttcattactttatctacaaaaatatctcgcattttattcaatggatagcaggtatctcaaattttcaccagcatccatcaaacaatgttctctcatagtatacactggtcagctatatgcatcagggtactccagttgaacatttttacaattttgagcgccgtatgcattttatcggattgaaagtgccatgctgacgagcaatagaatttatatgcctcccgtttattgatgcagaaggcttgaagtcccagccttctacgttcttggggacgcatacatcgtaaagcatctgacccaacactccatgggggttgttaatgctttccacactgggcatgttgaacaactccggtttcggctcttcgttgctgctttcatgatactccatggaactcg

SEQ ID NO: 82108 - DNA, 60629 bp, Oryza sativa
ggtgttggttaattaaaataaatcacatggtgatccgtgggtgcatggttttgctggtcgcacccatggcagttaaggaccggttcgcgggatgccctggaagaacttatcgtacttaccacaagccagcgtgggcaacggctgggcttgtaacgtagctttcctctagccgacgcatccaggcaagggtgggcgtgatggagtttggatgggccctgcgacggcctatgcggcttccggattcacctaggcacgagaggggactgcccgttgccttgcgaggagtgggggtgaaacctgaggtgtggtgtgcttggttagagggggttatgcgaatggtcctgtcacagcctctttccggtatgtcgtggtggcatgtcggcgcacggaaacgtgttgtggggctgtgtcttgtgggtacagttgtaattaattattacaactgtttaaatctttcaacttctgttcttaaatgctcgctttatgcaaatgaaccactttagctcttctttgatgattccctgcatcatgctctgttcttaaatgctcgctttatgcaaatgaaccactttagctcttctttgatgattccctgcatcatgcctctattccggcatgacttgctgagtacagtgggtagtactcagtcttgctctacttttcccaacccccagagtgcgagtatatgtcggatgaaggtttctccgaggagtaggcttcgtccgtgccgtcgaggatgcctgtggagtggtgttcccgctgcagttctagtcaaggcttagctcctgttgtctttctttctttcccgctgcagttctagtcaaggcttagctcctgttggctttctttctttccgctgcatttatgtaaagacttttatgatgtttgtaagacttggaattctattcgggaatttctgggcgtgacaaggtgtcccgccttcccccaggccgggaccgcttacatctgatagctttcataggtcatagactgccctcacagggcaacacatatcttttctgcacactttgtcctcactcgtgtgcacccggaaagaatttcccggtcggtcacccatcccaaattgctccaggccaagcacgcttaaccctggagttcttcggagattggcttccggaaaaagcttccggaaaagaagttgcaacttgttgatatgagtattctattaatcctattaagccctaggccgggatgttacatccggcgaggcggcgcggaggcgacggtgaacgtcgacgcggccggagctcgtcggcggggaggggagggggcggagtccgaaggcagccgccaagccggcgcttcccgtccctggcgagggacggtggagggacactccaagacggcgcgcgcacgggaagaccgacgcggccgcaaggaggtgaagtggcggcgatgctgcttccggtttagggggcttcaaaatccggtatgtcaccaaacccgagcctaattttcttccatttggatttaattcggactttgtgacttagggttcttccccaaagaattagggttcttcatttggggattttaggccgattggatccggcttatggggatttcgggaaatttcaatcttgtttattcccatatgattaaccgtggggagtttcaatcttgtttatcccctaattcttgtttgctgagtactagccgaaaccttagtttcggtctaggaattttgagtgcgggaattgggaatttccctttgctaaatttaggggaatttcaatctagtttatccccttcttagcttcggcttagggttctgagtgcgaggaaattgggagtttcaatatgtttatcccaatcccttttcttctcttaatctccactgatggataatcaaaatcgaaaacttgaattaaacagcttcttcaataatttgcttctcctactgatggccgaaaccaccagtataaaagggcttaatacttaaagaaattaatccaatctaattcaaaattgctcatgccgaatcaatcttgtatttttataaggatggcttctaatcacagggatgatgtgattatgagggattgagtggactaaaaattaggctctgataccacaatgttggagttctaattacatgatcttaagctttagtctataaacaatcacctcttgcttatgcggaaaaataattgatctacttacctgagttagaagccattgccgttcttctttcttcttcttgcagagatgcctcacgaaccccttccagtgcctagatcgatcgggcgattaattagggtttgagattagagagagagagagtttggtcgtctgtctccttccttctctttctttatataggcgacattggtgaggctcgggggttatctcaattagtttaggattctgttttctgtaccgatcacacaaaaaacgaatttatctcttagtttgtttcttgttaggataaggaaaccggtggtttagatcctctcctaacccttatcgacacaagtcgacaaaatcaaccaacatacataggcataataaagatacatatatactgcacacaatacaggagtcataaattgtcaaaaacaggcttctcactgagagtgtgatgaagactgattttatagaagatttctctcgttttctgacgtgcacgcttcccgaactactaaacggtatgttttttgtaaaaaaatttctatagaaaagttgctttaaaaaaatcatattaatctatttttgaaatttaaaataattaatacttaattaatcatatactaatagctcatatcgttcgttttgcgtatcttcccgatcatctctttcaccttctcattaaactcagccttagccatacgaaaaatggggtactctgctgttttacctagcagcacaaggcttgtaaattgtaatgccttgtgctctcccgcaaccccattttaatggttcaggcttctctcataattgatttttcaacgataaagacaaaagaagttgactacctgtgtagacctttcacctgcacatggaattaatctgtcactgtaaaaaaacctagatttgtttttattccatctggacagagtagaatatgtcacatccaattctaaatttattttttttgatagagagagtatgcaggattctattgtatcatagtcctaggctgggttcgttgttgtgtgttgggaatacatttctagcgcacgaaaaattgagcggtccattagcatgtgattaattcagtattaggtaattttattttcaaaaatggatcaatatgattttttaagcaactttcatatagaaactttttacaaaacacacaccgtttagcagtttgaaaagcatgtgcgcggaatgtgagggaggtgagttggaaagttggagaaagaactcagccctagcgttgttggtcatcctattggacccgctattgatcatcgttttggtaagctgcaacaagcttagctaatcagaggagaccctctccttgggcatatttttacttctactactcaacctatggggtattaggaaccatttccagattcataatttatataaatggactcttgacattaaaataatcaattaaggtatcattagttggatttccaagattaagaatgccacttctatcaaacagataaatttgtctctcgaactatagctttaatttattttcaaggatggtcaataattagatttctactattgcccataaaattgtaggtcctgctcattcagcctctatcataaacaattgttttttggtatgggggaagtcaatcattggctccacaaacagtggtgtgtacatgtggttagggtaagtgctataatgcttcatatgttacccttaaaagtgacacatagaattgggtgatgaggtggagaagagagatgatgagtcactcctaaatcaagaggtagcctccacacaaactccaagaaggatatgggagtattataggtattggtatttgtgtattaggggtgacattgtatatattacctcttaatttatgagtgaataacatagataaatttggaggtagcaatcacatctactatagatcgtgtcactgcaatcagctaaaggaacaaagaatgagaacacacggatcatgatttgtcttggccacttgatgtctcgacctacggagtaacatcctcggccttgagctgaccttgtcagtcctcgtcacatggacactaacgagaataaaaagttaatatggttcactaatagaacatagagccatatacaacacttatactaaatgcgatatccataggtgagcatgttatccctcacgacatgatatggagtagcggccacccattatttgttaaggttggtgaagggaaagagtgtatcctacattttcttagtttatgaattaatgtgttgctttgaatagtaggatctgagctttcatagaaaaataaagttttttagaggtattctagtctttacacacttagtttagacaaatggcattaaaaaaatggggttcccaaacaaccaagatttccaaccaacatattctttagacaactacaaaatctcgaatagtctataccccgtaatctacataatcgcaatttctcccaaaggggtatggatagataatcaattagagtcatagcccacaacaagtacttcatatttagcagcatgcttcaaattttgaaggatatgagctgggtaaaaaaaatcatatatgtaattgtttacaaccttttttgtcgtttcgatatatggtttattatagacctctaatctatatcaagtagtgaatccttcctcctatggatattgcatttagtacatgtgttatatatggctctatgttctattagtgaaccacaataacttattattttcatttggtaatcattgccggagccatggattgttatttgtaacaatctagccccaagttagtttttatgacaatatgctagttgggagtttggtactaatcatgcacattatgcattacaaagagttagatctcaatggtgattcacgtggaaatcatcacccatagtctataaccgtctgtaacaacgatatagcattgtaggttccattaacaacgatatagccttgtaggtcccattatcaacccgaaacattacttaagtaacgagcaaaattccagtgcatacagggcaggctgcctaggataaaatttccatgctccatgtgtattgcgtcatatacagaaaatgttcaatcagctcaatattaactccacccttgtgaaaatccagtcaaaccaacaccaaatgggtgatgcatgtgtttatcagccatatagggaaaacttggacacatgatgtagttctctagttactatatatgttgtttgacattaactggtttgaagcagctggaagttacacacacgcgcgcgcacgctatttgctaaagtgatgatcctctactatcaatagaggcgtttattggagttataatgttaaatggcgacttttcattatattgatgcaacattgttcaatagagtgcgtagtctatgtgcagcatacaactcaacaaaatggttctatttattttccatggatctactgaatctcaagcttttaataagttgtaccgtgaaggacaacaaattagggtgtgcaactataatcaattgaagactattacaatttataaaccagataacacagtcaggaggagagaactataaagtaacttaggtctatggtgtggtagaaacatagccaacaatgatgtctcctatgtttgaacaaacatactgttagaaatatggtcataattcagcatattttaatccagaaaaaagataataaacatgacatgtggaaaccgaaatgatccagtgatagtgctaaacatgaaaatactagtaacaatagtagcatcatctagtaacatgtttaacactaaggtgattagagtaatatacccagagaacgctcctgaggatgagacattgttgttgctgttgcctacgttggtgttgttgttctcgcctcctccagtaccgctgccgacatgtccaccgttgacgcctcccccagtcaacatgttgatgaagatgaagtagacattgatgaatagtgagtagtcgcgccttgcactccccaaaaacctgatcgcccacctgtccgtgcaaacgtcgtacctgtccgtgcaaacgtcatagcagtgtgtggtttcgaaggcttactctcctaatacgtgtgcacacactcgtcaggatgggattaccgtagcagcaacaacattggaagtggatgaaacgtgtgtgtctcttctcccattctcattttataggagaaatgaaagatgaagagtaaaagagtcatggaataggaagatgaatagagtaactaattgtcatcaactatcctccactacacaaccatcaaccaaccatcaattaggagtaattgatattggttaccaattcattaatcaaatggattaattctcaaaacttttcatcccattgatatcccataagagaatgaatacacataaatttctagcatagtgagccttggaatttatttgatttaattggatcaattacccaattaaatctaacacatattaggcaactatgatcagatgcaaccatggaacatgtagattgaataaaaataatatcactatcatatattgttaggactttggtactccaaatgaatactgcaaacacaaatccagcattactgaatgactaaatatccagtgtttttcaggcagtttgataacaatggttgatacacaaatcaacacagtggttgatacacaaatcagtgcaaaagcctattgcatataaatttgtcgctagcaagccagacccttgagcgaacaaagatgttctgaccaaattcttatcattcaccaaattttgataatgcaacttggcaagaatgtattgaaagcaatgagatactctggtaacccataaaaaagatgctcgcatagtgaaccacactgtaaattaaatgaaaatcctgtataaccgagcaattgacgatatttatttactagttgatccataaacaactcctacaacatagatgagaatttctctctatagtctaatcggccatgattttacatacattccttatgttttcattcttcatgcttgtgactcacctgctgtcggtgaaatggaaaccagggtacccatttatctggcaaaaggatcattatcaaataaatagcatgctcagaatatctttaaaaataaaaaggtaaccctagagtgacgtagctaggggcccactctggtgggtcccgggcccacctaagttttcatatatgggattctccctagctgaggaggaatactgcgtgtatgactcaaatctctgagcataaaagtagcttgggacctggcttgggtcccaagcataccccaaatgcgtcttaagaatatagcctatggtctgcctcggacctggccctgtcctaggtcccagtctcaccttagtccttgtaggttctacggtcctcggcaaaaggggcgtagaaatctgcaagatttatatcttaagagaacaagctaaggtatgcttcgggcccggcctactcttgggccccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagggctcactccctctgcctagaggagcatcgagacgtacaaatcttggaatattccttcaccaacgacatcttcgagaaactcatccgaggattgccaaacttgccgggaagttgggcgtgctccatagccagctgtgaggcagtatgccccgccataattgaaacaggatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggtctcgtcaggcccaccacgcaccacgtggcgagcacactggtgagatcctaactgtctcagatggagcccggggtaatatgaatcgcaagactcaaagggtttcttgaagactgtgttagggaaccagccggcgacaataagacagctgataagacaagactaatagtagattggtaataatgtgagcccctccttggactataaaaggaaggggaccatatacagatgaaagggttggattcttttagatcagtactcttgctttgtagcctgaaaaggtctccattgtacttagctgatctagagaagacaacgaacaccaacatagagtagggtattacacctctgggtggcctgaacctgtataaactcctgtctccctctctgtgcagggtagtcgggccccgtgaacccttcctgattgcagatagtccgtgcctctcaccgcaaaccccctggttggatctttactctcggggaggggtctccactccccgctgtctgagggactaccccctcgacacctgcgctggtagaaaccctacatattccgacaaactgataatatttcttaggatgttgtaaaaaaatgttcttaatggtgagaaggtacgtgcttgttctcttgttacctaatgcacctatgctgatagaggcatggaagttggtcgctcgactggcctttcatgatatggagatcaattaaactggataccattatatctttcgagaatacaaactggagaggaaaaatacagggaaaactaaagactttttagttaagagttaggacaaaggtcactaaataatggctcgaggaatagggtcaaagggaagcaggacgccacctgtgaacatcatatctgtagcacggcgtgtttatatttctttcagggataatgaggatgatgacatgaagaggaagagatagaggaggacaagaaaatacggatgattattgtaatctggagagcaccttggaactttataccttcacattttcttaagtaaatttcacgaaagcttggctgatactgttcaagttgcacaaaatcacacgtgttatgttacgctagatattgtggtgctagagcaaaatttgacagtacactaggttgggataaccattttacaaaggtttagggtgtacatagtcactgctacctatgacgggcaatgaacaggagcctatcaaagataactatagtcatctttcacaggtgtaaagctcgcacatgtcactgatgacccctcattggtgacgagtttggttgtggctcgtcacagatgtcctatgccagaccacaaatacagcccatcaaagataagtagtcatcgatgatgggtgtggctaggcggaaaagctattgggcgcgcgcgttccgggagtgcctaactaactattttagactctaactaactaaattagttttagataatgacggtaattaagataaaatttttctttttttggaagatttttttactaacagattgaaaacttttgacttaagatttaaactttgaattcaaattttgaaaattttcaactctaaatttaaatttgtaagacaaaatttgaaaactttcaacttagattttaaaactttcactcgagatttaaaaactttcaacttgagattgaaaattttcaagtccatatttgaaaattttcaagttgagatttgaaaactttcaacttgatattgaaaattttcaagttcagatttgaaaactttcaactctagatttgaaactttcttcagattgaaaaactttcaagttaagacttgaaaactttcaactctaatatttttgaaaacacgtgtcctaacaattaaaaaaataaggaaaaacacgaaaaaatagcgaaaaagatggaaaaataaaaggaaaacacgaaaaaaatagcgaaaaaaactgcgtgggaccgccagctggcgtgcgcgccagttccgtaactagcgcactcgcgccagttagcatgccctgtggttaggaggccatacctttgctatggggtgtatttcggcttgtacaagtgagtgcctcagtgatgggccattgggctctgtcacccggttttatattagtggcctagaatgtcacaaaatcacacattaactaatctgacgtgctactacattataatgcaaaaaatgcttaacttagatggctatcactctgatcaggtgaccaaagaactagcaaatttgagatatgaccaatatagtacatgttagatgattaaggcctgtgtagttcccacataaaaattttacatcatgtcacatcgaatgtttgaacacctgtatgaagtattaaatataggccaaaaataattaattgcacagattgcgactaatttgcgagacgaatcttttaagcctaattgctccataatttgacaatgtggtgctacagtaaacatttactaatgacggattaattaggcttaataaattcgtttcgcggtttactgacggattttgtaattagttttttttattagtgtctgaacactccatgcgacaccctatataatacctgatatgacacgcatatttgcaactcaaatatttccatctctatcaaaatttctattgttttttaaaaaacaaacaattaattgtcacctagatcatcccaactctataaacatgacaatcttccttcatttcactatcttggctatgcttgggtctgattttgataacaattttgttaaagttccttcggtgggggcaactggtggtatcttgattgcatggagaagcaagcttggatccattagttccggtagggttgattcacatagtgcctcagtccagttctgtcccaagataggggtcatggtgattgaattgtgtttacaggccacaagatgagatgagacgattcttttccttcatgatctttggggtattctgttgcattctttgggtcctaggctaaatcgcaggagatttaatcttgtttataaggatgcacagaagaataatgattgtttacacccaaatttggcacctaggattaaaataggaaagattgccaaaatttgtaagtctaccggtttcctccgagtgggccggtctgaccgccgtgtgttgagcggtcagaccgccggttgagggccagtcagaccggcggtgtgtggccggtttgaccggcaggtccgaatccgattgtgtttcgtcgggtctcgaggtttccttgctcgggaaggaatgtttcgggtttcctttggtttctaccccgagttggacgtggaggagggcctgtagagggcaagaccaacccctatataagggacatggccggttcattgtaaaaaaccaatctacaatcaatcaatcgaatcattttttcatattgcttttagttttctcttagtttgtccatctttgtcggtttgcgccataaaccgtccgccgatgctgcgagagtgcgacatctctttgtaggtttgtcctgaaaacctttcgttttgcccacgagatgggtagttatttagaaatcggctccgctagccgatttagttatcaaaacccatctaggtttagctctttgctagatcgaggtggttggcgactctaggatcaccgcaaggcttaaggtgctgcgatcgtgcttgtcaacttgtcaaaaaagttgccaacaatgataatctcaacagggccatgatagggacgtttaggtagtcaaggaaatccccttgcatgttagaaattatacttggtcaaataatagggactctcttactcttgtcaaattggatagaatgatcttttgctcagtagaatgggagtcacattttcctaatcatgtcctacatattgctgcaacagaggattaggatcatcgccctttgctgctagccatctacaacatttggtatctcctaaccaaagtacttttataaaaggttgatttatccaagataacgtcatgcttgtgcaacaaacggcaaagttcttgcaatctcaaaaggagccaagaattgctctcaaattttacacgtgtaaagcctttcactctgcttttcggccatttttacttgaagtcttgcataggatttagccaagtttagcgggatgttttaagtaggttgttggctaggttttctactcaggtactcttaaatgtactcacaacgtgtcaatttctcaccggcatgggcttcagcaaggagatctcgtgtccttgatgctcttcatcttggtaacgactaggtttctcacatgttgtgtcagacggtcccatgccccttgctcctgaatatgtaagacgtttaattgggccttcaaagcccattaggagtctgatgacgagaaacgcggcggcctgggagttcggcttagttccagtacaggtccaaaacgcttttaggtttagggcgtgccagttagtttgatccgatcaccaacaagaataaacaagaaaatcaatcaaattagaatacgatagccgatcagccagtaagtcgatgacatatcgtgtgaacctagccgatgcgatctgaccgaatcggctgtgaggtgtaagatgaatgaaattaagtaaacctaaaatatgttccatattttgatgataatattttataaaaacaataattctaaattaataatatgaaaaaagaagtttacgagaatttaagattaatatatgataccatcacatactaaattttcaaatgaatgtatactaagttatccttagcatactagtttgtcatataaaagataaaaattacacatacatctaggctcataagaagcttgagctcgggccgacaaagctcgtgaacttgcgcatgggcttgggctcggctcattaagagctcgatttgagctcgaatccagtccgaaacgagccaagctcgagtagcgcacaagcctcgagcttttttgacagccataattgtagtgttgttagtagtattaatgtagtatgttgtatcgtttcatgtggactcttaggtttgtagaacttggtgggataggatgaggacctagtaggacaaatcattgtagtttttagtatattttattttttaaagtctagtttagttagttattatcttatttgataattgttgttgacctgttctgctcctgcttaagtgataacaaatgtttgaaccttttgcagttttgaagcattatgcttcgacaagataattggggtaagtggagatctggaagatagttgaagaccatggagagcaggtaatagtgcgtgaaccatggggactatgtcatagatgcaaatcgatcaaaacaagcaccaaattccatatatatagtttagaaacacgctattgttctttgtttggtatatttgctttgacactcgattattgcagcccaatgagagtgttgattgagaatctttagcttttccttttttacttcgaaacaccatcatatttcaaatttaccttattagataaggtgcaatggtagcagcaaaaaaaaaaaagctcatgtcatcacatttgcacacctcatgtatctatgatgtcagtctaatggcgaatccttaattgccacttgtaagagtggcaaatagttaaaatatatgtactattttttacacaacctagcatcttcaacactttcgatgcaacattggtcaagtgatggcaatctgtctacagcatttaacagaacaacatggtctgccaattttccatggttctatttcattacaacatagttcatccggaatagtagtattgctatggacaacacattagggtgccaaagcaacaagaatcgattcaagaccattagaaagtcaaaaaaacagttaggagagaaaaaaatcaagtaattaagtacgactagtgtggtacaaacatgatcaatggtgatagctcctacattgaacaaacaaaccatgcgagcgttaaatgcaacgtgagacaaatattagtaagagagcaaggacaagtttgggagcttcctgtagctatagctactcccgaaatctcgagctccctaaatagttcagacttagtgtttatagaatcgagaaaataaaatagtagcagaggctggataacataggcagcactcaaataggttgtctatctgagctactctacggcatggaaaacacgatagataactagaacatgattaattaagtaccaactattgtaaacatgacaaattgttttatttttttaaaataaacttctatacagaaaatgtttggaaaaaaatcatcgtagtagtttagttagtgtgttcacgataaccgaggaagtagccaattagagaatctcatcaaatgatgccttagcttctctagatttttcaccaaatggatactcactagctacttagaatctctatctccaccaaatagatggcatagataaaataagaataacagcactccaaaatatagtcggcacttaggtacttagacaagtacgataagaacaaatgtagcattgctaaattattcaattaaaatagatgagtaaaccaactcataaagttatcaaagatttattatagctagtgagcttgagccttaaacgaggaaacatatttagacaaaattcttcatcatattgcatttatgcctcttggcaagaacttgttgaatgcaaggagtagatcaggatacccatcaaaaaggatcttcacacgttcaataacagtatgagtgttaatcctgcataaccaaagtttcaataaaacttgttatccacatacaactagtaacacatgagaatttcttgctccaatctatccagtcatgattttgtaagcaaccaccctatgttaatgcctattactcacctgcccctggagaaatcaatcatggtgtgtatgaatgcatggaacttctcagggtgacgcaaaaatttattcttgatggtaagaatgtaattcattgcatcttctgtcgtcaacttatgcaccttcaccgatgtacgcatggaagtttgtggcttaatggaccttcaatgataagaagataaatcaaatatagtaccattaatactcgagaatacaaattgataaagaaaaaaacaggaaaaataactagagccttttactaagaacaaaggtcaccgggaagctgagttgaagaatgatgttaatggatgtggaacctaccggtcaatatatttagtacaaaataaatcctacataacatgcatttgaaagaaatttaaaaggtatagtgccaacacaacaccatgcatatttagttatgattttctcagttcaatcctaccagcgattatttcttctctctttgatttgggagggacgagatggttacaggtagggacggacctaggttttgcggagatctgggccggcacatggcatgtttgggccaagaccaccattgggtctgttcggttcagctgggctgtggctgcacagccacagcgctgcagctctcctagcataatcttgcttcctgagtcctgtagctacagcgcttccgaactcacccattatatggtgaaagtttgctggacctaatgggctttgtttcctaggcttcgggcaatggcatgtgtgtcttgaggcttggtctgcccttaacacaggtggagcaggagcccaaaccaagcccaaaaactagattcgccactagacctgggacatgaacctcaacaaatctagtcgacgacttggattgatacccaattaataacaatttgtaatgtaaattttatattataaccatatgacacgtgaaagagtgaaaaggtactagccagcccacactattccaacccaatagcctttagcccataaagtccaactactaccaactctcctctgccctaatttgtctctcacagtcagcctactcccccatcccacaccgggccgcctccccctcacgccgcctccattcctccccaacctcatctcctccatcctccccctcatgccatccgctttcctcccaaacctcaacttcaccataatgtgctcccattcccctcaaattcaaaatgtatctcaaacaacaaaggcgtacaagagatagtcgtagagcaaatgaaggctagaaagtaatggtgaccatggtggagactagagaacaagatgaccattctaagaagaaggatttacatcatgcaaattaaaacccaaaagattttcaaacactaaatcagcaattcttcactcaatttcacaactaagacgaacaaagagtaaaacaagaagaggataacaagggatcgtagggattgatcggtctgactactcaccgtttgaaccccatggttgtgcctgccctttgatatggtctctctctccaatgatggtaatactcaatgaagacctactagactagctcaccctttatttgttaaggttgggcaagggaaggaatgtatatatccattggtaggatgtgtgctgacataggaaattgaagattttgaggggttttctagtctttacacacttagcttagataaatggcattaccaaaaaccggggtagccaaacaaccaagatttgccaaccaacatattttttaaacaactacacaaagttttctataacccgtaatctacacaatcgcaatatgtcccaaaggggtatggatagataagcaatcagagtcatagcccagaactagcacttccaacatagttggaatatttagtagcatgcttcaaattttaaaggatatgagatgggtgaaaactatcatcatgatagttgtttacaacctcttttgtcattttgatacatggttatcatagacctctaactctaatccatatcaagttgtaagggataattgttccgcctatggatattacatttagtatatgtgttgtatatggccatatgttcttttagtgaaccatattaactttttattctcatttggtagtcattgctggagccatgaattgttgttcgtaacaatctagcctctagttagttcttttatggcaattcactagttgggaaagtttggaattgatcatgctcgttatgtgctacaaatacttagatctcaacgatgattcatggagaaatgatcacccaaagtccataaccatatgtaatatcgatatagcattgtaggttgaaagaaccttgatgtcacctaagagtggtgaataggcgtttaaagcttttacgtaaatgaggaagctagactttttggatattccaaactattttcggatatttccatattatttttggatattctgaaaatctcagatttacgagcaagctagtaaagcaagcaaaaaagtgtagtggtacaagtaaggaaatgattgcacaaacaacaagtaaactactagcagcatcatcaattagctaagatagatgagtgcgcgagatatatcaccaggattcttgtaagacgatatgctcccgaagttcaaatacttgaggggattctactctccgttgaggagctcataatgagccaggtcttttccaaccctatccttgtgaggttgcacaaatgtactcctccttccactaaaggtatctcttcccattcggaggtgagatcgtaccttcacaaactccctcggcacaccacaaacaaattggtgtctcgaggttgactcctagtcgtctaggtgtcctcaactaccaagagtaacaaatgcaacaaagatttcttggagatgaattgagtgctcaaaagatcttcacgaagtcaacaccaagcactaaaataaactcaaatcaaccactctcacaaacacatgaaatccaagcttatagatcggtggagaggaagaagtgagaaagcaagactcaaagtgaatctcaaatcaacacaagataagcaatggagccaactagcttgaggttggagggtagggacggcaattttacccacgggtctgggtatccacgggtatctgtggatacatggcccgatgggcacgggcatgggtgtaatattttgcccgtggccacgcccactcgagacctgagaacgtagcagacagttgtcgagtattattttttacccgtaggtaactcatgcccgacccggtacctatgtattagctaatttttgcctacctagccatctcttaattctcacaccctttctcttggctcatttggctcgttaactagggacacatatatactcaactaataaaccctaacctaattccccattcccctctcctacccccatacccacagcggaggccggcagtggcactgatgcgggaaggcggaattggcatagtcatcatcctcgtcctcgtcacatgcagccgctgtggtgctctgcgatgccatgaccagcgacggaggtggaggaggagcggtggagggacgggaacaagctaccattgaggaggagcccgtgttgctgccgcccgtatacgaggctccccgcgtggaggcagtgcatggatgcggtgctcgccggagggatctggaccgcgacgcggagatggcgaggcgaggaggaagtgggatggaggttggaggagagtacgctcgtgagtcgcagcggtgggcatgaggcaacggctcacgggcacagtgggtactcgttgggcatgcctgtggttgacaggcatgggcacggtcacggggttttgcccgatagactttacgggtgtgggtcgtgcatgggcacatgggtctcgggctgggtatggatttgctctgcccgtgcctgacctgactcgttgccatccctagggatggggcctatttttggccacaccctcatatctgcccgaaaatcaccagagagcaaaattaactttcagaaatttctaccgtgattttcagaagttgctatagtgttttcgcaagtttccaaaaagtgtaaaaaattcagcatgagcatagtagaaaactgggcaaattagcatgttggaaattctgaaaatattttcgaaaagaaatccaaaaatcaccagataaataaactttcggaaatttctactgtgattttctaaaaattccgaaatcaccagagagcaaatttgttggtcatatcaattttggaaattcagaaaggaacttttggaaatttccaaaaattcagcgaggacgagggcgaggctgaggccgcaagggcgtgaccagcggtgaggcagtgaccacgccgaggcaagtgccgctgccgagctagcagctgccggctggggcctgcctggatcatctattcatctctgcatcatcaagtaatttgacgaactagactgtcatctcatctctgttattagtctgtaaaagtattttgattcttgaatgattgattggttggattgattattgaatcaaatacatatgtgatatgtcttttcttttgtttataaaaggaagtttttgtttcctcaattgcttcaattcctcatcatgtcttccagcaatagaaaatatgattcactgactagatgaagcagaatctcaaaagggtgcttttgatagctttgttgtaagagaaactcaggatgctactgttgctgacggtcatggtggtgatgtagaagaggtcgaggttaatgttgcccaaggtgatgcagtagaggcaaatattgatgaaggtgatgtcgataatattgccgatgaaggtcatgctgctaacattgccgaagaaggtcatgaaactcatgatggtaatattgccgatgaaggtaatgatgctaatattgccgatgccatcaattgttcttttcatgatggatgctaatattaaagttatatagttgactaaaagtatgccatgtttatatgatattagatatatgaaatttccaaaatttacggccccaattatcattttatttaggggccccagatttctggagatggccctgagaatttctctctctaatctaatcagtcatgatattatatgcggtcatcatgcattcattctttatgcttatgggtcatatgactcacgtgcggctattagaaacccctcatgatttggacgaaccaagaagtctcaggatgttatttgtaaatattgtaaccttctttttatatatatttaatatagcgcagtaggagcctctcctgctgtttcccgtcaaaaaaaagtctcaggatgttctcttcgtacccaatgcagcagaggcgaagccaggggatctggaggaacccaggcctccccaggccaataacaaccctcccccacccccaccccctcttctctttttcacataataatcatctttttatcacctagtggccatgttcagctgctggttcgcggctgtggcgcagccggcaccaacagtgccgcacgcacgcggcgcagttgccgtagcaggcttgctaaacaggcccagaatgtcaagtgtaaaatttgatatggctatggtatactgttcaaccatgaactaaaccttccatgctgtaatgtacctctacataatttctaaatgagtaaaatacacggccaatccttaaagttggagcgaggtgtcacttaggtccatgatcttgaaaaatcaaaattaggatctgtgatcttgtttaagtgactcattgaggtccaaaggtcatctgaccgggttgactggcttacatggcggaccagagtggtaacatatttgcatttcggtccctcctccccgcatccaatccaacgggagcaccggcgggcctgggaggccggcggcagacgagcacggtaccgtcggcgggcagtgggtggagcggcggtgggcaagcatggcggtgggctgcggggggagcggacggcgggagagcgcagtagcgggcctgggacgccggcggcgggtgagcgcagcatcggtaggcgggcgacggatggaacaatggtgggcgagggcggcgatgggcgaacacgacagcagttggcgggcaacggagggagtcagagaagagcttgcgaagcaccgtcgccatgaccattgtgggcgagcgagcatcaggcagcgggtggtggtggtagtcttgtaggcatcctactcctgctacaactccatccaccgtctctccaatttgccgccgccgccacggacagcgtctttgcagctagtgtgccggtggcgccgcgcctcaccgatggccagatttgccggtctcccttcctgcgggtcgtcggcggcagattcgcggggcgatgcctcgccgccggagtgatggatgccgagctccgcctagtcgctggcgctagatccagccgcagctgggacgacatccaccggtgtgcgcgccgccgcctggcacggtgacgtccacggccttagtgtggccgttgatggcttgctgccttgccggagtgcgccgagtcgacggccgatgtcccaccggagaaggtagagctcctcaagatggcgttcgatggcctcgctgcgccattcgccgtcttcctcgccgacggcctcgctgcgccgtttgccgctgcctaccagcttaacgcctcagcggtgccacctcatcgtctactgcagctgccccgatgtcgagggcacccagctctgcagcctccttaacgagctctaccacaagcccgtcgtgcccgctggcatcttgctgccgcccgacactggcgacgaccgcgaccgctcggacatgatgcggtggctcgacaagcagctagcgaggtcggtcgtctacgtcgcgctcgggacagaggcgccgattacatcgggtaccgtccgcgagctcgattcctctaggcgctacgcaacgccagcgagtggctgccggaggggtacgaggcgcggcgtggtggagatgaggtgagtcccgcaggtgcgcgtgctggaccgccacgtaagcctgtcaacccggtcacgcgttcctgtgtgcaccacacgaagaagtgattggatcggacacgggaaagcaaagagggggaggggtgcaaaatacaaatatgtttccacgctggaccgccacgtaagacagtcaacccggtcagaggtcctttggacctcaacgagtcacttaaacaagatcatggagcataatgtcgatttttcaaaattgtggacctaagtgacacttcgctccaactttaaggaccggccttgtattttactctttctaaattattagtcaatacttgcaagatggatatattgttgctcatttgcctggatgttgctcatttgccttgatctagttttttttatctgattgtttatctatttatctagacatttaactcagataatattatcatcacttgtgatatgtctccctagaacccgtattgctgaaagtgaacagtaaatctaaaaaaataggtccttgagaaggtacctatttttttatagtaaaattttgctacctcgagttacctagtacttacttgtagataataagttttacactagaaaatgtgatacctcctactaccttctgaaggatgataaattatcattcttatgataatgtttttttatgttgatatacgatatattacctttgggaagccttaaaatttgatattttttactatattttctaattgttatgatcacttgtcaagttgctcccctcatgcttagatgctggcttccccagtgaatgcaccactgatgatagaggcatggaggttgatggcttgactggcctttcatgatatggagatcaattaaactggataccattatatcattaaagaatacaaaatggagaggaaaagtacaagggaaactaaagccgttttactaaggacaaaggtcactagatactaggtcgtggaatagggtcaagggaagcatggaccttacctgtgaaaatcatatctgtaacacattgtgtttgtatttcttttggggaaaatgaggatgataacatgaagtggaagaggtagcagaggacaaaaatgtggatgattattgtaatctgatgagcgccttggaaacttatacctgacatttttgaagtaaattttaggaaagcttgactggtacggttgaagttgcacaaatcacacgtgttatgttacaccagatattgtggtagaggcttacagcctagagtatcacgaaatcatacattaaccaatctaacgtgctaatactacataataaaaataaatacttaacttaggagtactccctccgtcccaaaataaggcaacctgtgaccactcctaatacaacgaatctagacaacccttcgtccagattcattgtagattagatgaccaaagaagatgcgaccataagttctcaactcatcttcttcattttccacatgcacgctttttaaattactaaacggtatatgttttgcaaaaggtttatatagaaaagttactttaaaaaatcatattaatctaatttttattttttatagttaatacttaattaatcatgtgttaatctattggtccattttgcatgcggaggggaggggttcccgacggaaccagatcgtctgacatagagcgatctacgccagagggacatacaacgcacgcccgccgttcatttgctatctaaaggtgccaagcgagcagagagtacagagtgaagcgagacagcctcactttcggcccactccaataaaatcagcctgctaaaccggaggaatcggcgacgccgctaatgcttctgcatctcacagccgcagccccaccgcctgttagttgattagttgagtctgtttctatctccatgcatgtgataatgatcagtttagttgtgataagataggattagatattatctcttcctttatatttgttatcacatgctggtttctctcccgagttggcgcggttgttgccgatctcgtggacttctttaatcgccacggtgagggctattctcaccatatattaacgcgtaagcaacgcactgatcgaaacatgcgattgtttcctgccaaaatcctcacatggtatcagagcctgatccaatctaatctagcgatgttactcgatggcgtcctcctcctacaccaccagtagcgccaatcctctccagggaagcttggtgagtgagaagcttggaaaaaccaaccatgcactttggaaggtgcaggtctatgctgcaattcacggcgcgcgtctacaggggaacctgactggcgcaggaaagaagctagacgccgagatcgccgtcacagttgatggcaagacggagaagaaggcgaatccggcatttgaagattgggaagccgtggatcaacaagtcctaggcttcctcctcacatctctttcaagagatgtgctcatgcaagtcgcaaggtgcacaacggcggctgaagcatggacaacaattgattagatgtactccacccacaccagagcgcgagcgatcaacacgtactatgcgctcaccaacaccaagaagggaaatatgatggcgcttggtgacgagatggcggcaagcaccgggcgacctgttgaagaagaagagatgatcatgcacatcattgccggccttggcgagggctacagcgaggtcatctcagcaatgagtgcgcgccccgaaccaatgaccatgggagaattatactctcagattgttaacttcgagggtcgcatggcactctaccgaggaacccaggagaacgtcgtcaactttgcaagccgtggaggtggcggcaatggaggaggttgcggtggcggcaacttcagccgcggcagcagcggaggtgctcccctaggcggttgcgggcgcggcaacaatgccggaggtcgcgggcgtggacgagcaccaggagctgcagatcgccgaccaacatgccaagtctgcttcaagcgaggccacactgccacagattgctggtataggtatgatgaagactatgttcctgataacaaacatgttgcagcagctgcggcggcgagctcctcccatggcatcgacaccaactggtacatcgacaccggcgctacagatcacatcaccggtgagttggaaaaactcacggtgaaagacaagtacaatgggaatgagcagattcacaccgccagcggagcaggtatggatataagccatgttggcaatactgttgttcatacccctaatagtcacaacattcatcttaaaaatgtgctatatgttcctcaagctcagaaaaatcttatatctattcatcgtctagttgaggataactctgcatttcttgaactacatcgtgattattttttgtcttaaggatctagccaccaagaaaacgctccttaaaggaagatcacattgcaggctctatccccttcccaagccatccttgaagtatgcttgcaatgccaccaagatctccttccatcgatggcacagtcgtctaggtcatccctcctcgtcagtggttagacaggtggtcaataaaaataatctcccatgtttagatgtgtcaaatgagtcagtttgtaatgcttgtcagcaagcaaagagtcatcagttaccatttcctgtttcatctagtgtctcccaacaccccctagagcttgtcttctctaatgtatggggtcctgctccagagtctctagggagaaagaagtactatgttagtttcattgatgattttagtaaatttacttggatctatatgctacagcataagtctcaagtctttgaaaagtttcaggagtttcaggttatggtagaacggctgtttgacaagaaaattctagccatgcaaactgactggggacgggagtaccaaaccctaaattctttttttttcgaaaattggcatagttcatcatgtgtcatgtcctcacacacaccaacaaaatgggtctgctgaaagaaaacatagacacatagttgaggtaggtctctccttactatctcatgcctctatgccattgaaattttgggatgaagcctttcaggcagccacctatctaattaatcgagtccctagcagagttaatactacccccttggaaaaattatttcatcaaaaaccagattattcggccctacggatttttggttgtgcatgttggcaaaaccttcgtccctataataaacacaagttgcaattccgctctactagatgcgcctttctcggttttagcaacatgcacaaaggtttcaagtgtcttgatatatcctcaggccgtgtatatatttcccgtgacgttgtctttgacgaaacggtgtttcccttctccgaactcgatgctaatgcaggagctcgttttcagtctgaattatctctcttggcacctaatattattagtggggatgaacaggaattccattcatgggctaatccacttgctaatctgcctaatatgtctcacaatttgcctcaagatgctgcaacagatcaaacggccacagaagatccaactggcgctgactcccatgatgatccctgcgcccgccctgacagatctgtgcatcgctcccctgcgcgcacgcctgacgcgtctcctgtccgccagtccagtactgccatgtcgccacaccagcattcgcctgctgctgatcgcattgttttgcaggggtcaccgtcgcatcgggagacaagggggcagcagtcaggcacagcgacgggtgatgggacgtcgggcagtcctgcaacagatattgaaacacctgacaccaatgacattgatactgacgatcttgatgtcacaggtattaatcccgatgccgacactatactgcctcattttcaacagttggagattcaggaaccacaacaggtccatcccagaacaaggctacaaagcggcatttgcaaggaaaaggtatataccgatggcacaattaaatattcctgctttactagttcaggtgaacctagtgatcatctagaggctctaaaggataaaaactggagattagccatggatgcagaatatgaagcattagttaagaataacacttggcacctagttccacctcagagaggaacaatgtcatcggggtgcaaatgggtgtataaaattaaaagaaaggctgacggttcactagatagatacaaagctcgtctagtagctaagggattcaaacaaaggtatggtatacattatgaggatacctttagtccggtagtaaaatgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaatgtactctccggaattttccgtgaattttcggagctcgagaaatagttttaatagcacaaagatcattgcatcaattaaaataaaaagaaaacaaataaaattttcccctctttgtcttgggccgctttcggcccaagatcttctccctctccatcctctcgggcccagccgccctccttttcccctcctcccttctctttgggccgtcggcccggcttgccccctcctcgcgcaagtccgcttcgcctccctcatcctcctcctcttcccgagccgccgacaggtgggccccacctgtcggggtcacccccaacctccagctcgggccagcaaccgccatggccgcccgagccgtccaacgtcgccgccgtttccgcccacctcctccaccccccgcgcgcgcgcttgtccgtgggacctcgccgcccacgtccgcgccgtttccccccactctccccgcaaaatccggccacgtcgccgcctcccgcgtctctctctcccccacgacgccgccccacttcccctcgaaatccgccgctccccggccctctcctcgcccccttgagctataaaatcaatccccgtggactcctcttcctttttccccgttttcccgagtaccccacgccctctaccgagctctccacgccgatccccttcgccgccgctcgccggcgatctccagccgcccgccaccgccgctcccgtcgctgccgcgctgcgccgccgccacctatagcatcacagtgcctcgccgcaccccggcatccactccatctccctcctccaccgccggaaccaccttcccatcgcgaggccgagccactaccgccacacaccgccttcagccggccgctgccgccgcgttagccgtcgccgcacctcgccgcttgcaccaccggcttcgccgtgccttgccgcacctcggcccccgctccgttttcccatttcatcgccggaaccacctccccaccgcgctccctctctccaccactcaccgacgagctccagccgccgccaagccgcgccctgccaccgtcggcttcgctgcatcgcgtggtaccccggccgctcttccaccttcgttggagaccgccgaatcaccgccgtcgtcttcgccccgtgggatgctgccgcctccctctgctcgagccccatcagccgcctccttcgccgccatgcccctcggtgagctccgccgcctccctcttcgcctcctccgctcgttttcgccgctccccggtcgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgtcgccgcctgtgtcgccgccggtggtcatccggccgcgcgccgccgtctggtcgggttggtcggcgagccaaccctcccctccgccttgcacctctaccgtggactcggtccacggtgggctagatccttttgcccgctgacgcgtggggcccgctcttttggtggacccggtccaagcccgcacctccttgacccgctgacgtgttgggcccgcctgtcggcgccggcgccccttgctgacgtcagcgaataacatttcctttgagaaaatatttaataattgcgcaataaatcgagtttaattatagaaatccatttaaatggctcaaaacttctaaaattcatatctaattcattcgaactccgaattgagccattcaaattgcaaaattcatctaaaattaagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgtgccatgtttacttgatatctatcctttgtcaaacttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttacatggtcataattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttatgctttatttacgtttggagctgtttattacttgtcgttttgtgtaccctggctggtcctggacagggatttaatacacaaaatagtctggaaatttgggctaaatttctgggcgtgacataaaagcagccacaattaggataatatgccgtgtctagaggatggagtcttagacaactggatgttcagaatgcgtttcttcatgggtatttagaagaggaggtgtatatgcaacaacctccagggtttgaggatgtcaccaaaccacactatatatgcaaacttgataaatctttgtatggactaaaacaagccccaagagcctggtttgctagactgagtcagaaattgattgaacttgggttcagtgaaccaaaggcagacacttccttgttcttcctgaataaatgggagttcactatctttgttcttgtttatattgatgatataattgtagccagttcatcagagagggcaactgcagctttacttcaggatctaaagacatattttgccttgaaagatcctggagaactacactacttttcttggtattgaggtaagcaagatacataatggtattattttgacacaagataagtatgctactgatttactaaagaaagtaggcatgataaattgcaaaccagcagctactcctttgtcagtaagtgaaaaaatgtctgttcatgaagggtctcctttgggtccaaataatgctacacaatatagaagtatagttggtgctttgcaatatttaactcactagacctgatatagccttctctgttaacaaaacctgtcagttccttcatacccccacaacagtacattgggcagctgttaaaagaatcctgagatatataaaacaatgtactaagatgggcttgaatatacataagtcagggtctacattggtcagtggattttctgatgcagattgggctggcagtatagatgacagaaggtcaacaggtgggtttgctatatttattggctcaaatctagctagtgtcatggaatgctaggaaacaaaccacagtgtcaaggtctagtactgagtctgagtataaggcgatagctaatgcaatagcagaaattatgtgggtgcagactgcttgctgagttagggattaaaagtccccgtgcaggtaaaatttggtgtgacaatcttggtgcaaaatatttatctgttaatccagtgtttcatgcaagaacaaagcacatagaggttgactatcactttgtcagagaaagggtaagtcagaaattgttggaaattgattttgtttcttccggtgatcaagttgctaatggatttactaaaccattgtcaactaatcttctggagaagtttaaagccaatcttaacctaaccgagaagtttaaagccaatcttaacctagcaaggttatgattgagagagggtgttagttgagtctatttctatctccatgcatgcgataatgatcggtttagttgtaataagatatgattagattttatctcttcctttacatttgttatcgcatactggtttctctcccgagttggcgcggttgttgccgatctcgtggacttctgtaatcgccacagtgagggctattctcaccatatattagcgcgtaagcaacgcactgaaacgtacgattgtttcctgccaaaatcctcacaccgccatccgaggacgcggcggtggcttaatttcgtcggcggcggcacccacgtccggcgctgactacgtggcccgagcagtttcacgctatgtttactattctcattagtgaagcagtgagccggcgcctgccacacttagaagttagaacaccatccaactcaaataagctcgtcgcatgcatgctgctgcatgcatctctgggaaacagatcgaaagacacaagtcatggcagagctgtattaagttactgaaccagtgaagaaattttggactgcatcactgcatttgttcaataggaaattaaagcacattgttgggtcaggatagtaatcactgcagaaacttgactacttcaatttcccttgagaagaatatcagacttgacataatgatgcaatgatgcaagactcgtgggatttgagtcgagacgtgacagtcgaccatcggccaggcagtcatgtgctcgagtggcaggatgctgatgggtggcggggcaggaggtcgagttgaagtagtacgaggtgctattggtccactcgacgttgtagacctggttgccgatcgacttgccggaggcgactgacaaggttgaggttgcagccatgggccatgctggcatatcaagagcaccttgtgaaactgctcgggattcggcgtcagcgtcatataggagagccaccgctgcggccctcgaccggccggtgaaactgctgcggaaaaaagtacaccgaaggtccccgaacttgtcatcgagttaaaaaacatcctcaaatcgtaaaaccagatatccgacatccctcaactaattaaaatcggtcacaataggtccttttgtggttttgattatggttttatccgacgtggcggctgagtcaacgtgggccccacatgtcaggatgccacgtcatctctcccccctcttctctcccctcccctctctctctctctgacttttcccggctcgccgtcgctgggatctagctcctcccctcgcggcggacgcggacgtggactttcctggctcgccgtcgcttggatcccctccccccgcggctgacgcggacgcggacttccctggctcgccgtcgccgggatcccctcccctcgcggtggacgcggacgcggacttccccagatcgccgttgccgggatcccctcccctcgcggcggacgcggacgcggacacggactctggcacggtcgcaatctgctcacgcgtggcccgccgtcgtgccgcctcaccccatcctcgcgcggccggccggcgaggggagcgcggcggagaggatggcccgcgcgacgtcagttccccagccgccatcgcaggatccatggaggaggaggaggcggccgcttgcgagatcgcgcgccttccggaggagctcctcgtggcggtgctctccctcacctcgccgtggtctgccgtgacttccgcgccgccgccgactccgacgccgtcaggtcccgcttccttccccgcgacctcccgtgcctcgccgacggtgagctctccctgccgctgtccatgaaggagctcttcctccgcctcttcgctgcgccccttctcctcccacacgaactcacggtgagatcccttgcagtggcggcgccgtcgccgcttcctcctcctcgccgctgggctactagccccggccgcggcagcgtcgggccgcccgccatgactgaggagagaagtgagagagaggaggaagagaggggtgatgatgtggcatctgacatgtggggcccacactgattcaatcgtcacggtggataaaaccggattcaaaaccaccgagagacttaaaagtaaatggttttgtaagttaagggatgtcatatatctgtttttgcggtcgagggacgattttgtaacttgataacaagttgatggatcttgggtgtactttttccaactgctgctgcagcgttctcagctatttctcgcttacctgttagtggaccgattctattacagtggaccgaaagcgaggctaggttctctccgctctctcggcaccattcgatagaaaatgaacggcgcgcgcgcgttggacgtccctttgacgtagatcgatctggttccgttcccaacccctccaaaagatacttattactcctctggtttgagaatacaagacgttttaacttttatcaaagttaaactgttttaagtttaactaagtttatagataaatatagtaatatttataatactaaattagtttcatcaaatcaataattgaatacattttcataataaatttattttgggttgaaaaagttactattttttttacaaacttggtcaaacttaaagcagtttaactttgaccaaagtcaaaatgtcttgtaacctgaaacggatggaattgatgattagacctaaattattctcctgtcgttatgtgcttgataagaaacttggatccatatcaattctagcgaatataatgctgctattgtttctgttgcactggcaactggcaagaatgatcaattttgtgctgaaatgcgcttggtttgtcacgattttgttgccctcattttgatcttggacattgcttttcatgtttgcggttggaataggaatttgtacaaattcataaatgtgtgcttatgcacaattttggttctaaaacaaagatgaagaatatctggaggtgctctttttctcctgaacataaagataaaaatgaagattaagtgtttgacgcaaaacgaggtggtattaacgtatgattaattcagttttaatcattacaaacttaaaaaatagattaatctgatatttcagagcaacatttatatagaaagttttcgtacaaaacgcaccgtttagcaatttaaaaagcgtgccacaaatatccaaaattttattaacctttttagtggaaacgaacggattaatgctagtgaacatgagcacgtcccttgcacttctctaaaggaaagacctatggtgaaaaaaaaaactgaaggcgcacacggaagcttaattagaaattttgtgatgtctagaaatttatccctcgcctcagcagaattgtagcaaacctatttttggtgattctgaaaagacattcatactagactatgtaacacaaatttttatggttcagtatcaaccaatcattaaaaagaaggaattaaacttttcaaaccaaatcttgaatcttcattctaagggcctctttagatcccctagcaaaagttttcaacctgccacatcgaatgtttggacacatgcatggagtattaaatataaacgaaaaaataactaattacacagattgcgtgtaaattgcgagatgaatcttttaagcctaattgctccatgatttgacaatgtggtgctacagtaaacatttgctaatgacagattaattaggcttaataaattcgtctcgcggtttacaggcgtaatctataatttgttttgttattagtctacgtttaatacttcaaatgtgtccgtatatccgatgtgacacgccaaaacttttcattcacccctatatctatacacagcctaagcttctactccctccatccaaaaaaaagacaaaccctagtttccgtgccaaacgtttgactgtccgtcttatttgaaaaaattataaaaaaaattaaaaagacaagtcacgcataaaatattaatcatgttttatcatctaacagcaatgaaaatacgaattataaaaaaaatcatataagacggacagtcaaagttggacacagaaacccatggtttgccttttttttggaacagagggagtagtcctctattcaaatataagcaataaaaaaatcaggccttaaaatccaattgcaacgtcagatcaatcgtttctcgaatgaaaatcgtgttcccaaattcacactccaaatttgccattcaaatccctccacctctacaaaaatttctactgttcattcgaaaacacaaacaattgtttattggatcatcccaactccatacatatatactatatgatgcccgcggatcatatatcctaactccatacatatatactagatgatcctcgtgcttttctgcgggatatatgttagatattggagaaatgatgaaatgatttagtttgaaatattatgaaaatgatttgtcaataatgaattagcatgtgtatgtttagttttataataaaatagattgtagatataattactatatgcttgcatattgagttttgtgtgcttaatgggttaatgtagcatgcttgcatgtaggttttaggagtacgaataaatacaatgcttgcatgttatgttttaggtgcttaattagtagcttaataaaaagaagggatatgaaaaatcgacaatctttccttcattttattggtctgaatggcccaaaattaagtgcagccaaagcaatcccagcgaacacggccacaccaagggaccccaagatcatctccatggagctcaccgtggacacctcctccctcttgacatgcgccgacgcggcggccatcaccttcctcaccatctcctctgcggtcgccgcgtcggccgccgcgagccgccggaacccctcgctgttcttgacggcctcgatgccgcgcgcgccggtggcggcgacgtcccggacgacggccgccttgagcagccggaggccgagcctgtcggccagcgcgtacgtgtcggccgccgtggccggcgtgacgcaccgggccagcctgtcctggcacgcctggctcagcgcgtccatcctgtacaggtccgccgcggcgagcaggtgctgcgccatgtgcacgccggtggcgtccctctcgctgttcccgggcagctccggcagggtatcgtcgtaggcgaagcgcagcatggcggcgaacgcgtcgggctccatgtcatcgatggtgatggtggtggtggcatcgtcggtgtcctgtgtctcccccatggcgcgcgccgccggcccgtggagctccgccagcaacacgggcgaacgcgcggcgagcacgcagcggtgcgcgcggaaccgctccccgcggacgacgaacgtgacgtcggcgcccgtgccgtcctccagcatgcggcggaggccgcgccgcagctcgtcgtcgagcggccgcgggccccgccgcagcacctcgtcggcgtcggcggcgaggagcacggcgcactcgaccacgaggcggtcgccgcggagcaacacccccgacgcggcgaggtcgtgctgcaggatgaactccgggaagccgaagcagccgcggcctacggtggctggacccgggccgaacacatggtacccgcagcgcgtgtacgagccgtcgtcctcgccgccgccggtcatcccgccgcggcggtagacgagggtgaagtcgacgagcacgcggacctgctccctgtggtcgctggagacgaggcggaggaagacggcggcgtaggggctgccactgtagtagccgccggggaagaagaggatgtcccagaggtggccgccgaggctgaagagaccggagatgacgggcttgccggagctgaggccggagaaggaggagtacggcgtgatggtgaggcgctgcgtcgacgccgtctcccgggtgggcgcccgatcgccggacgacggcgaaggtgcggccatgtcgagttagattggaattcgattttgcttaggtttgtcgtaataattagtaggaaaattttttgaagaggaagccgtgcttcattgatctttttgatcatggcgaattattacagtgtcctctagatatactccaagattatatcaggaaacataatatcactgtattttttttcattactactccaaattatacccgtacgttgcaacgggtaaactaaaatacccgtgcgttacaacgggtaaactaaaattataccaaatataaaaatattagatgattgagtcccactccggtgctttctactcggagtagaaagtaatttgggccattggtcgtatttaattgtagggctgagatctagttctactcccaccagtattagtattagtggaagtagaaatatggaagggtgttttcgtcaagggaaaaaaatcgcgtaggggtattatcgtatttttcagtctcttacccaccctatccctatccgattcctctcgcatcgtcgccatttcaccacttcccgtcgccattcccccccatccccgcttccgccgccgtccatctccctcgccgcctccgtcgcctgtcctggcgtctcctccccctccagcgccgtcgccttctctgctccctcgccgcactcgcccttcctcgccgccttctccaccgccagcgcccctctgtcgacgtccgcctcccccgatattggcggcttccctccgtcgaagcccttccttgtcgccctcgccgccttcgcctccgcccgcgtctccgcgccggcttgtgagcccccaccgtcgctgtcctcctcccccgccctcttgtctagcgagtcgcgtgacgtagccgcccctccacccgcctccgccggcgcgcgatgagtcctcttcgccgcgtcgcctccccgcgccaccaccgccacgttctcctccccatggaccgacgcacccttctccactccacctctgtcgccatcgacctagccgcccccttctctgaagtgtgaacatgcccttggcaaccgatttaacccagtgtaagcgatactctattagttaataggagtactactaactgtgtcatattaatcacaattcaccaattctattgtcttgaattgcagttttttttggttaatttacaattttccatctttagtgttcagatactatgcgaggaatcgagaggagacagccgagcttcaggtacattctgaatcctccaatcttaccatacttttcttaccaatattcagttatacggtatcagaaagacaacgaagagaagttggtaaagagtatcatcttctaatgcgagattactcatttactctgttgcttcagccttcattatagtgctcacctaagcagcatcttaatataccaaccactactgttatgattttgcagataaaggttgtttgttcttgaatccattgtattgtatattgattatttgattgaatggttgggagcagggtcagtttgcaagacggtggcatgcgcgaaggggatccgtatgccggcgaaggggttatcggtgttcaggtgcgacattgtagcatacgcacgtcggtgacgtcgatagctgactgcgctgagtcatcccgaagcgtaaggtttcatataccgctccttctcaaatggattgaaatatgaattatgaatattatctcaaaaaggcatcaatgtttgggatccatcaaatacccaagtagtatctaaattatttaataagggtaagagagcatagtaaggtaattgtggtaaatgtttgacagataatccatttatgtcgtggttggtagcagtggacgatctttaatgttgttcagttcggagttgatcaaaattccggctaagtcctgtcgaaatgttttcacttccttctgcataatgcaaagggagtgcattttaaatggttttttgtattgggaagcactggtgcaaaatatgaatagaggttgttgtagttgcctgtagttgaatttctgggagataagatccgctccaatgctccatgaacttaagggtgtacaggccacacgagaagctacaagaatttagtcgttaggctaacatgtttgcgtaattgaataatgtgaatatcatgtggaagagtttgagtcacccacccgtctccttgctttggcaagttttggactttgttgtactcccattcggtaatattgaaatcaggccaatcgtgttttaactgtgggtgctgattctctgtcccgtgtaatcccctctcaatagctagcagctggaaagttttgtgcaacgttggtacggttaaaacatagcaaaaccaatttgaattatacaagtggaagtgtattgcttaccacacgccttagatcaggtcgatctttactgattggctttgcgagcgaatctagtatttgcacctcacatcgcttggcgttaagaacggctaggtaccagtgtgtatctttaatattaattgggaggaaaatctgcatatgttcattgttcaacactaagatagagtcataaattgaattagccattacatagatagagtcataaattgaattagccattacatagatagcttgaataagtattaccatgtcaaatgctagatagtcgcgtgccatatctctaatccatcgtttatctcgaggtttgcttgcttcgacatgcgctccctctacatttagtagacctgttttcatggccatctctaggaaggccttgccatctcccctgattcctttctctttatagcggaggcataggatgtatgcatccatgacctgaatttgaggttagttcagttatataacaaatatagttataaaagaatagtaggcttgttaaataggcgaacttacatcatcattcaagaattctggttgtgttagtactttcattcttatccgtttaacctccacttcttcaatatgcaccatcactttgttatcctccgtgttattaatgtaggtaatgaacgggtcttcttttttagtcaactctacgaaggttggacaaattagtaatagatctatagaaatgttaaatggttagtcattaccttctgaattttttaacattgtttggccattcgtttttttttcttcttttgacctcgtaaggcgttctttggtggtccgttgtctatgtttttttgcgtaagatattccttctctatgtacactagaaaagggtaagtcaaatcagtaacacacaaacatagaatataagtaaaaaattatggatgatgtagagagttcatacattcggatatttcattcagtgtttggttgtcttgtttcctcttcttttcaccccgtaattcgcctgtgtctggcatgtaagcttctttattcgtttgcgcttgaaaaggagtaaagttagtaccattgacatgagcatatgcaactatgaaatagcatagtacctattgttttctttgtctgtgcttgggttttgattatgtccttctttttacctcttgtttcgtagatgaagtcagtccgattagttggtttgtatgttcttcctgtaggacctgtaagcatcttcctgctttgattgctctagttactattgtcctgttaggtaataaagtgcacgttagtattatgataagttgtagtaacgttagtgagagaaataaaattcagtttaccttcgtttcacaagtcatgtttacattttgatttatataggactcttcgttatgatttgatacatgctccctgggatcaatttgttcttgttcaacatcctgcaatagcgtcaaccttttttttagcggtgttacgtaagtaataatgattaacagtctagcatatgatctttacctcaaacacatgcgtactatcttttcgctctgggcattttgaatcattttccatgcaatctagtatcaatgatcgcatacgtggccaaaaatcctttgtgaaatcgttgaaattatcttgtaaagtttggatgctttcttgtaacctttcttgtaaagtgatgtcggctgattgttcagtggatgttatagagtgtacctgaatagcacaagtgagaaaaggatgtcaaacatattttgttaaatagagttcgtattaaaaccccataatatatacctcttcagaagtgccttgaaaatcttcattgctacgtgtttctgagtcattgtcctgcgctttttcatcggggatttcattgcaatgtatagttcccgtaatgtcgtcgacaacctatttttagtgaaaaaggtgtattagagattttacagacagttgatatagttagtacatagtattaaaaatgagatagttaccttcccttgtccaaaaaggtaagaaattcttttttttttttgtcccagtactgaattagtggcctttgacgaccagaatgatatattgtcgcagccaatttatctattcgcactttttcccaataccaaatctgcaaagcatttgtacataagataattagtattgctatgaaaatatgttcatgacaattttgtaaagaaactcaattttgaaacgaacctgtaagaggcatacgttcccctcaatgtttgttgtcttctctctaaattttaatatgcctttcagtaactgatttagtgttagactagaccagtttagttccctcatgttgtcaacgtcgtcgacgagattgagatattctgagcgcacatatctttgagttgtaggacatatgaaggatccaattgagaaaagaataaatctttgaatgaagtggtcatcgtagctcaaggagttgattattgcttcccgtaatgcttgtaaagtaattgttgtttggccttccttttttacaggttgaacaattctggtttattgatttttggtgcctcaaatatgtcatctctttttgatggcagtccaagcaaacaatcaacatcatcgagtgtcatcgttacgaaagtaccattaatattgaatgctttcttctccttgtcatagcttcttgcaatctcattgcacaagtttcggtcaatatgtatgttgtcaatctttagcaagttgccaagacctgaaccctcgatagcttccttttgacgtagacttagatggagtattacctcgtacatggcatgtggagagcaaactagagttccctaattaacagaaaagataataagagtttagtccatgtgaaaatttatgcaagtgctcatatatatgattgcacattaccaaacctagagatcaattaatcctgctagaaatcaattagaaatcaaaggaaataattaatcctgctctggcatgttactcgtctgacatgttgaagtgatgtcctccatcactgttctggcagtctatatggccctctctataatttgttcaatgttcattcttatgtgcaggattcagtgaggttgaggagtttgaggggagcaacatgagtgaggtcttcgagggcaacatagtactgtcaggtttgtgccaccttcacccatgaccacatccctcactttggtttgaaagtttgaaagtgtgaaattctgaacatatagtggctaatatagatcggtcgtcgaggcgtggtaattatattgaaatttccaatcaattctaacatatattcagtataattcataagatctcaattgggttgaagattcaacaaatataattaagattgtctggatggaatatcatgcatgattgtgtttctaaggtagatggtcacagtgtgtctgtgtgtggcgtagccctgctattttacttctttaatcatgaggccaacatttccggattcaacataaatatgcactgcatgtttcctatttcattgctcatgaggccagcaccatatttcagacagtaaaaaagataggctcagaaagcagtataaccgtttctaagagtttgaattgttgtagtattaacaaaattaacaaacagtaggtgctaatgaagtgctgtagtgccattgagtttacatcatctccgcacattgttggctgaaatttaaacttgtaatcttggaagaacaggcatgcaacccattataaccagtatctgaaagttggtttcttatattacagagtaaatcattttctttgttgtaggagattacatatcatggaacctgtgctttcagacatctgtgtataccctgacagtgaccaggattagatcttcatttttagacagtctaaaactaaactaggtcaccaacggaaacacatatgaaaacattgagcctctctgaatatgctacatctaagttttacctctttagatttgtggagaacaccatgagtttggataaaaatataagaaatcctgatttccttaattggttgtagataaattattttatacttaagtcagcgatgacccctatttgttaatgccagatcttcgacacgaatcttacactttgtttttgttatgcaatctatataaattctcatcataatatggctatgataattacttgtatgataattgcttcgttatgattctcagaaatcctaactaattctcactaatcaataatatatatcccaatacatcagcacacatgaatctttgctactgcagggcgtcgccagtgccattgtcagcttcccgccacaaacgcctctggatctcaaatccaccacgtcgaagcaggggttggtcaggccggcagaccatctacggctgcgcctaacactccccgcaggtacattgcttcatcccattgctcccataggcttttagttttttttttttttggcaaaaagtcgagacaaaaagttatatgccctaatggcatgtggatgtcatgtaattactaaatttttagcatgctgaatatataacatggatatgttgctttggattaatatcactgtcttctcaaaaattaggtgccattctgttcgttttttgtatggagtatgacaagtatataaaatagttgtatggagtaggacaggtatataaattaggtgccattctctttttttttatggagttgtacaagtatattttttgggatatcttgccgtgctgtgtactctgtgtggctgctacatcctctatacaattgctccagagactagccagagcttaaaagaggcacacagtaaaatcaggggagagactatattcgttaataatctaatcatatgtgctgtaattatcgttgcgccttagacctattgcaactttggcttgaggagtctaagatttcgacaactgatgtatacaagagctgaaagtgaatgttgtatgtaaaaagacgtacccgttttttcttatgttggcttgtgcccgtcgtcgctgcatgaaattgttttcgtttgctccccgtcggcggctcgtaatttggcctcatcttgttatttatttcgtaatttttgtccagaacatgtgaacaaaccgagaactgtctcctatatatatatatatatatatatatatatatatatatatatatatatatatatatatatatatatatatatatatatatgtatgtatgtatatatgtatgtatgtatatgttacatgtggattaagctcggtatgtaataataggagatcaattaggtctaaaaaataacatataattcggcaggaataaataacagataattcgaaacaaatcaattcggttagagaacggaaattatgttagacttctgctacctacatcgctagtatttgtttaaaaaacctcgtgtatttaaaacgcaggaagttcgataagttccgacaagattttatttgtccaaaacaatcggatccgatatattccatgcgatctggatggtcggcgatatgattttttattcgtccaaaataatccgtttcgctataatatacgagcgatcgaccgaaaatttatgaatttcaaaaacaggcccggtccagacggtcggcaacatgattttttattcgtccaaaataatccgttccgctgtaatatatgagcgatcgaccagaaatttatgattttcaaaaacaggcccggtccggacggtcggcgacatgattttttattcgtccaaaataatccataatccgttacgctgtaatatacaagcgatcaactgaaaatttatgattttcaaaaacaggcccgatccggacggtcggtgacatgatttcttattcgtccaaaataatccgttccgctgtaatataagagcgatcggccagaaatccattctttttaaaaaaccgacctggtcggcgacttaattttttatttgtccaaaataatctgttccgctataatatacgagcgatcggccggaaatttatgatttttaaaaaatgacctggtcggcaacttaattttgtatttgtccaaaataatccgttcccctgtaatatacgagcgatcgactggaaatttatgattttcaaaaaccggcccggtgggcaacatgatcgaccggaaattgttttcttacaaatcgactcggcccggaccaactcgagtacgtacgtgaaaaccatgttttcggatatcggtactgttagttttaaaaacctcgtgtgttaaaaacggaataataggagagcgttaatataacgcacgaagttcgataatttccgacaagattgtaatcccgttgttgtaggaattcatatttatttgttttctaaaaaatcgaccggaataattgttttataaaaaatcgaccgtcccggacgtaataattattttgttcgaaataatccgttccgctgtattctatcgcacgcccaaccgaaaataattgttttctaaaagatctaccatccattggactagcctgtaacctagtaacttaacttgttgtcatcagaagttcagaatattagaaaggattaaactaatccaaaagcatgcacaggggaaacacttaatatgcacatcttgagaaaagattaaactaatccaaaacaaaaacaatgccaataatacaaaagatacaaagtttgtgagccacaattacctaattggttatttgtgtgcaatgtctcacggaatggccttcgtctcttagatggagctcattttgccctaatctcttcaggatcaagtactctcttctctaatggctggttactagatgaaaagtgagttggcataggaccaaaatctccagccacgatgttctcatcggatgacgatcctttatccaaaatcccctttaagaaatccatcgccttttctgtctgctagagttcctagcggcctcgaagaaagcatcactacccagatttcggaggctacggtaacgaaccatgtgttcagaccacacattaggatcggcattcctgtctgacctaaatgtcgcctttgctcccattgtccacctatccacgacacaacaacgagagatggtgtcaaaaccaaggaacttgagtacaacaaaaatatgtgagcaagggatgtcttcgcactccatcttccgacaatgacattccacaccttccaaagcctggcctttaaaagtaaccctcacttcatcccacacctcattatcgtccttcaaaccaacagcatacaatgacgaaccatcttgattagtcccactgatgacttcaagtcctgcaattagccgtatctgtgcacggattgtcttgaacacgactgcagtgtatatacgggcaacgtctttctccaatgggtcggcgtctattctacaaaaagggaccgaattggtagacttagcgtccaactgagcctccttcttatgcaggcgttgtatgcacaacttaacatgtttgactaagcacattagtgacatgtttctctttagaagggtgtgaagctttgagttcagtgactcactacattggttgctgtgcatacccaacaagtatttccaatatgtataggcagctgcccacttctcccttagtcggtacatcagagcgatccattgtccatttcccgtgcctccattctccttaaaatcagcccaacgtctctcgaacttgtcctcatccatattctcataaattaattttcttagctcgtcgagttttggcttacgaaggtgacgactcatattctcctctatatgccaagtacacaatctatggtaagcacccggcattaccttactgatagccttcgccattgctaggtcgccatcggtaatcaatgattttggatgcacttgacgcattgcctccaaaaaagtctcaaggagccaacagtaagagttgacatactcatttgatagaattccgcacccaaaaattgttgtacttatgtggtagttaactcctatgaaaggaatgaaaggaagattgtacttgttcacatggtaagtgctatcgaaaataacaacaccaccaaaagcagcatagtctaaacgtgattcagaatctgcccaaaacacattcctaagacgcccgatatttcaacacatcttcagcatcatgacccttgatattcttcatctcgtaccgtgtaaagaaattataaaggtccttcatcacaaaaccaacctcatctaactcatcatggttattctccataacctccatgatttgaaagggcctaaggccactcatgcgaagctcgaccgcttgggctttcttaaaatcactcatcacatgatgaactcctaaaaaagcaacatggtcaggatttgcaagttcgtgcgtatgttggttatcaaactccttaacaaaccacacccccttctcctcgttccgctcaatctcaagcttagctaagcaaccgcagcgggtcagtgcccgtggctcccttttccgctctgtcctctcaaagtgctttaactccctgtacccttcacatgagcatacgaattgcctccatataatctcaccgtccttccgtttcaagttgtttttcctcacactgaaacccttcccctttgcatagtctaaatagaatttgtaacattcctccttgcttgaaaaaaccacagtacccatcattttatactcttcctgatcctctagaatcacatagctcgaagtctcagacctcacctacggaaaagtaaaaaaaacaaacagatcaagcacccaaatatataagcttacgtcctttatacctcataagtatataaaaaaaagaacaaccatcaactgcataaatacatgccattctaaactattgagcaattactacagttcccccacaatggctgcaaattttgtacgtactataaattgttatactaaaatacattttctgaaaatggttgttcagagataatttttctgttttcatttcagctgtacagtcaaattttgtgttgcacatcatccagtagtttcagtaatctgtttcttttttcagcacctctggagaatgtatgcatttgtgtatttcacaatgacttcggttacatgctcctctctgataattctaccattgttgaaacccttataaaaggaagattcgaaacggagccaggtcattgcagcttattaagacctatttgtagtcagatcgttgccacaattcctgaatctgttttgcaggtcatgtggattcctatggacataatcaagttagctgacaaactagcaaaagaagccaagtccaatgttaatgcagcccctgtctatttttgtcaaaatatatcgcatttgtcttatcctaccagaagatgtcatgctaaatcatatctaaatatcaatggtcagttcgccagggcagcaagccatacatgcacagcaaaatcaatttaatattgttcatatttccttcaaaaaaatatttctttcaaaagttattgttcatatttctttcaaaaaaatattgttcgtcagtttcatcgttcatacttacaactcaacatacaaaatcaatttaataaatctcctattcgatttacaagctagtttacacagacattaacaagcaagtatatgcattaatagaggagcaattcagacaagttcaccactgaggatatgaaggggaacagaaagccaggttgggggggggggggtggggatgggaggagtggatacctgatgatttcgccgtgcccagccgctggccgcgccgccgcctgcgtcggacagatgcgacgcgtggcgccaccggccgcgacgccgcctgcctggaggaatagccaccgggcgcgtagccgcctgccggtgcctgcctccgaccaaatgcgaaccgaagggggagggtgaagagggcggggagatgtacggcgacggagggggcgaagacggcggcaacagaggaagcgaagacgaaggtgacggatggagcgaagacggcggcgagggcgggggaggcggacggcgacggaggggggcggagaaggcgacgcgggcggaggagacagacggcgattgaggaggcggagaaggcggcgacggcgagcgatacggacagcaacggaggcgggcaaggcggcgaggccgggggaggaatggcgcgacggaatccacacctgcgatgcgaaccgatgcgaacagaagaaaacatcccataccaaatttacccctaaaggatattagaagattacttacctaccctttaaaataaagggtccagattaattctactcggagtagaatacttcaagtatattgtaccggagcattcccctagatgattagggtttagttttacatgatatgagcattttaagaaaatctattactaatgaaataaaaaaagaaaatccattactaatgaaataaaaaaagttcaacttaagagacctcaagtgaacttatttcgtgtggagcgtacacgcggcccatgaggcggcctatagtgtgggcggcctgaaaacatattcggggataactttagggacaaaaagtgaacttattctatgaggagattacaagcagcccaatagtgtgggcggcctgggaacggcacccggcccgacgcaggagaagctggagtcgtgcgatctgatggacggtcctaattcattgcgacctatatataagttcaaaaggtccaaaccctaaccctaaatcatttccccttcctctctctctcagtggtgccgcctctcctcctccagcgctcctcctcgccctccccggcggcgccgctctctctctacctcccccaccggcggcgccgctctatctctccctcttcttcctgaccgtccttccccccttctcttgcctccctcgcgcgacggattcggcaacggcggtgtcggcggcgaccgtgggtggatctggccgcggtggtggcggccaaggatgggtccggcggcggaggctccctccgacccctctcgcctccctcccatagcagatttaacagcggtggtggcctcggcggctaccgcatgtgcatctggcggtggttcggcacggcggcggacccagcggctgctgctcctcctctcaggtgtggcgacgtggccgggagtggtgatgggctcaggagcggcggcgggctcgggagccagtcacggcggaagacgactacggcgacgacggcggtgaccacaaggaaggcggctgcgggaggcggctaggcttagggtttggattttacttttgaattggacatgactacgacgagacggtagctggattgtcgtaaccagcttacctcactcgttgctattagtacacctaatagtgcctttctttatttcttcttatagaattttcttttgatttactcattcgaattacgatctgattgcaccgctgtgttcataacaattaaatctttaaaacaagatctcacataattatattttaataaaaaatgataaattaattttataatatatctaaattacttttagatttcaataaattacttcttagacatataaagtaaattcaataaatcataaaaataatttaagaataacttaaaagaaaaagaaagtaacttatcacaacaataagagtaaatctattgtggggtaaagaaatatatcaatctagaaattatatttaataaacatattgtagaactaaccaataaagtaaagtgttcattgaatgtctaaaaagtaatttaatcaaatatagaagtaattattgcatataataaaagcaatttacatatataataaaagtaatttacaacataaatattttttccatcataatataatcatgtaagatcttgttataaagatttaattgcaacaaacaccatggtgtaatcggattataaatcaaataaatagtttaagagaaaattctataagaagaaaaaaagatatatactattgggtgtactattagcaacctagagtactcttatgtatgggtgtctctcgttaaggctaaaccggagtgttctcggtttagattttaccttttgaattgggagttgattttgtggggattcttgattttgatttgggattgcaattgagtgattttgtgattcatgtattttgggaattggtggcaaaggggtggggagcaatcagctgatctactcagggtttttttttaaaataaaagacggactcggactcaaacgacgactacggacaaaacgggtgatcgaaagccctacgtattttttaagtaggtatatagatatggaagaaccaccaacacatactacattcataccgttgacacctgcgttcgttccctggagttgggaacgttcatctcaagcacgaaaatcagagcagttcattaacatgtgattaattaatactaattaattaagtattagtaaaataaacttgaaaatggatcaatataattttttaaagcaactttcctatagaaattttatgcaaaaaaacatagtttgaaaagcgcgcgcgcagaaaacgagggaggagagttgtaactctcaccgccgaactctctaacatatgctgagatgaaagctaacggcaatttcttgatctaactttaaaaaattccttatgtgtcccttaaaactcatctaatccctttcatatctttcatatttgcttggtccttttgtaccactgaatttttactttgatcactaatatgcctcagctgttacggccctcccatcgcctcccggccccatactcccgtcgtcgccatcgatccctcactctcatcgcccccacgagcagtgatgtcaatttcggttccctatcggcaagcaaatatgttagccgaattttccagggctttttttttttccaaattttacgaatttggtgaaggtttattaaaatttccgtgcaaaacgaaattgacaacctaaatacttgatacctagtatcaggtctggtatctaaggatatcagaccgatctagataccaagtacctgatacctaggtatccgatacccaataccaagtatcaagtatcaaggtaccatgtaatcgatacctgaggtatcaggtatcaggcctagtacatatggaactaaactgaatactttggcttactacttgatacctagtatcagggacttgatacccaggcatcaagtaccatatgggtgacatgtatgatttgtgggtatcatgtcttctacacatctgttcaagctattaactctatatactagaagagtgtcagagcaggtctctagtgtgatctttggctgcataaaaatgtttaccaaagaaaagctagtagtactttagtacataagtctagtatatagtagtactattagtacaacagcatacatacagaaatccggaggcaactctagcctctgaccaacttagcaatgctaaggccccctttgattcaaaagaaattcataggaattttagaggatttcattcctatatgaatttttcccacaaagctctttgaatcaaaggaatgaatcctatggaatcctataaaattcctatggaatgcctcttaccatacaagttttgaaggaattttaacaagaggtagaacctcatggaagaaatcctttgagtctttatctcttctcaaattcctgtgtttttcctgtagtccaatcaaacggtcatttctatgtttttcctgtgttttgcaatcctctgttttacacttacattcctgtcagaattctatgtttttcctattcctccatttttcattcctgtgattcaaaggggccctaagtttttctcacgtcacgcctggcccgccttcgcatgctctcagaacatatctaaacatgaaaaagaacggttcactcataacttatcccattgtttagacagtatcccgtttcctagtttttctcctttagcgtttccttcgataaccgggggatgctttacatccgatattacggttgagggccccttttattcaaaggaaattcataggaattttagaggatttcattcctataagattttttcctatatagccctttgaatcaaaggaatggatcctatagaatcctatgaaattcctatggattgtcttttcccatgcaagttttggaggaaatttaacatgaggtagaatctcatggaaagaatcctttgagtctttatctctcctcaaattcctgtgtttttcttgcggcccaatcaaatagtcattcctatgtttttcctgtgttttgcaatcctctgttttacacttgcattcctgtcagaatcctatgtttttcctattcctccattttttcatttctgtgattcaacggggccctgaaagatgtgaatcgatatcgggctagagtcgagggtgacgaaacacacttgttccgctccacttcaccaaacaacccaaaatgcaggcataaggaaaaagtacatcagaggtccctcattttgtcaccgaattacaaaatcgtccctgaaccacaaaaccggatacaacgcatcccccaactcacaaaaccagtgcaaactaggtccctcggcggtattgtctccggttttggctgacgtggcgcctacgttgctcctttcactaggtcttagttccatgtggcaatgacgtggcgcttatgtggcaatctgatccaaaaataaattaaaaaaactggggcccacatgtcagttgcatgcggcgtccaggagggagcgcgggacttgcggaacggctggcgggggcagtggggcacccgctcacgccgccggtcttcacgccgctcctcctctggctcctaggcagaggggcgctttttcttctcgcgcggcttgggagttgggggttagtggacgaggccggcgagtcggggaagctgtccatgtccatgaggcggagagggagcagccgtcgacacaacaacgagggtggggagcggcgcagcgaagcgggacgcgaggcgagagagatggtggtggagcagccgatgattccaagagaaacgccgttgcaggagccgttgatctttgccgctgccgtcgacccctgcggcggcgacggcggcacggtggaccacctcttcctgcatgtgctcagcggtgatgtcccacgagagcgcatccctctccatcccgctaggccgtcacgctctctgccctctcccgccacttccgcgtcctctcgtgacccgtcccagttcggccgcattgactctggcgaccttccccgacctgctcccgtcgctcccggcgaggccgtccttcatccgccgcctcgccttcgcattccagcaccgcgggtgtcctcctccgccttctcccgactcctcgacgccaccgccgaccgcggcctttccgagcttgccgtctgcctgcaccgcaacgggttccttcccaagaacctcctctccatccgctccctcaccgtggtctcactcaactcatgcgggttgcctcgccggttatggaggaacggcaggtgggccactcaagctgtgcgggctgccagtggcaacccttcaaatcactcaaactcacacttgatcggaggtggaagatgatgaacagtgaaaacaccagctgtttgatgcaggaatttttggtgccgcgtagaacgttgcagcgtttttttggggtttacttcacttctataaagcaaattacatgcaaactaaaatcaactgaaaaactgggagtgccatagtggcctccgtcatgtgtgccaatactccatgagacgtgctcctggccaaaacacacgacgctcacgctgcaacatgcaaacgcgctcatgcaacatgcaaaaacgaaaatataatcttcggctgcacatgattaaagaacgctaacacgggcaatgccggagcagacgctggagatggacatcggcgaggaggccgcgccgattgacaacgaggaggctacgctgcaacatcactggggcggtggtgcttggtgagtaccttcggcggcggcggccacgggcgccgaatggatcacaccgccatgtcgctggattgggtaagaaaagaagaagaccgagagattggggaggagacgtgggtcccggccgtgctgctcggccacgtgcgactgtcgagggcggcggggaggccggcggcgagagacggagagggaggaggcggggctgacgagggggacgggcaggccgaggagctggcctgctccgcccaacgccgtgtagcaggagagagaagaaatgtgaagagaggaagggggagaagagggagaagaaaacgagtatgacatgtgggccccactgtttttaatttattttttaatcggactgccacgtaagccccacgtcattgccacatgtaacaaaaacacctagtcaaagaagccacatagacgccacgtcagccaaaactaggaacaatactgctgagggacctaatttgcactgtttttataagttaggggatgcgttgtatccggttttgcagttcaaggatgattttgtaactcggtgacaagatgagggacctctggtgtactttttcccaggcataaatgttctgcattcgcgtttgtgggccgaataagtggaaacagtagtacgtgggttaattttgggtcgaacttcaacgctttgcgggctgaacgcacatgggctcgatcgtcctttctggcccagttggggagtgcgacccacctttccctggcctcctcgcctcgccacttcgcccgccgcctgcgcctgcgccgccggcgacctccatcccgtccccgcgcgagcagggtccccggcgacctgctgcttcctccgccggtgagctccggtacctaggcacacaatcctctccagtgtaacaggagatggtggagcatgccactcttgaatcctctaagccgcgcgccttccacccacatccgcagcttagctcgtgtcctactctcatgcctccccaccggcggcgaccgcctccggcgtttgaacccggccatccatgcccgtgccaccgtcgcaggaagactcgacgacctcttcctcaccaacctgctcctgcgtggctactccaatcttggccgcctccgtgacgcccgccacctgttcgatcgaatgccccaccggaaccttgtctcctggggctcggtcatctccatgtacacacagcacggccgcgacgattgtgcaatttccctcttcgtggccttccagaaggcctcttgtgaggtgcccaatgagttcttgcttgccagtgtcctacgtgcgtgtacacaatctaaggctgtttcgcttggcgagcaagtgcatgggattgccgtcaagttggacctggatgctaatgtttatgttgggactgcgcttatcaacttatatgcaaagcttggctgcatggatgaggcaatgttggtgtttcatgcactccctgtaagaaccccagttacttggaacacagttatcacaggatacgctcagattgggtgtgggggagtagccctagagttgtttgacaggatggggattgagggtgtccgtcctgataggtttgtactagcaagtgctgtcagtgcttgctctgcacttggctttctagagggtggtaggcaaatacatggttacgcgtatcgtagtgccacagagacagatacatcagtgatcaatgtgttgattgatctatattgcaagtgctccagactgtcagcagctcggaaactgtttgattgcatggagtaccgtaatcttgtgtcttggacaaccatgatttctggttatatgcagaactcattcaatgctgaagcgataaccatgttctggaatatgactcaggctggctggcagccagatggttttgcttgtacaagtatcttgaactcatgtggctctttggcagcaatatggcaaggaaggcagatacatgcgcatgtcataaaggctgatctggaggctgatgagtatgtcaagaatgctctcatcgacatgtatgctaaatgtgagcatctaactgaagcaagagcagtatttgatgccttggctgaagatgatgcaatttcatacaatgctatgattgaaggatactcaaaaaatcgtgatcttgcagaagcagtgaacatattccaaagaatgagatttttctcactaagaccaagtctattgacctttgtttcactccttggggtgtcatcatctcagttagccattgaattgagcaagcagattcatggccttattataaaatcaggaacttcattggacctttatgctgcgagtgctctaattgatgtgtactcaaagtgttcccttgtgaatgatgccaagactgtattcaatatgttgcactacaaggacatggtcatctggaattcaatgatttttggccatgcacagaatgagcaaggggaagaggccataaaactcttcaaccagcttcttttatcgggtatggcacctaatgagttcacgtttgtcgcactagtaactgtggcaagtacactagcaagcatgttccacggccagcagtttcatgcttggatcatcaaagcaggtgttgacaatgatccgcatgtttcaaatgctcttattgacatgtatgctaagtgtggcttcattaaggaagggaggatgctgtttgaatcaacatgtggggaggatgtcatttgttggaactcaatgattacgacttatgcacagcacggtcatgctgaagaagctcttcaggttttccggctgatgggagaagctgaggtagaacctaactatgtgacctttgtcggtgtgttatcagcatgtgcgcatgcaggttttgtgggtgaaggattaaaccattttaactctatgaaatcaaattatgatattgaaccaggcattgagcattacgcttctgtagtcaatctttttggtcgttctgggaaactgcatgctgccaaggagtttattgaaaggatgccaatcaaaccagctgcagctgtttggagaagtttgctgagcgcttgccatctttttggcaacgctgaaattgggaggtatgccgctgaaatggcactcttggcagatccaacagacagtggcccttatgttttactgtcaaatatttatgcctctaaaggactctgggctgatgtgcacaacttaagacagcagatggatagttctggcacagtgaaggaaacaggatgtagctggattgaagtgacaaaggaagttcacacgttcattgtgagagggagagaacacccagaggcagaactgatatattcagtactggatgagctgacgagtctaattaaaaatttgggttatgttcctgatacttctgaccatactctgttgtgtgagactggttaatctagtaatctacttgttaaggcttctacacagatttcatttgccagagtgtcttttactgactgcaactttgagtgagaacctaaatggcaaatatttttagaccgatctaagactaacagcttaagtgctgtttatgccttttgaccagtggttttgcacataatatcacgcttgctacagacttgttctttgagaatgtttgacagactaactggcagataaccattaaacctgaagaggtttccagtggtggggatagcacggaccaaaaattagaaggatctgcaaggtgtggtatgcctgtaattgttttgctgtaacgccatttcatttattagtagagttcttgcaacgacatctttatcagtttatcttcattctgttatcagtccatttctttttagttaaaattttctcacataattatcatttatacctgaagttttcaacttgtgtcctgacaatgagatacacctgttgggtgcccaacggatatcaacgatggttcttcaggtccactttcatcattgtctgccctttaacttgtctgtgctccacaggatatgacatccagcagaactttaccctggcattgttttattttgtgtgaccactgcccatgggcctaaatgtatttctattcaagggaaaccagttgagaggaatgtttgaatatacctgatgttttgtaaatttccacttatatccactcatcacttcacttttgttcatcagtaagagaacaagaatatgggcatcttttcaacaggtacatgtagaataatttggtggatgctgattcttttatcggtgatttgcggaaaaagtcttattaatcgtagttacatatggtttatcttaggttatagccaacgcactaacaatttaagtcttaactgctttgagctctatctccaaggaatcaatatattgatatgtcaatagtggcatgttgaattgcagctactaagatggaatgccagattgccagaacatatgtttaactggagtacacggtgtaaggtcatatttctcacacctgcgtttcatttgattctaacaaggaagactgatttaactgtcctgaattttagctttctgaacttatcatcaatagtagtgtaatacttagttgagaaagtttgttccaataagatagtaacagtattctgaatttaaataaccatgcttaggctgtgttcattcctcctggttgggaacgctcccctctggcacggaaaatggagcagtccattagtgcgtgattaattaagtattactccctccatcctaaaatataaggctcaaccattcataacacaaagaccaagaaaagttttaatcatcttcttg

SEQ ID NO: 82109 - DNA, 1392 bp, Oryza sativa
tggttgaaattaaagatgatgtgactgaaaagttgtgtgtgtataacaggttgatgtgatgaaaaaggactaaagtttggttctaaactttggagctaaacacagcccaaattgcaaaaggtttctgcactctctactcaacctgctttggcagcttgtgttcgcagaacagccggtagttattactggttgttgcgacatgacatgggagcaataaccaacggtcagccagaaaaccgcatctatctatctaccattcattcattcattcattcaaacgtcaggttcaagaagacgaggaaaaagaagaagaagaacaaaacgttttcatgaagaatttggtaactgaagatgcagaaagtttgatcttgctcgatgtggagtcagagtgacactgaaagtctgaaaaaataaaggctttactaattgctactgcaatttttccaatcttctgcgaatgatacagtgtgttgttccaaatctccgattaataatcctcgcatcatactttggtgggtcaaactgttaactgcacaactgttcgttggcaaattcaaagggtttcgcgtccctggaaatgatgtgatttgtcacgcaagatttatttatctgctcataagttcttctaatcaagagagcaggtttgctagttacaggaatccattcgcagtgatcaatagagattggttggtccaaaatgttcatctggtaatcgattaacaatcagttcatgttttggctgtcagcagcaaaactgcagcttgaagcagttctgatgaaattcaacctagatgcttcgacagttcgactacttataatcgaataacaaaaactgcacgctcagcaagaaaattcttccaacagtttttttctcaaagaaattattccatccacaaaaattgttgagcgatgaacaaagggatcccatgaacaaataacagcgcatggcgtggagcttggtcagccgctggatcagggagcaacggcctggatgtaagatggagccacacgaatcgggcatgtgatgcgggccggaaaggggagaactattttattgggccgtgtgctcataaattgggccgcgtcagaaggtgaagcccacgcgcgtcgtactgcgggggtggcgctggccacctgggtccgttggatggggatccgatggtttgtacgggggcgctgcggggaaagtttagtaccacatcgaaagccaacagagaaggagagcagcttataaactcgcgcgctgcagctaggtcgtcacttcggtgacatccgataaaattggaacgatacagagaagattagcatggcccctgcgcaaggatgacacgcacaaatcgagaaatggtccaaatttttttgagatttctgcccaggcccctgcagcccata

SEQ ID NO: 82110 - DNA, 6981 bp, Oryza sativa
cgccgtcgaccggggtgagccgaagaccgttccattcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagatttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatatggagtttattagagtaaaagcctttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccatactattattgttattgatattattaccttgttcaccctagaataaacaaaaccccaactagtggacactctatttatggttccactagtatgaatttaggtagatgcttcgctgattaataggacaacattaggtggattttataattttagactttgggaatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcgacaactaaaatgtggaatggttggcctgggttggcttgggacgagctgggacccagggtcgggttgccagttcggtctgaatcatcgtaggccttgggttaaggcaggtccgtgagggttcacggccttgtgtaataatactgtgtagctctaggatcgtctttataaaatggctttgggcaaccaagtgacttttaaatgctgtttactgcaaaacttaacccctatattattatccccttgtactcccttgcattaattatgcatctccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacatacgattcgccatgtgaaaaccttaacggcgtaatcaaattatgccgaaaccgagtcaatctcaatggctcgtttttctcattggcgtgcggttcttgtggacatcggactatccgatgaacacaatcgcccttggccttggtgagtactagacattccagtgaagtcaccaacacacataccgattgatctcatcaacccatgcggctatcggttcatcgcatgttccgatcacctaagaactcatatacaacataatagatctcatctactacatccgcatatcaactatatgcaatgatctagatcataaactataaaaggtggctctgataccactattgggatacgcgtaggctacgatagcatatatcaaaattttctatcgcgtaaaccaggaaccatgcaagtattagatcatagatcgttaccactcgacgcgctgcgcagcggaagaagacactgagaagtcgaaggaactctcgcgaagtagcgcgcgtcgatgtagaggaagtagtcgatcgcaccggctcgacctttttcttctcacgcgttctcctcgccgtactcccacgctaatcagcaccgcaaaccagcggcgcctctaccggtatctacacgtacagggacagaacgccacgcgcagatatgctagcacccgcgcgcggctagggttttgcgtggggagggaagtgacggctagggtttctcacgtgatgcaatatctccgccggtcgcacccctcacgaatatataggatccatcactcgggcctccaaggcccgtaggactcctattcggatccctatccgaattaagcttatattggatctccatccaatcgccttattccggcccattaagcgtgcgaccctgtaggttcatgtatattcggctgtaacccgaaaactccttttcggtccacacgtcaacagcggcccctagcagaacgtattaacccaccggacatacataatgatcatatcgactgaacctgtagtgtatacttgtatgaacccctttgcctcacgatatcgattaagctcaaggctagatatgtgacatcctctaatagcttaattattcactcgaacctgttaatagattatataacttgtgattgactcctcattcacctttggcatggccatgcacttccataatctacaacatcgaggggcccagagatatctctccataggaggggcaaatcccatcttgattattcatatcccactgcatgtttcatagcatacccgaaaactacttttataactacccaattacggagtagcgtttagcaatccctaagtaagctactacacatgttgagaaccatgataatcttaggtctaaggattcaacaccaacactaaaagagatcactgatgacacaacacatatggctcttacagtgtctcatgttgggtctatccaataacatgttcaccaacatgtgtccacattattaatttggtatgtctataccataatccataagacatgatcatcaattaatacatgtgctgatcatataaacatatttgttccacatatgatatttgatcagggatcctttagaaatagtaacaaacaacataaagagtctcataaaagaatcacatattcattaaccaataaggagttatctatttcaaagaacaatgtcggataaatatgtaaacatagtgtatgatacaatcatctctatgattgcctctaaggcatatcactaacaatttggcatgtggtgtgtacgttgcggcaattgcctgccttctaaaatgcatgcacatatatgcccaataaatggacttgcaatgtggaggtggtttccattttataagaagtaaagtaaatcagggagatggttattctcaggtgaatattaaaatctaagtatatgcatgacattataaaataagtcatttaattccctaagatatgtaaaattgtgttaattagtgaattgtacaaaacatgtaaataatgaaatggatgattactaggcgaatttgttcttaagaaaaaaaatgtaaatctcaaaagagcacgcaaatatcgtcctgcagatgataactactcgtaccgatgcggtacatatgtacatatagaactaatacttaacacaattatatccttctctatcccctagaaaattatctttttatccttactacctaattaactgtgccagtatttaaataccttataagtggtaccttttagttttactgttgagcgctgaatttttgcctttttttagaatgcctctccatatattaaatatatcagcagaaaacgttcctgttataccagtatctttttctgcaatcccagcagtttgagggcgactgctttgatcagataagtgatattttaagcacaatagcgaccgtacgttataagatattcgctctccgagtgcgtccaattatgtataaaaattggaacaactagaatgggagataccaccaacctttgtcatcaaaagtcatgggcctgccgatcaagatagatgtgataatgcaggtctaggctacccaccatatccatatgtctatgtctatgtgtgtgtatgttgcatatattcatgctctaaacttttagctgtccacgacaacaatctctcgtgcttatcccctacaaaacgatgtgcttccctcttctatgttgcaaaaatttaatttgtcacaagtcggtccaatgagaatttgcctcaccatgccatgtccgtatgtatttagacaaaatttgatcacatatcataaattgctcaaagatgggatttttttttcattacgggtggtgttcaatgagaatatgctggctaaaaaaattatttgttttaatgttactcaatagtaagagggagtcggggatttatcccatgctactcaatgagatatatatcaccttagatctcattttgttttttttagcttatggctgtgtgtaatatgatagaagttagaggtgtataaaacatttgcattatcttaaaacaaattgctcaaacaagtaactcatcttatttcgcgatggaaatcttgtccaacatgtgccatgtcccaattttttccaaaatgtaagtctcacaccgatttcttttgtcgtaaacaagatcacacgcgattcagaaaatactccctccgtccttttttaaatgtaaccatataagtttccgtgtctaattttgatcgttcgtcttatttgaaaatttttataattagtattttcgttgttataaaatgatagaacatgaatagtagtttatgcttgacttatgttttttaatttataaaaaaaattttaaataaaatggacgattaaagttgagcacagaaaattatggcttcactcgaaatgggatggagggagtagtcgacaataatgcaatagtacgttttttaacatattatctagctcaaattgatcccactgtcaaattgctcgagctaatcgtggcatgccgcatgtgcaagacttaaccgatcaaataaattaaaacaactgtgtgccccgatgagcgcgggcaatttgacagtgggatcatattgtggctcataatacagagtggaggcgcttacaagaacaatattcccttagttgccaattgccattggaataggcgcaatcaaagaattgattcccgtgtgatggctccaacactctatctacgtccccataatgactccaactttacaggcaacccacgtgaattgatatgttccatgggattcacataaccaaaacaaattatataatgaagtgactggttgctttataacatactccctctgtcccatatccccttatagattgattctttttggacggaggggtaggtgactaaactgtgcctatcttacaaattatggtaattagttcgtaccccgcactttgctacagaataagtggatgaatacatgctatatattatagaaatggtagatatatatttaaataatataaaaatgatgtgaagataattaatgatttgacaatgcttgcatattgagttataaaaatataacaaaattataaatgatatgtcatatttgcatgatatttgaaatagtctagataataattactagtgggtgatgatgtggtgcacttacatatgatttaaaatactctagataataattgctagtaagtaatgatgtggcacacttgcatatgattttaaagactctaaataataattgatagtaagtgacgatgtggcacacacttgtattttaagctttaaaagttagtggacatcaatattatagtaagataggataccaacaaggcgacgagatgatctaacgatggatctaatggtattgggtctccaattacaagctagcatcgaagctccattcttgttttctcataggtccatgctctccctaaacaatagatcttctcatgcgatatagcctaggttttttttttatataacaaagcaacttattgaaaagaaaagttcaggagacataaaatccccggtacatcacctggattaaaattaaagataatatagaacaaaagcatcccttctgcaagtaagtgtatagttgaactaagagaaataattttgcaaatgaaaccatgcagcaataatgaatggggtcgacagagggatacgacattattgttgtgatgacttcatcctccacaggccagatctattactaacgtacgcaccgcttaggtggccctgtcaatgtgattcaccggactcaacaaaatatgtcactaatttattggttaaatcagatgcaccctcttgtctaa

SEQ ID NO: 82111 - DNA, 942 bp, Oryza sativa
gtattggcatgtaagaacgtgaattaggaacatgaaagaagtcaggattaacaggttcgattgggtttctcagtaatggaccttgttgtggaagcatgagccatgatgtttccaccgatgggtttgatctgcggcccagcaaacatggcagaaccatccacttgtgccactacttgattagtgataaccacagccactccaaactacagtgagtaagcaaaccaaatttaggatattgaaacatgccagagtaaggactatggtctatggttattctgctgatataagtaccatgtttcctttaaagaaagacaatagaaaagaactaacctcatctgctaatttctgaaggctcctcagaaacttagccatgtgcatttgcctcgctgagagctcccctcgacctgagaaatcagttctgtacaaagctgtcgcgctgtctacaatcatgagagcaaacctgcacatgtgaagattcaaataagaactatggaggaacacctaattcaatattatgttaggtacttgtctgaagaacaaccataactaaaaatcaatgaaatatgtatcagttattttcccatgtttaaataaggattttgtgcaaacagaatcaaacatatgttgaccttgaaagaaaataacaagcaccacataacaaaatttagctcgaatccactcatcataatagaagcatctgtaatcatgagccattactttgggcatcctaccattccaagttgcttgaagtgtaaactcagtactatagcaatagacagcaatggagtactgaagttcacttctgttttgatggaagagatgcgtgcaacttagtctgtcatacgggccaaaaaggttactacagaaactaaggtttgttggcattacataatcacttagattcataaggacaagtactatcaacttagtttcctactgctg

SEQ ID NO: 82112 - DNA, 2422 bp, Oryza sativa
agactgaacatccatcaagattcacaatgtataagccattcatcatgggtgcatggaaatagaaaatgtcattataatagactgaacaaccattgtccacagatctaaaaccataaccctctgcttgcaaacaagaagcagagataacgttcttacacaaagctggaatgcaataacaattatttaactaaaaaactaatcctgacggtaaagataatggcatagtgccgaccgcaacagcagcaactcttgatccattgcccacgcgaatgtccacttcgcctcttgctaagctcctacttcttttcagccctgcaacgatttgcatatatcagcaactgacccggtatcaaatgcccaagaatcagtagaggaagtagcaagattaatttctataacattaatacctgaggtggaactctttccatcctgctgcttctgcttgagctgctctaggtatttcttacagtttctcttccaatgacctgtctccttgcaaaagaagcactctgcatccttagcgggccctgtcttttgaaccttggtcttacagttgctagtactcgtgatctcatcagagtttagctttctcttttgaccactcttcttgttgttgggcttgagcttatgcataaccatcacatagttggagtttttcttaatgctttcctcggcagtctttagcatcccatgcaattctgccaaggtcctgttcaggttgttcatgttgaaattcataatgaacggctcaaagctgggagggagcgactggagaatcaaatcagtagccaactctcggctaaggggaaaaccaagcttatccagactctcggtgtaaccaatcattttgatcacatgtgggctcactggattaccttgtgcaagcctgtacgcaaacaagaactttgaggtattaaacctctcagctcttgcttggtcctcaaacatgttacgtagtcccgtgattatcgtatgagcatccaatgcctcatattggctttgaagctcaggggacatagtagcaagcatgagacagcttatatcaaggtaatcattgcatcgcctttcatgcttcctacgttgagcagcaggagcattgttgggcaagtcagctggaaaaggctgtataagcagaaactctttgtgctcttgcctgagaacaattctcaggttgcgataccaatccatgaagtttgttccagtcaacttctctttctcaagaatagaccgcaagttaaaattggatggtgcatgagctgccataatctacaatagaaatatatgtatgcaaaatcagcaccatgtttacatttaacctttcatcaaacaatttaacaaaagatactcccattatgtattgtgaaacaaaattccctctagtaacatagtgagttaagatcctcattttattagtgtctagtgagctttggcatccaagctagacaattatcaaaacaggtaagcaacaccttgctaatcacatcatatgtgactcttgtgctgttggggtgacatctccatgtccaacccaacctatgccccaaggtccaataaccttgtcaagtaaaccaataatctccgcatatagatgtccgacatctatcctattttatcatgataaaaagtgacactttactatggcaaactgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttccccccttcctctcttgggccggctcggcccaactctccctccctctctctcctctccccgcggcccatcggcctcctccccgcgcgcgcgccgctgacaggcgggcccgcccgccgccctcgctgacgggtcgggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaatggtggccgagatctccgcggccgattcctccccctccggccgttctctctctctcccggcgctatataagcgttccccgtgctctcctcctccgtttccgccactcgccgcctctcctccccgtcggaatcgagcccgcaccgtcgcaccttc

SEQ ID NO: 82113 - DNA, 1469 bp, Oryza sativa
  unsure (1)..(1469): unsure at all n locations
ttgtaagtatatttggcatgtaaaaactataccaacaaaattatacttcaatgtattttcatataatgttggttctgttttaattaacaaaatagctagtagtcaaagtttatatgtcttgaccttttgacttcataatacgccttataaaaagaaatggaggttactttcttgaaaggatctgaaacctatgccttttcatcctaatctaggcatgacatgtttccagattttgaagcatcggctttaatgcaatatgatgtatcccatcaaggcaatcttacaaactgaagaaanaaaatactgcatgaatgcaaagattgcttggacgttagcaatgcattgtggcaacaagatactgagataatactatccacggcattcatgcaaggcaaaagctagatatcttcaatgtaaattctggtaggcaagatgagaaaaaaaaagggttaaaaaatgtcatcaatacataaacaatattctgcctttgtgacagcaactccaggtgacaaggggaaacaaaaacaaggcaaaagccatattccacatgtttcagtaattcggaaggctgggctgagcatgcataaactcaggcccaacttcgaacaatcttttcctatcacacccacattcagataaggctaaagatccttctgagatgatcagaaccttcgtcgctttctccttgtagcttcttttgggaacttgaggggagctggaagtgtcattacagaggatttaaatgcaccggccgacgaagatttgcatcccagctggtcataatatggtttaatcatctggcgggtcattttcaggtcttcacatatatccttagggtcggatctgaagtcatcagcgtagagcgtgagtacgagaatgtagttgatcagaagctcgtgtttctctgttgacaaggcgctagatcctggttccgtaaacattagcaccatcttacgatatacatactgtgggatcactggtccactggtagcctggttttcctttctgtgccgcttggacatggagctgttccgtgccagcagggataggagatgtgtgatgtaggacagtatccaagcaagcctctccttatcttcaccctaaagcatataaaacatacacatattgcatttagagcatatggaataaaagaaacaactctacaaacacagtttttagttgagttcagtatgacataagttaaacagatggctgccattgtctcgagagcaatctgagtaaatatcttaataaagaggggaaaacatgcaaatcaggattgttctacatggcatcattgcaattgagtgtctgccatccaattctaggtagaaacagtttgctcacatcacagcaaaaactctgtaactgtcaactacaatatttcagcaaataaattctttttgcactgactaaaggaagatccgagtcaattaatagctacttccctgtatgcttgagtgcttgac

SEQ ID NO: 82114 - DNA, 802 bp, Oryza sativa
ttttggggttcttgaatacggctttctgctttcattgccccttttcttgttagtagttttgttcttttttgtgctctgtaaccactgatgtggtctattttgcccttctgtgtagcttcaatttaccttatgccctacttatatgctaatttctctcttatatgcttaataattggcacagctcctgccactgttataagaaaatgttcatgcatgttattatacctgatcaatattgatgataacatgtcaacataaaagaactctgcctgcaaaattttatgctacacaccttttggccccttacatttcagttacaacagaatcacacatctgaattatgtcagctctctgatcatgtagttgtggttgcatcaagtttgatacgaaagaaatcaaccttttctcaatcattggtccactattgatcacaatagcattgacatcagaaacctaatatcgaatggctagcattaacttaagcttgggtttttcaagaaataaaccatgttgccattgtagaatgaaactgcatatacaattcttacagagagacgataaatgaattattttaagattacacatagattagcattatagcgtggtcatcaacatcattaacttcagatacttattcaatttctcttttgcagtatttggatgaaaataaacagctaattttggccatcctggaaaatcaaaacctagggaagttggctgaatgtgctcagtaagttgcttgctaaacatctttgaaaggctttattgctggattactatatgaaatgcttctaggtggctg

SEQ ID NO: 82115 - DNA, 26588 bp, Oryza sativa
  unsure (1)..(26588): unsure at all n locations
ctgactgcctccttgttgtccctttcctatttgcgtaggttgccttgtccacgccataggctgcgacctctttgttgccagttgtcgcctcttagtcggactctacgaccatcgcacctcttcgttgagcgccccatggtcgtctcctgatccgcgttggctgccgctctcgtctccacctccctcctcgctggccgccatcctcctctccacgtcatcctccacgtcggcggtctcgcggacctcctctccaccgtcctccagcttctgcgaaaatgtaagattataagtgttattttatgtgatttttagctgataatgtgaaaacattttatgtgagataatgtgaataatgtgaaatttttttgtgatataatgtgaaaacttgttatgtgagataatgtgaatatttcatatgttatatttatgtgattttttctgtcgtaatgtgaatttttttatgtgagataatgtgaaaaattttttatgaaaaattggatcacgtgcgagcaagaggattaatgggtccacaagtcagcgcaaaccgactttggatcagaccaaactacaaggaaccgtcataggggcccacatgtcatcctcccatcaaaggtggtggctagggttcagccgaaccaggcttggtgcccccgccaccgatgctagaggtggcatttgccgacagaagggatgtagctaagtttaggacatggtgtagtgcatggtgactctacagcaactcctgatggtggttatgcatggttagcagaccaataaccgtcatacaactgctattgagaggctataaatggagctctcttcactttgtaacacacacatcaaggatcaattctctcttccactttattctctatagtttctagtaggaaataagcttaggagcctcagtcctatagtcttctcagagttctgaatatgtctctagtactctcttctttgtgtaagactatagtcgaattaatataattattttctttatttatttatgctcatattttatataattctttattgagtatatttgttatgagtagtatatacttcgtatatctacttcatcctagggtagtcgatccatgctatggtaatggtccaatgacctttataggttgcgctagctccaacttgttcttccgaagggtaagagtcctaggggagttagtgatattgtttactagcataaacgtggtgtttaggctagataaatatcgttggatgtgggtgtatcctatggaaagtgatgtaggcggcaggtggtgacaaccttgtccatcctttgtatttctccacgtctaggtttgatgtaagagtgcgtaaatgccataaccacgctggcaaaccagcagggagtggtctctcggtagtacttgggtgcttggaactaagttctatgttgtaagcatgtatatattaagtatgtactagacatgattagtttagaagtatagttgtatcatagtatccttagctatttactactaggcactcttttagaggtgaatctcttgtatgtgtctactaccctataaatcattatcctaacccctgtctagactatggtgaattaattatagattgattaaatatatataagtatgtcttcataccgccgcctccctgtggaaatattaatacgatatctttgggaatactcatgggtgaagtgctacaatggtattctgtacgcttgcggatttatctgtgatcgtaaaaaataccaacaatgctagccgcatttctccttcactttgatatagaattcttgcatccaggttaattctccaattgcaatacaactacattattttttattagtatacatgtaggaaattataatttccctttattaattgtgctagttggcagtcgaaagtggtacttaacgactgtcaacacccagctccatcgcaaccaacgacagttgttgctccaacaccactttcctgttaacagggaaatttggtaagtcccgaagttatcatcgacctagagtcagtattggcttcattgtcctggaatcggccgacgagaattatcaagtcgctaatagtcggattcttgctatattcggttaaggaaataaatctattagggaagcttatccagaagtgaccgagttcaaggaggatacgtcatggcaagtttatctattaattaagaatagtctattagtttccttttatctttaggaaagtgtgtttagtgttcaataaggactttatgtttccttttatctttagaaagtttctttcttgacctacaaggactagtatctaccgatgggcataaatatgtacaccgaggtcattgtaaactatctctcaatcaatactactctcggcgtatcgccaccctcttttctgaggttttacttatcaaccggcggaatttggcacctgacgcggggcagcatcagttcagttcgatctctggcggaggggtaagtcctacgttccgtcggccctgggaatctatcagctacattggtgttgttcaaggctacatcacttcgatctcttgaattgctctggtttggttgatatatttgcctacctgatatctcaattctatctctaattgcattgtgtttagagatgcatcgatttagatgggactgtcttggttaggcccgatctactgtcttagccgatatatctctacaatcacaatgctgttataaatagatttattatatccatcacattagacaaactaaacaaactaaaggtttcactgtttatctaaatcaattggattttatgacatcagacttttagccgatgtatgttttaaccatcggatcagtacttatcctatcatattattattagccgactggtttctattggattatattattattatatcttattatcatcagtcgattgtctttgtatcattatctatgttggacatatagccgattgctcaaaaccctatcgacatcggctagaatcggcatcggctaatgtcggctatcggctggaattactccatcggcttgttagccgatcggctgttttatctgctgtttacataccttgtcagttgcaggatcaaactgactgactgttaggtaattcttacagtcacagatagaaatccgcaagcgcatggatataccgatgtagcacttccccctacggagtattcgaaagggtatcgaatccaagggaacgtgtgtgatcagatcttcctctggttcatctaaggacaccaagcaaaggataggcaaggatagagaggatttactagtgagaaacaatgtctagggaaagcttaagtttaatcctaatgcaatacttcgggcactggtaacctgctgttcccagatgtcgctctactacgtacccggacagggaggacttaagtgatctcgagggctgtcaccacctctacacctacctcaaacataccgtgggatacacagcaattactgtataataattacctaaacaccacgtctaagcaattaatatctactttagtgtttacaactcaccaaagcaatcactatattttagttgattatagtgaacaataatcctgtatgctatttaggaactaaacaagagataattctcacaagataaatttaaattactcagggagaatattatattgaaatcagagtaataaacagaattaaagaaatgagagaagattaccgacaactccggaattcttctaacttcttctactctactctcttcctattctagtatacaatatagtacaatagagtctcttataattcagctcaagcttggaagtgtgcgttcaagtgagtgaagtgaggtatatttataagaccttgtccgaagagccccttaaccatcattagggagtgttttatcggggtgctagccgataagttatctagacattgcatcggcttacaaggattacatacaagttggatttagccgattgcaacaaaagcttcactgtttatctaatcttgtggatttaatgacatcggtcctccagccgatgtatgctttaactttcagatcagtgcttattctatcatatcattattagccgattggtttctattggattatattattggtatattttactatcatcagccgattacctttatattgctatttgcttcaagtgtcggattctacatcaaaattatagccgatagttcaaaaaccctattgctatcggcttgtatcgacatcggtcggaatcactccatttgcttgccaaccgatcggctctttgatctattgtttacatatcttgtcagttgcaggatcaaactgactggcacgcccgcatctcatcaacctttggacctacactagagctaagcagatctcctaggctagtgtgtgtttttcgcgtcaacactagtccaccttccccaactctagtgaggtcatcacccgcatctcctgctcaagcgccgactcctccctctccgcctacagttcaagcttcactgctgaaagtgcatctaggacccctcaattgttttggtgttaatgacaacacaattagaggttcactaatgctttttgttgagatgaatgcaaggataaaaaggagtggaacttgagtttaaaagcattgcagcatgttttgtggtaatcgtcttctaatccatgtatatcttgtgttcttgagtattaggatgccgtactattaagagggataccacatgcatataattggtagaacactagtgctcaaaatcctttgtttgaagtgttcttgttttattcttgtgagactatccgatcctgatcggactatccgatgctcagactatccgaaatttcatagaactttgctctctgtctttggtctgagtgttggcgaaaaaatatcggactatccgatataaggtcggattgtctgatacatcggactatctgaaatttctcagaacttcactctctgttttgaattgtttttttcctcttgagtgattttgaaatcagattatccgatgtgatcagagtatccgatgacccagagactccgaaattcaatggaacttgagtctctgtaagaggatgaaattcttgcttcaaaaataacggaatatccgatatgacatcggactatccgatcgatcggattgcccgaaattctccagaatttcgttctctatctgtggcttgcttgggggtcaaaacatcggactatctgatgtcaccttggactttccgaggtgggatgaaaagattctctctcaacggccacattttgggggaatctataaatacccctcacctaacccttttctagggttacccaactcattcattctcattcactttgggttgagcttggtgctaaggtgctttggatctttgagctctttctccctcctcgttctttgtgtggtggatccatgtggttgtggatttggtgtttgagggcctagtgtgtgtttcactcgatcttgagcactagggtttgaccaagagttgtgtggtgtcttttactcttggaggttgaggactcctagacggctaggtgtcactcccgagccaccgctctgcgtgtggttggccgggagaagtttgtgaaggccggatctcatctccgcaaggacagagataccccttagtagaaggaggagtgcttagtgcaacctcttgaggaaagggttagcaaagacccggctcttagtgagctcctcaacggagagtagaatcccctcaaggatttgaactccgggaacaactccatgaacttcatcgttggtgatctctcttcatcctctctttagctttgcttaattgtgctgctatagatctagtcgctgtttgcgctatactcttgtttgtgtgctagatcttcttgttgtgactctttagtagattagacagtctgatccaacatcagactatctattattttcggatagtctggctgtggatcaaactttccgaccctaattcagttttagcttctgcataaagttttaaattagcctattcaccccccctctaggcctaattgaccctttcaactggtatcagagcctaatctcctaattagccttaactgcttggagagatcatgtcgggccaaacgggggatggcaaagatggtgataagggagatacgtttccttatgactatccatccacatctacttcttatgtgagtacctatagcggcaaagctccgtacttcaacgatacgcgctatgtcgcttggaaacataagatgaagatgcatttgaagtctattaacccatctatttggagaatagtcgaaaaaggctatgttttgtagaaacccgaggatcccacgaaggaggacgacgagaacgagcacaggaatgctcaagccgctaatgcaatacttagcgccttgaggaacatacttggcactagcgatgttaattagtgcatgccgacaaaaatgtcataacagtcccttatgcttttacataagcagccgctcgtaaatctaagtattttttttccgcagtaatacatcctttttaacaattgatgtctctaattcatctttcttgtttgcagcgatcactatatactattcctagtatatccaaaggaccatttgttcgtagcattggacccaacacactacgacaaggaaacgttcatggagttcctcactattctgattttgtaagtaatgtaataatccatatgtgcataattgctattatgaaatttctaagtaactataacaaatgttttgttcgaacaacacacatatgtattaccgcaaaagaggtgggccagtaaaagagccgacaaggaataatctacacgccaagacaggcttgtcagtactgacaaatgatattaacacaatttttcgtagaatccttacttgttagtattgaccggtctcttattattatgttcacagtgttttaaacaaccccacagacttccctatgtaaataatacatgtgcgagatggttagagtcaataagaggtacacaacaaacagtgatgaagtaagtccggatattgcactccatacagggtattctgtcgaaaattactttgtaacatttattgtccactttgtccatagatcccgtcaatcccttacgtagcaaatcggttcgacgacacaattatatggaacatgtgcgctgagcactgccgtttcacccatcatgatgcctacaatgcacttgggctattctacgaaaaggagagtcaaatcgcaataaaagacatattcaacccactaggagagtgggaggaagaacatatatagtgaaaatataatatttttgttcgtgatgaaactgttgtttatttgtaatatatgtatgacacgtccataaatgttttgtgttatttattctaagactatttacatgtcaatgcaatattgtagttagaatgacaacttggttagctcctatgcgtagaatttcaaatttcgattatgaaattgcgggaaatgttgtattacatacgagacacgatcttcccaaatggccagtttgggaatgggcctcatggagcatgcggccggcctaacttgtctgcatgcgaaaaccgatctttgcatgcgggccacttaacccagttgcatgcaaagatcgattattgtatgtgctgattagggtgagcgcatgcgaaaatagtgatttttgcagacattttcgtgcatgcgtgctggccaaccgcatgccaggaccggttttggctcccaggaaaaatgaatttttttggtagtgggtgtaaattgtctagatataatggttgtcatatagtacaaccactattttaaaatgaagatgttttggtttttctaagtcaaatttctccatgtttgagcaagtttctattaaaaccattaataattaaaacatttttttttaaaaaacccccttgggggaaaaaaaaccccaattggggaaaaaaagtttctattaaaaccataataattaacattttaacctgaaacatgaatactatacaatagtagatttattttattaaattaatttaatgttggtgttgtatatgtgttgatgaaaaatccgcgctcggccgatggtgccagatctgtattggcgcgaactaactcaacgaacacaatagcctgggagatctgcttaactccagtgcaggtccaaaatattgatgagatgtaggcattccaatcagttttatcctgcaactgacaagacgtatgaaatgaagatcagagaaccactcggccaataagttgatagcaatgctagccaatgccaataccagctgatgtcgatatggttttgagcaaccggctatatgtccaatctagattatgatacttgagtaaataatgatataaagacaatcaattgatcacaatgtaataaaacagtaatataatccaatagaaaccaatcgaccaaaaattgaatgatagaataaatgccgatttgatgtttaaagcatacatcagctgatatttcaatgtcaaataattccacaagattagataattagtgaaacctttgttgcaattggctaaaaccaacttgtatgtaatccttgtaagccgatgcaacgtctatataactcatcggctaaaataccaatgaaacccttattgtcaatcaaaggcagattagcttttatgattctaagcacgactttgtaggtcaaacccaattgatgcagcattaagtctaaacaataaggcctttgactgattttcagggtggtggataccttaactaatctagatcgatgaaacaatttaactaataccaataaaaccctagaaaagatctagtcgatacaggtaaattcagacattgacttaaattaactaagatatataatgaatagatgtttacatcgacaagattatagtatcgaggccctagccctgccgatcaaacatccttaacaagccttacccctcatcggagatcgacgccaatgaaacctaacttgaaacaagaactcgttgagaaagaaggaaataaaaagggtgggatgcgccataattgtattgatcgagagatatattacaaggatacgggatgtacatatttatacacatgggtagatattagtccttgctggaaaaagacacaaactttcctaaagataaagtaaaatatacaagtcctgatcagactctaaacaatatttcctaaaaataaaaggaactaactgactctatctagttaatacaaaaattgccatgccgcatactctttaaacttggtctgttctcgataatcttcctgtaattgccatgccccgaatccactaagaatctgaccgctggcgagtgacatttcccattagccgattctagaactctgaagccgatacggttcctaggccgatgatgacctcggggcttaccaaattttggcgttaacaatttgtttctatattttcctataagctgggttaaacttacagaaagtttaatacaggataaaaccaaaacaccttatgttctaaaatggagggaatattaaactgataagaaacaacttaggtggtaaaatagaatttagttttcttttaatgtgtcaaatcatatcttactataaagttgatgcccactaactactaaagctccacatgcaagtgtaacacattatcatccactagcaattattatctagagtattttaaatcacatgcaagtgtgacagatcatcacccactagcaattattatctagagtattttaaatcacatgcaagtttgacacatcatcacccactagtaattattatctagaatattttaaatatcatgccaacataacatatcatttacaattttgttatatttttagaactcaatatgcaagcaatgtcaaattattatctccacatcattttcatattatttaaacatatacatctatcattcctataacgtataacatgcattcatctacatatcctgcagcaaagcatggggcataaactaattacacggctacagaacattacataggttagcatacggcacctatgcgaaaattagaactggcacctatagattagcatgagccagaaaagaaaaagagagccagctcgaatcgagccgaactcaccaacgtttgacaccgcgccatccccaaatcaaattgaaatccccaaatcaaaattaaattgtgaccatgatctattgacatcacagaatgaacatactcaacaacaaaataattcacaaaaacatttacaaaagagactggggattggaggggaggggagggcgagggctggccaccgggcttctttgctccaccttctgccccctcgccagcggacaagggagggcgctgcgccgccaccacggccgcctagtggggagcccactcccccggccgcgccctcccctcccgttggatctggcggaggggaagacgctgcagccgcccacgaccggatctgccgaatggggcgctgccgccgcccactccctcccctcccgctggatctggcggaggggagggcatngccactgtgtgcatacagagaggaagaggatagataaagaaggaaggggggttgtaggaaggaggaggaggaaagggattatagcacgccgggtagagaataagatttgggcgagtttttttatgtggttggcgcactgatcgatcgtctgggctgggtcaattttacaaaacggtcacctacagtttagtgccggtttttcctctagaaccggtacatatagtttttaaaggcacatgttttttatttttctcagcgtgtggcggtaaaaaacggcccttaggtgatggttttaaattaaggggcacctataagaccggtccctatgagggtttttatagcagtattaccttgtaagtggtggtcataagcaaatcaactagcctctcttgtgtcaagcttccacagactgagcggctcgatcggctcgtctccaccctactagatcaaatacgtaccatacatatgcaactattattaaatgtacttacagttattaagaggtggagtaatgtggaccgttgatcaagagaggggtaaggtatggaataaaaatatattgtaaccaatggtagaggagtaattaactagtgaaatattgccattatcgccgaattgaataccttgctccgttgatcggtactgtacgcttgtcgaaacaagatttcggcaatactaaaaggggtggctatcaagctggaaaagtggatgggtttagagacaaggaattttatacaggttcaggccttcttaatcaagaagtaataccctactcctgtccggggattgatccgccgagtgtattattgattatatgatatgggtgaaagtcgtgcccctagaggcacccggacccctccttatataggggaaggagtccgtattacaaaatacagtccatatccctaacggaatatgtagttacagataaaatacaatcgtaaccaactaggatctcggatatttccttgacatacaagtttagaatttaaccctagtccttttaaagacattctatctatacacggcaccccatacccagtcagactatacatgccgtgtaggtatggggtatccataaactccacagtagcccctgagacctttacagtcgacgaaacaatctcttctcgtagcacagaatgataatccgagtactccgacttcttctgccctgatctcccgagtaccaaaaatcaaagactgtgaaggtctaaaaatagaaaaaaccgggtgcatcgactagatgcacataattaggtgtagcccccgactacgtgattagttaaaaaactaaacatatagtcaagatgcaaactacattcaaccgagtggtttgacaaccgaatatcatatagtaaagcatatgcggcgttcaataaaacatccagccgactgcttttagctttaatataccaaaaatggagatatgaaaaggcctgagtgaaaaacactctaaagatccataaattcacacacttgataagaatccgagtaaaaactcttaaaaagatccatcaaacgtgatgtaaatgtgataacacaacaagtgatgagtctaaatagcctaggctatgactctcaccataaaaataagcatataacatgccgagtgaatgactgtattaaaaccagtcatcccaataaaacccaaacagcctttgcagcctaataaggcctacaaaattagtataacacctttctgtcgagtaccttttttatttgcatcatagtaattccaaggaatcatctaactgcgtcaaaaaggattttaacatcattgggccatactgttgtgagcaaaatttgccaaagcaaaaatgcctaagtccctaaggatcacaactagccacgctggcaatagcattgggctgaagtactgtataggcccaggtccatcaccactcctgaaaccctagcaaaataaacgccgaagtcagagcgtcgtttcgtcttccctgccaaaactctcgccattttccccattctctgctacagtgtaaactacactggcggaagctagggttaacaaatcctctccgatccatcctcctgagctccacaaaaaccttccgcgcaaccaccgcatcgattccccatccatctccagccatatcttggaccaaatcacaccatccaattcgtattcatggcagaagagaaagaaagcttcgagtgtcagtgggcgccctccgatgtaacagaggaaaacctgaaggagatggtggcgcacggtgttcttccggcgaaggagatcattggatggcgtccagcattcggcgaagcattcccgacccccgacacacatgaagtcgtggtattttctcatttcttctatggaggattttctcttccaacctcaagattcttccggggaattttggatttctacgggattagtttacatcacctaaacccgaactccatagttcgtattgccaacttcatacatgcctgcgaagcttttttgggcatcaggccacattttgccctattccgtcgcatcttcttcctcaagccccaaccgaacaaaagcaagccatgcgtagttgggggagctggatttcaacttaggggaactctgagccaaaagtatttctccatgcccttcaaaacctcaaacaaaggctggcatgcaaattggttctatgtacaaaaccccgagcctgcactccctgagtactcctgtcatcctccagtttatcaggacacttggaattcactaccaatgggagaagaagccgcccaggcgcttgccctgatggaccatatgctgaagctgaaggagcaaggtctgcaaggagaacagatcacccggcattttatcaagagccggctggccccaatcaaagaaagatctcgcacggccttcgaattcgacggcaaacatgaccctaaccgtgaagatcctgaatctcttgaattcaaggttatgaaggagagaatgtataagatcttctcaaatgcaatcgcagtcagctattcgcacttgctgccagtggtgccatacaatgccttcaacccccctccaccgatatgtatttaaaatcccagcctttctcaaaagcatgcttttatcatctacaaagttgatggaaaacttggatcatcatgcccaggaattcgccttgatgaagtcagaccccccaactgctcaacgccactcaccccgtcggcaaactagtcaagctaacggaggaccaaaaatccgatctgactctcaacccagcaccactcaatcggccaaccaatcagacttccgaaagaggaaattggttctgagtgacgaccaaaatgatgactctgaaaaagctggcagcaagagggtgaccggaaaatcaacaaggcaagctaacccgaagaagaaaacatccagtcgtcctatgccaaaaatcaggaagttctccaggtacaaatcatttagccattatccttgtattgatgcgcacttcattattgaaatagcactgatagcataactcaaattcgtaggaagccatctgacatagatccttctggaaaagactctgagccaactgacatggagatgggtccttcaaaagaaaccgggccgactgcagaagatcatccgagtgacaatcagtcggcaaccgacaatgtagaacccagcaacgagcccctgactggaaaccagtcagccgaagctagagtcggtgctaatcaggagcccccggctggaaaccagtcgggtgcagaactaaataaagatgtccctgaagtagaagctcaaatggacagccctcctagaaaggatactagtgctgatccagggtccagctctcctgttaaagtacaagagcctgctcgtccctgaccggaaattattataggtaaacacatcctctgaacccattttgatctgacaggctttcttcgattgtttcacctttattcatgaatatacaagggccaatgattggtgatgaagaagaggtccttcagatacgatcggctgaagattctcgcccacccattcaagtcaagtggtgggatgacgacatgcaacctcagggaatcatgataaacaagcaaaaggaagacgaggaagtatgtctgctgaaaaaggcactcgggcaagctactcgtatcgtaaacgtaagtctccctatacgcagcttcaaccatcctgtttgccgctttgcacaaatgccgacaaactcgccttgcagagaatccatctcaggaacgaggcgaagactgcgactcttgaaaggctagttccccatcttggaaccattgaggccaccagaaaccagctgcacgaagctaaagagcttgctaggaaaactgagcatgatctaagggatcggattgccgagctgcaagactccaactttgaactgagcggttcatgaaaaggtaaatacaacctctatccaacctacttatgctaccatccttgtaatatcaattaacaagaagaatacagtgcaagctgccaagatatttgaattggaaaagcggatccaagctctggagaatgacaaggccgaattggcgagacaaagggactcggctcggaaagacgttgaaggtactggtgactaatactccaaaaaccattcctttctttatgcccactcgttgatataaatctatttatgcagatcgcaaaataaagtcttaggctcaatttaatgtcttggtcaacaaaatcaagaggcttgaaggggctagggatgaagtcgccaacgctgctaccccactcatccaagccatgtttttcaataacaatggtccgagtacatttgatgcttctgagattttcgacaagctgagaattgctccggatacatactttaagaatatcaaggaagctggaagtatgggagcaagcctggcgttggcaatgaccaagtctttatacccgaagattgatattgacgccattgatggctttgcagatgggacgagcgaagaggccgcccttgacctcatcaacgatgcgcagaaagccgccaataagatagccgttgatgtagttgagagattctaggacaacgaccttcggccgactggatctgataattccaatgataaaaaaactgacaccgactgatgttgtattataacaatgattctgatgatgaagatgatggaggcacaatttgtacaatactgatgaatttatgctgtgcttgatatttcaaacttagctcctgatttcttaaaagcttttgtcaaaccttattgagcctaaaacccgcaaaagttattaaaaactttcagtcctcattgactaagccaaaaaatcaaacaaggcaatgataaatcaagtaagcaaattgaattgataaaaatcatactctattattattatagtagccctcgactgataactcaaggaaaaacatgatgttatcagtcaaagagggaaatacaaaagtaatgcctaagcataaaattgacgaagatgttcgatattccaagaattgtcgatggtagtaccatcttcacgcttgagtcggtaagaacctggccgagtgacttcggaaattatgaatggtccttcccacaagggagataacttgtgtcgatcccgtgtagtttttctcagaaccaggtcgccgactaaaaaggctcgtgattgaacattgcgattatgataacggcgcaacccttgcaagtaccgagccgactgaattaaagctgcttcgcgggcttcttccagtcgattgagatcatctactcagttatctccgtagcgctcttcgttgaagttacgaaaacgtaaagattcaaattccacctcattgggcaacatcgcttccgctccataaactagaaaaaacgtcgactggcccgtggcccgactgggagtggtgcacagggaccaaagtacagatggcagctgttctacccacttgccggcatagggatgcagtcggtcgaaaactcgcgcttttatcccttgaagtaccatgacattggcgcgttcaacttgtccattactcatgggatgcgctacggaggcgtaacaaatcttgatgccgaagtcttcacaaaagtctttaaatactccgccagtaaattgagtgtcgttaacagtgatgatccgattgggtaccccgaaccggtgcacaatattgatgaagaaatctctagccttgtctgccatgatagtgatgaccggtttagcttcaatccacttagaaaatttgtcaacagccacaaagaggtgagtataaccaccgactgcctttttaaatgggccgaccatgtcaagcccctaaaccgcaaatggcgaagacaacgggatggcctgcaactcttgagctggtagatgagtttgtcaggcgaaaaattgacaaccctcacatgtccgcacaattttatcggcgtcggccacagctgtgggccagaaaaaaccctgccgataagccttgccaacgatggttcgtgcggtagcgtgattaccacagatgcctgaatgtatatcttttagcaattgcctaccctcttccaaagacacacagcgttgcaggattcccgatggacttttcttgtacaacccggtctcatgaatgacatagagtctgctgtacctagagatccgctcggcttcatctttgtcttgagagagtttttgtttggtcaaaaatcttatgaggggctccctccagtcggcttcaatcatacttacgtcttgagtgtccgtggcttcaataaatactttcctcggtacggttggttcgtaaagatgttcaacaaatacgtcggaaggagctgcttctcgttttgaaccaaaattagccagtctgttggctgcctcattattatgtcgaagaacatgggtgtgttcaagtccgtcgaatttgtcttccaacttgcgtacctcctgtcggtaggcggtcatgttataatcaaggcaggaccactctttcatgacttgattaacaaccagctgagagtctccatgaactatcagacgccggattcccaaagaaatcacaatccttagtcacgttgtgagacacagaaaaatgtatccaaaatacgtagctcagtctttctccagtcggggaaattagaacaacccccgctccagtgtttgagagcctcttcgacccgttaaaatgcatggtccaatactccatcttcttctcaggcatgtcttcttggcactcagtccactcgtcgatgaagtcggctaaagcttgggacttgatcgaagttcgcggcttgaaagatatatccaaggacatcaattataaggcccactttgcgatccgcccatttgcttcgcgattatgacgtatatccccgagtggaaacgatgtgaccaccgtgaccgagtgaccttgaaagtagtgagatagtttcttgatagtaattaaaacaccatataatagcttttgaacctgaggatatcttgtcttggaattagccaaaacctcgctaacgaagtaaattagtcgttggactttttggacatggccttcttcttcacgctcaacaaccaggactgtgcttacaacctgggaagtcgccgacacatataacaacagcggctctcggatgtggtgaagctaggactggtggagtagtgagaagttgtttgaagtcttcaaaggctttttgtgcttcgggtccccactggaaattgtctgttttcttcaacagcttgaaaaagggcatcccccgctcgccgagtcgcgaaacaaaccagttgagcgccgccatgcaaccagtcagcttttgaacatctttctgggaacttggcggcttcatgttgaggatggcattgattttccccgggttggcttgtatgcctctatgagacaccataaatccaagcagcttccttgatggtactctgaagatgcacttttcagggtttagtttcatcctaaaagcgcggatgctcgcaaaggtttcttctagatacgtgatcaaatcatccttctgtttggtcttgacgactacatcatccacataagcttcaacattgcggctcatctgagttgaaaaacatctctggatcatgcattgataagttgctcctgcgttctttaatccaaagggcatggtgatgtagcagtaggccccgaagggcgtgatgaatgaagtctttaagcagtcggattctttcagtcggatctgatgatatcctgagtagcaatccaaaaaactgagtagctcgcagtcggccgttgagtcaactacctggtcaatgcgaggtaacccaaagggatctttggggcaagatttgttgaggtcggtgtaatcaacacacatgcgccattgtcccgtcttcttccgaactaagactgggttagccagccagtcgggatggagaacttccttgatgaagcctgctgctaacagcttggtcaattcctccttgatcgcatccttcctatcctgtgcgaagcggcggagtcgttgcttgattggtttagcgtcttccttaacatgtaaagagtgctcaatcacctctctaggaatactaggcatatcagattgttttcatgcaaagatatctttattattttgaagaaaggtgacgagcgcgctttcctatttacaatctaactcagtgcctattacagcagtcttagtaggatcagagggatctagaggaattttcttggtcttggcgtcgctttttccactctttggcatcttggttgcaggcacttctccttcgcttgctgtggacgcagccagtcggatttcttctcgggcgatcgtgatctcgcgggtctaggccatctcacagctttccttgtcgcatgtgacggcttgtttgatgtcacttcgaagggatatgactcctcgaggaccaggcatcttcatcatcatgtaggtatagtgcgggacagccataaacttggctaacgccgggcgtctgagtatggcatgatacgctgtcttgaaatcagcaactttgaagcaaacattttctgtgcggaagttctcccgagtgccaaaagtaaccggaagagtgatctggccgagtggtgtagcggatagccctggaatgactccgtgaaagggcgcattactcggctttaattccgtgcgagggatctgcatgtcgtccagggttttggtgaaaaggatgttgagtgcactgccaccatcgatgagggatctgcgaagcttgacgttgcgaaccactaggtctagtaccagggggtaccgccccgggtagaccactcggtcaggatgatcggagcggtcaaacttcattgttgtctccgaccaccaaagaaattggggcgtatcgggctgagcagcgttgatctctcattcggtcagcttttgcttactcttagattcataagccaggggtccgccaaagatgtggttgagttccttgtgatggtcttgaaaaccagtcggggcatcatcgtcatcgtccttcttcttcgacgtgctttgatctccgtcggaggccttacgtgcgttcttggcgtattgttctgcaaactgtttgtagatgaaacaatcttttgccacatgattggaattgggatgatgcggacattgggagttcatgatcttgtcaaaagtgttgacacgcgaacgttgtcagaaggatggtgttgtagttgtcacaagttcctcgggcttacgcttgcgatccttgtgattggcacttccactcccttctgtagtcggcgtatctttctttggcttctaagtggtgcccgactgcttggacgcgataatggcatcttcggctttggcatactcgttggctttttcaaacatctgtttgaccgtcttgggaggcttgcgcccgaacttgccgactagatcttcgtgacgaattcccttggtgaaggcggcgatgataacgtcgtcggtaatgtcggagatcttgttgcgttgctcagaaaagcatcggatgtaatcccgaagggattctccagacttctgaatgacgttgtagagatcaaaatgtgtatcagggcgttcaaatgtgccctggaagttggcgatgaagtggtcacgaagctccgcccatgatccgattgtgccacggggtaacccatgaagccaggaccgggcagaattcggtagagccacaggcaagtagtttgccatggctttgttgtctcctcctgctacgtgaattgcgagaccgtagacggtgagccaggactctgggttagtggtgccgtcatacttctcgattccagtcggcttgaaaccggctggccaatccactctgggttagacagcgactccatccacatcgtcgtcgtgatccggtgaatggtgggggacgtagcctcgtgccgcgtggcactggttgattgtatcgcgaagatcgacggggcgcctgcgaggtggggagcgtggccgttcaactcggtgctccctgtgtcgttcgggaggcgagtggacagatcgcccgtcgtgacccctgctcctgcgattggatcctgcgccggcgatgctgaaggctcggctggtgatagtcttgagatcgaagatggggaactcggctgccagtcggcgtgcggacgcttgcggagttaaccgggaccgaggcaacgatcatggtcttggtcagggtcaagatgttgacgacgtgattagcttggttgagtgcgtcttccttgaggagggtgtcgagaagggtgatcgctgcaaccgcgttctattgaggggtgcgaaagaccgcagttccctcgacgtcttgctgcacgataagttctcgtgctcgtcgcccggcgtccaaggcccgttgtcgtcggtcctcagcctcctttgcagcccgttcgcgttcctgttgctcacgctgccgccgttctcgctcttgtgcttggcgctcctcttccagtcggcgtcgttcggcttcctgttgtacgcgtagctcttctgcttctcgggctttgcgctgttcccccgtctcgttgtcagccatgaagatgccgaagtagagaggcgtgtagttatcttcaaagcccttgtcgaagtcgtcgaggttgcggttgtcgtagcgatagccgaagttgtcgtactccacgatctctgttggtcgtgagtcgacgccgggggagctgaggtagccgtccagttgttccgtcgaaaccgtgccgagcggctggagtatgacgccgacttccctggagctaggccggaccggggctgaagccggatcccgcctaggcctatggggagaagacacccttgtggtgaagacagtagccaaatcatcggggagtttcatcaggattggcggataggcccaatcgtcttgatcgggtcgtgttgaagtagattggatctcgtccaagtggtttgaagccaactcggtagagttgatcttggggtagaccatggccgagttcgggatgccgaacggagcggagatctggcctcttcccgactggttcgaatccgagtcgaggagagaaatcttaccgaagtcgttggtaatgaagtcgaggctgccgaaacggaacgcctgcccgggagggaagacgaagtcgtcgatgccagaaatgaaacccatcgcactagtcggcgaagaacttgacgctacccctagctggcgcgccaactgtcgaaacaagatttcagcaatactaaaagggggtggctatcaagctggaaaagtggatgggtttagagacaaggaattttatacaggttcaggccttcttaatcaagaagtaatacgctactcctgtccggggattgatccgccgagtgtattattgatcgtatgatctgggtgaaaatcgtgcccctagaggcacccggacccctccttatataggagaaggagtccgtattacaaaatacagtccatatccctaacggaatatgtagttacagataaaatacaatcgtaaccaactaggatctcagatatttccttgacatacaagtttggaatttaacccgagtccttttaaatatattctatctatacatgacaccccatacccagtcagactatacatgccgtgtaggtatggggtatccataaactccacaacgctagagaatgtaaatctacctaggcatcgatcatatctacacgggaaaaaaatcaggttgtgctttctttctcttctcccacatcgcttcgttcttacgagggtttgaattggttcactagaaaaatatcggagggagaactgccgacatggtcgaggattgaagcggtgatgaggtcagccggtcaatggcatggtgaagcgcatctgctaagattccatttacgcagttgattagtgatttacgtagctcacaatttcattcatataagagactagatgagttctcctcctctattcttcttcgagggtttgaataggtgcactcgcaaggagacacggtcatcatggttgagcatttttataatctacagctctgataaaaaacctataggaggcaaaggcgaacatatctctggatatttgtgttgggatacgcgtaggctacaatagcataaatcaaaattttctatcgcgtaaaccaggaaccatgcaagtattagatcatagatcgttaccactcgacgcgctgcgcagcggaagaagacgctgcaaagtcgaaggaactctcgcgaagtagcgcgcgtcgatgtagaggaagtagtcgatcgcaccggctcgaccttctcctcctcgtgcgttctcctcaccgtactcccacaccgatcagcaccgcaaaccagtggcgcctctaccggtatccacacgtacagggacacagaacgccgcacggagatgtgctagcacccgcgcgcggctagggttttgtgtggggagggaagtgacggcttaggtttctcacgtgatgcaatatctccgtcgttcgcaccccttacgaatatataggatccatcactcgggcctccaaggcctgtaggactcctattcggatccctatccgaattaagcttatattggatctccatccaatcgccttattccggcccattaagcgtgcgaccctgtaggttcatgtatactcggctgtaaaccaaaaactccttttcggtccacacatcaacagcggcccctagcagaacgtattgacccaccggacatacataatgatcatatcgactgaacctgtagtgtatacttgtatgaacccatttgcctcacgatatcgattaagctcaaggctagatatgtgacatcctctaatagctcaatcattcactcgaacctgttaatagattatataacttgtgattgactcctcattcacctttcgcatggccatgcacttccataatctacaacatcgaggggcccagagatatctctccataggaggggcaaatcccatcttaattattcatatcccactgcatgtttcatagcatacccgaaaactacttttataactacccaattacggagtagcgtttagcagtccctaagtaagctactacaaatgttgagaaccatgataatctcaggtctaaggattcaacaccaacactaaatgagatcactgatgacacaacacatatggctcttgcagtgtctcatgttgggtctatccaacaacatgttcaccaacatgtgtccacattattaatttggtatctctataccatgatccatgagacatgatcatcaattaatacatgtgctgataatataaacatatttattccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagtctcccacttgcactagagtcaatcatgaatgtatcttatacccattgccctagtgtgtgcctcatgcttagggtgagggagtggctttgtcaacggatctgcaacattcaaatccgtatgtattttgcatatcttcacatctcctctacccactatcttgcgaatgaggtgataccgccgtaaaatgtgtttggacttttgatgcgatctagggtccttggcttgtgcaatggcaccactattatcgaatagaggtccatagggctagaagcactagtcatcacacctagttaagaaacaaatttctttatccaaacagcatcctttgctgcttcagaggcggcaatatattcggcttctgttgtagaatcagccactgtatcttgcttggaactcttccaactcacaacgcctccattgaggcagaacacaaatccagaccgcgatctaaaatcatctttgtcggtttggaagcttgcatcagtgtaaccatttacaacgagctcttcctgtcctccatagactaggaacatatcctcagttcttctcaagtacttcaagatattctttacagctatccagtgactctcacctggatctgattggtatcggtttgttgcactaagtgcatatgaaacatctggacatgtacatagcatagcatacatgatggatccgattgccgaggcatatggaatcacactcatcttgtttcgctcatcagtcgtttgaggacactgattcttgccaagattaatgtcatgtgacatcggtaagaaacctttcttagaatcttgcatgttgaacctcttcaacaccttgtcaatgtatgtactctggcttaatccaattagcctctttgatctatctctatagatccttatgcccagaatatatgctgcttcccctaagtctttcattgaaaaactatttttcaacaatgtcttaacggattcaagaataggaatatcattcccaatcaataatatgtcatctacatataggattagaaacaccagtgcgcttccactaatcttcttgtatacacaaggctcttgttcgtttttgaaaaagcctaacaccttgactacttcatcaaaacgaatattccaactccgagatgcttgcttcaacccatgaatggatttctgcaattagcatatctttttagttgattgtggatcaacaaaacctttgggttgtgtcatgtacatatcctcatcgagatttccattgaggaaagctattttgacattcatttgccatatctcaaagtcgaaataggcagcaatcgctaaaacaatccgaatatattttagcatggcgactggcgagaaagtttcatcataatcaacaccttgaatttgtctgaaacctttcgccaccaatcttgcctggtagatgtgaacatttccatctacatatgtctttttcttaaagacctatttgcactcaatggcttttacaccatcaggtggatcaaccaagttccaaacttgattgacatgcatggattctatttcggatttcatggctccaagccatttctcaaagtttggtcccaccattgcttcctcataggtagtaggttcatcgttgtctaacaacaatatatcacgttgtcctgtagttaacaatgcatacctcgcaggtgtacgccgtatcctttcggaccttcgtgaagcccgtgcttccacaactggttcaacaacaacttgttcaacctgttgaacaacatcttgctcatcttgttgtggttgtgtggacgttgaaccgttttctggtgtttcatgaatttcttcaagtcgcaccatgctcccactatcctttcttgaaataaactctttttccaaaaaaacaccgtgtcaggcgacaaacactttgcccttttcccgattataaaaataatatcctttcgtttccttaggataccccacaaagaagcatttatctgatttaggtgtgagtttgtccgattgcaaacgttttacatagacctcacagccccaaatcttaaggaaagacaaactgggacgcttccctatccatatctcatatggtgtcttatccactgataaccccaaaagcttaccgacagatcagtttggctcattattgatcgcaccatgtccaacaatgtacgattcctccgttcagacaccccattccactaaggcgttcctggcggagtgagttgtggaacaattccacactcctttagatgattaccaaattcaagtctcaggtactctccaccatgatcagatcgtagatacttgattgtcttgcccaaatga

SEQ ID NO: 82116 - DNA, 1633 bp, Oryza sativa
taccgtttaacaatttaaaaaacatagtaatgaaaccgatgtaaaatatgtatccactactacataaacgatattttcaaatgacacccccaagcagtttacatgtactagctcataagtacctcctccctccgtcctaaaaaaatatgggactggatgtgacatattctagtataataaatctagataaatgtaggatgtgttatatccaatactagattggttttttatgggacggaggagcacatctgaaaaaaaaaaactggtttaggccagttgatggaccgttgcgacaacttagatatcaacttagaactgagaggccttgtttgttactaaatgagataaagatttcatttcatgttttattagcatgttttttaagaaaatattagcacgtttttcaaactgttaaacggtatatttcatataaaactttatatgcagaaattgatttaaaatatcaaataaattcattttttaaaaaataaataactaaaactcaattaatcatacggcttttttttattttgcatctccgtacttaatgttattcagcacttacgaacgggaccagtaatttgatcgtttagttggatggagtgtttgttgatattctcagtcttaatcgtaattttcacaatcttacgagtgccattactaattactggtattttgttggagtatgaccagaaatcgcgagccgggggaatcaagagaaatttcctaggactgaaaggacaaaacctgtgagactgtgattcgtttcccatgggaattcagctaggaacaatgtttcgtagcagacaccaaaataacaaaataatatgtagtacatatgaagcgagtgtaactcaattaattaacatattaccaagatcaagtttgaaatttaacatgaatacttgtatttacggttaattatgttttcagtgatagataacgtactcattgactgtgagccatctgtggtgatttcgtcaatttcaaaatatgttgtgttagtcttccagaaatacttataggataggtcgtcgacaataagacacccatcgtgacttcgtcaatctcaaaatatgtcggttcaatcttctggagagatgttgatgggtaggatgtgcgtgtgaatttatatggatgagtatacttgtgatgtgggcgttgcgttgttttcgtccatccttatatgtgagaaaactgtgattatactattgtaaaaagagcggatccgttagtatgatataacttgtaaaatcgcacgggtgtacgccataatgtcattttcactatttcttacatttttaagtttcattttatccgtgttcgaagtacgctggctgcaaggatacactctgcaccagtgacagtgaggccatcgatggacaagggaaagtgtcaggtctcaggctctcagctcggtgcatgggagagaaaacgaacgacacagaggaaattttgtccagaaaaatattaaaagagtgaaagattatatctatttataaagagcgaaaatggtgttgttgtgtacacgcttccatggagcatggcgttttgccaaacggattagttccatgaatcaaacaggccttaaacccttagtcatctcctaagcaaagacatcaagtctaattaa

SEQ ID NO: 82117 - DNA, 615 bp, Oryza sativa
tatttttcaacctttacttttaggtcgctaaaaacaattatataaaaattttattcacaaattacttctcgtttataaatgtgctgggccgtgagttttttttacacctaggagaccacgtgggcccccccacctcctccccgcgttcttcgctggccatgtgggccccaacgaagacttcctcgccctccccgtacctcgtacagaaccggccactgtggcaggcgtcatcgcgtcggcctcatgcatgccgacgctgcccatacaatagtcgcttgccacctcgcctttttttcccgtcgtccgtgccgcgccaagtcgccaacaccgatgcacccggtgcaccgccttgccttctcgcgctccaactcccgcggtcgacagtccacgccgaaagtgtgagccgagctcacccacgccgcgtcgccactgtcgcgtcgcctcgcctcccctgtgccgccatgcctccttccatcccctcgaagccaccgcgtcgccattcgccatggctatagaagccacctcgctccaccatcctccatctttcgccattcccatcgccactaccgtcttcgctctcccctagtcggcccgaggcgcgcggtcgggcacttc

SEQ ID NO: 82118 - DNA, 5348 bp, Oryza sativa
tgaacccctatattattatctccttgtactcccttgcattaatcatgcattctccggtgtgtcttgctgagtactgtggttgtactcattcttgctctatctttctcccctcttcagtaagagaagctttggagaagatgtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgtcctttatatcatgtttgtgtggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttccttttttctccttcccttaatgctatttgcaaaaggtttactcccttcttccttcttcggatttcaactagtactagttggtcaggtcagtgaagaagaagacatcgtcagttgtttgtcgaaactccagaaggctgttggatccgtcagcgcagcaaaggaagcagtgaagccagatgtgaagcaagagtgaagatcttggagaacccgtcgcagaacctaagccaccctctagggtagagtcgttagttgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggttagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctaatggaggtagagtgtctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcggaagcttgctcctcagcgaattgtcatccatgcatcccgaagcagtcctatagcccgcgttgcaacagctccaactccagcgagtgcattaccacagccccagccatcagttgacaagacagaggccagtatcggcattgtacctttggatgttccagcacagcagccaagaaatcaagtacaggatgaagaacccaagcgtaagaaagttatttacaacggtagtacctgttaaggaagcagacgtgccaatcgccaagtggtcactggagcaaatgcagtacctgttaagcctagcgctagtcagaagcaaccataatactcttgtatcagtaatcatatacttatgttttatagttgttccccgtcaatcatgtaataacagagaaacatgagattatgaaggagtttgataagtttatgaaggatccatgttaagatcgcaagtgcggtgagttgtgtacactttgttgctgattagggagacccagggtctcatctccgtaagctcataatctattatgaatcaaataacctcgcgattgatggcgaagaaaatcaagtgatcaaccaaagagacatttgtttggactaagagtttcagatgtgtcttcttcggatcaaaggcatgcacccgttgtggagaaattggacacgttgctagcatgtgtctcacactctgcactccctatgaagaagaccatccaccaggggagtgtcccactcgcaaggtgacatgttttctgtgcgaaggagcaaaccgtgggcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcattaaccattctctgcaccgacagcctcagcaaggaattgtcgtcgatggaaaaagttgtgtctctccccgacctactccaggccaagcaaagggcaatcaacctccggagggcgataccaagcagaagaccgtcatccgcttcaaacagcaatcagaaggaagcttctcctgtgaatgatagcaatatgcagtcctatcacataatcacagaaccaatcaaggatgatgcagtcactagaacaatgccagctatatctctccagaatcaaaatgagcagccatgtttgtggttttcagttcgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgggattcttttggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccgcaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcaatagtatcgctcaacgcattttcctagcaatcgatccatcgagaaagaacacatcaaggctgaaggtgcacaggaatacgttgaatgctaaatgatgacaacatgaagagaatagcggaaagtaaactgaacataaagaaagtgaatccgagctgcttgttcgtgagagccattcccagttatagaaccagtgatatgttcgaagatagtctacagaggtcagattaaaatcacctctaacaacgaagcttcagatctggcaggatcacgatcagacaataacaagtccagcagcaaagtcattcgggaagacgtcaaagcatgtcaagcgggataaattggttctcttgggaagcataacttatagttagagtggttgaccctggaatcgaatagcagaagtagctagcacccggagaccaggaaagctaatatgaggcagttaggggcaagttgccaaacatgatatcctagtaatgacaaagctgatgtcgacgcatgtcacgaaggtggtaactggtatgaggttgacgccaaagatatgaatgataagaagttctagaactgaagccccatcctcaaccaccgcagcctagtctgagtcagttaaaggtgcaaccagggacaagtcgggtgaagagaagatttcttctgcaacaggagatcgagccaagcagtccagagcggaagaagtcagacaagaagagaagaccgcccaacctatcttcttgctagcctcctcgaatctcggggacgagattcttgtaaggggggtggatttgtcacgtcctgataaattcatcccgaaattaaaaatcattctctaaaaggaataatagaattagttaaaattcgaaaagaaattggtaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggtttataaaaagaaaaatctctaaaagtcttcttttccccccttcctctcttgggccggctcggcccaactctccctccctctctctcctctccccgcggcccatcggcctcctccccgcgcgcgcgccgctgacaggcgggcccgcccgccgccctcgctgacgggtggggcccacctgtcatcgccttcctcccgccgctcccgccgctcgcccgtgccctagcgccgccgccgccgcagattccgccgcatcccaccgtccctgcgcgccataatgaggggggaatcattccccgcgattccctctcccgtttcccccgtttttccctctctctctccctcggattcgtccgatttcattcccgaaaccctcgccggcgcaatcaatggcggccgagatctccgcggccgattcctccccctccggccgttctctctctctcccggcgctatataagcgttccccgtgctctcctcctccgttttcgccactcgccgactatcctccccgtcggaatcgagcccgcaccgtcgcaccttctctccgccgtcgccgccgagctccagatcgccgccgtcgtcgctccggacctcctccccactcgg

SEQ ID NO: 82119 - DNA, 520 bp, Oryza sativa
cgcccaaacttgtcaaggtgccaagctagaaagtcttcttcctggcggggagaaagacaaatcgataagattaactcagtgtctatgttcaggaagcacctcctgatctgtgcaacatcccaggtaccatcttgccctattaaatcagagacccatttcagtctgcaatttcctctcatcgtcactggtcttctcgagtgatcccgaggaatccaagggtctctccacatgcgtatagactgaccattaccgaccctccaaattatccccttcttcagtaactccaacccatagatgatagcccgccaggtcggggaagaaagcatactatattattattgtgtgttcaatggtacttcttttctagataatgagtgttcaattgtacttacagctcaagtaaactcttccatgcttggtgaagctccctcttttggaagcatgatagcaccgaattttgacttgtacacactataatctttcatttcatggagccgcatcactggtttgctgaccgcag

SEQ ID NO: 82120 - DNA, 17591 bp, Oryza sativa
cagtagagttttctgcggagcaacgactcgcggcttaacgctccggaagaaagcttttggattttctttaaagttttccggcaagttgaaaccagtcatgcactactctgttttcacaacaaaaagtgaaaacaaccaaggttagcctgcaaaggaaatgattatacagaggtaaatataaagtattagttcaagtaatctctattatgaatcttccccgccaacggcgccagaattgcttgttggtatttcttaacggcattacaagaaatataattcccaacaatggcgcagaaatatttctggtatattatggttacagagttcatccgcaagcgcatggatataccattgtagcatttcaccttagagtattccaatggtatcgtatttattttatcccgtgggaagatcatgtagagagaactcaactaataatttatatattacttgtgataatcatattttaagcaggggttaagataatcaaagggtagagtgacacacaagcattaactactcatcctcataatatatcatctaagctaagtggaaagaaaagagaaaggaaatctattcctatacgtctaatatatatagtatacatacattctagttaactgatatactagctaataccctttatccgatgccctcctggtacttcaagaaggcacccctgactgccgagttccttacgacagcccgtcatgaccatacaaccggggctaaatacggaggaataccctccccaggaaattaacttaggattatatataggcgcggaggaatacccgtattgagctgtcgccatcagcggcccacctctcatccgcaatatataaccccaaataatgatatcccgtaatctagacaccacgtctaaactacccgatactactctaatatcatcgtcatgaccactctaatatcatcgtcatgacctagagtaattgcataagcaaacactatatccgcaccaaagcatctcctagataagctagccgtatatttagtataataagaacataatataaagtaggtactcatatactcggagaatatttcaataccataaatatatatagaagagtattctaataaaagtacaaagcatacaaaagagaagagaaaagctactagagccatacccgaactcttccgaaggcttacggaatcctgactcctattctatttctattccaccagctaggtactactaaactaaacttaagagaaatgagagagctattgcttgaggtgtgtgttgaagttaagagagtgaagcctttatctagaggtggttatgacggttgtggaagaggaattgtccgaagtaccctccaaccgtcattggggtgcaatcttggacgtccatgccaaaccctggcctcaacagtggagatgggggttcgcccgaactccctggttcggccgaaccatgggctggcccaaaccagcccatcttcgcctggcgaattcctctattgcttcacttcgtagacttgtgaattttggcctaattcatcgtgtcaattctgagttcttttcccattcatacataagtctggttctcgacattgtccgattgatttatcgtctatgttgatgccgattctcctccactttagtgtcattctctacaaaggattaatatacctaatactagtggaatattattattctaacaaacatatgcattgcaagcatcactagttctctcttaatttggtaatattgatggtcgaaactgatcgacaacgaccgtcaacagtggttgcggtatgactaccttaattaggagttgaattgttttctttgtagttgttttaattcagattagacaattgcacttaaattataatgtaataaagcttaggttttttagcagtctatattctttcctttccccctttttctgtccatccccattcagatggtgaacacaaggaatggcgaccatgcaacaggtgatggtagcagcagtgaggaatagactggaggagccaataccagtggtgcaactagcaatggtccacctccaccgctagagaattcaacaatcgctcaggtgttggccaattagacgcatatcatacaatgatatgcagcagatgcaaaaacaacaccaatatatgcaatagcagatgatgcaccatcaggcactgcagcagctgaatcagcagtttggtccaccaccaccacattagtccaaactactttagtttctccatgtcaggccacccactttctccagcaccatcaacccaatggaagccaatgactggcttcatgccattgagaagaagatgaacctcctccggtggaacgactaggagaaggttgtctttgccacgtacaaacttcaaggtcccgcttctgcttggtgggacaactacatggtcacccgctcagctgtgacatatgtcacttgggcggaattttgccgtagcttcaggaaggcataggttcccgatgggactgtagcacaaaataagagggagttccatgcgcttcattagggaaacaagatagctatagagtacctacacgagttcaaccgcctattattatttattacgacgacagaataatccgcaagcgcacaaatacagtcgtagccttcaccccaagagtattccaggatatagtatccacaggcaacgtatgtgtataatctaagaacgagattcttccaagggaaataactatatggtaggccaagaatagagaggattcctatgggttaattatcttaatcaagttaagataaaactctatcaattgcttcaagcatcggcttacccctggtctgccaaggagactctggctatggctctatgatgtacccgaatactgtcaccacctgttaactacctctacaacccgtggagcacacatcaaacaaaggtaatctctagcctagacatcgtgtctgtgctattgattactatcctaatcccaacgtcacagagaagattaaggtagtctacctaagcagagtgataaaactaaataaaattaaataccaaaggagatcacaaatacttacttataaaagaagcatccatcgaggtacaagatcggagggagtaccggcatcttcaggactccggcactcctccagaactcccctagaagaatgccaacatatccggcacttctccggaaccccggagagatgtctgaaatttggtgcactcctttcggagcttccccattctattcctacccttaaagagcaatgcctatgtatataagtgaagttgtagtctgcttgttggtgcaaatttgaagtgaggagtagaggggctacttataatgtggatacgacttgagagagtggagatgctatggaaatattctcctccaactcctctcaaacctccacatgtcctccagccgtcattggatggcagtttcttgcgttgagccttgtgccaccgacttcgggatagtgataactgtcaccacatggaagctgagcacgagggcagccattgttgacagtcattatagaccaatttcgaccgttaatacttccggaaataatggagaactagcaatgcttggatgcatatttacttagaaataatccaagtccacttgtacttggcaaagtatttgaatacagtagattacttcataaatggagaaatgatggaaattcaccgttcaaccaatcagagcccaacatgtggcagacatggatggatggatccacaaactcattagaacatcttcaaatgggcccaaccaccatgccactgggccaaggagtaaaatgtcagggcccaagaggaagtccacagccaggggggctggccaggggtcggcggacctctaggttctgctgaccccggcatgtcccggcccagccacaaccggctattacggtactactgacttttctatagtggttgtgaccggtattgtcgctcctaaccgtcattgatcagctataaaaggtcctcacctcctccatttcaacacacaccatgaatgattcaggtgaagaagctctctagtttacttactttgctccagtgctagtagaaattagaattataatagtcttctctagttcttcaagtcttccggagatttcgggtatggatctagtatctgttccctctcttgtaagactttatccgataatgaaatacttttctttatctagttttggtcctttactatacttgcataattattcgagtacgaactttagctcatacttgtctcgtattaaatatgtagttagcttaccagagatatgcaatagtattgtctaagtgtctatttatatagttgctctatgtcatctgtagagatgtagagtaatatttagtattgtaagcgtggtgcttagattattagatatcattaagtggtgctatatgccacggatctgtagaggtaggccgctgatggtgacagctcagtatgggtattcctccacgtgcgtaggtagggctaagagaggttcttgctgtgggtactcctccgtatctttaaccggttggatagccatgacggattgtcgtaaggaacccgacaatatggggcggtttctcgatataccagggggggcatagttagggagttattagccacagagttgtacaatagtaagtgtatactaaatgactatatactagaagtgcataaatgatgttgttctaatttcttctctatttagcctagacttataatttagtgagagtattctaaactgaaccttttatgtttcaaatctatccttatcctcaattgattaatccctgcataagactttgatctacataagtatgataagaatttatagcatattactatcctaccatatcttcccttgggattaaataaatacgatatcttggacgtacttccgggtgaaatgctatagcggtatatccatgtgcttgcggaattatttctttaacccatacgattaccgtttaatatttctgacaacattgcttgggactaagttcctagtaatgttgttaagaaatatcaacagccatccctagttcggccaaacctagtcgagccgcctcgtgccaccttgcacctgggtcactgcctagtgggtcttcatgatggtgtacggtggatggccttaaatatgttggttttactctgatttttgggccatccaatctgtgtattcacgtctgattagtatatttcatcgcatgtcagacggttttcctccataattcacatgcatacaaatattcaccaagacttgtggaactagttagtaatatccactacctctaagtttagtattcaattttatattctttaattttctttcttgcaggaattggcagtcggatttgacacttaaggatctacaaacatcgcctcacacgctactctcctgttgatgtgcgcaccgatgccgtgaggcaagagaagtttatgtttggtcttaatgatgaactaaccaaccaggtcatctatggagattatactgattttgagaagctatttgacaagttgatttgtcaggaggatcagcgcaaccagatggatcgcaaaagaaagggagcttagttcagggcgcgtcaggggaacaaccaaaagcctcgcttcatgactgataaatttttaagtttagatcagccatgcaaagatgataattcttctaattttagtaaaattttaggcttgatagaaattgaatctgtgatgtgttaatttgtggatgaacaattgaaattccggcacgaagcagtgaactggctgttgacggctgttaaataccaaattctcgccgtcaatacctacataaaactgaaagtataaaatatctgaaagtataaaatatccaaaatagtggtaggatatatttctaataatttccacgagtgttggtgtatatttagatgtaggtgacaaactacctaagttgagaagaaatatacatgaaggaggagaatcaaactcatattcaaacttatggagtttcggaccaaaaacccaattaaacacctccaaatgggcccaaccaccgtaccaatagaatgaggtacccaatattagtgctcaggaggaaaaacggggccaacggagccggccagggttcagcccaaccctgacagaggccactagcccaggcccaagttgagttcggtagcaaccgctccccaatgtgggtttctaccgttttcggctctccaactgtcatccaaatagacgcttggcttgaggagagtgaagatgctcatatgattccatggagggtctccacactccgaaggcacctccaccaataaataccactcctcatccttcattccaactcacaccaagatgtagcttgagctgaattataagaggctctttgtatgatttattttacacatagaatagggagagtatggtagaagaaatcggacgagttctggagttgtcggtaatctcctcttactttttgtacattgttaattactctggtttaatagaattatcttcctgagtaattaagatttacttcatgtgaataattcttggttattttctaattagcatgcgggatcattgttcactaaagtccattaatttattgtgatcgctttagaatttagctagcactaaagtagttattaattgaatagacgcagtatctgggtaattaatttccggtgattccttcgtatcccacagtaggtttgagatcggtgtagaggtggtgatagccctcaagtacactaaagtcctccatgtacgggtatgtagtagagtgacatttgggagtagcgagctggccagtgcctgaagtatcgcattaggattaaactgagctttctgtagacaccgtttctcactaggaaatcatctctaccctttgcctacattttctttgtgtccttggatgaacctgaagaggaactgaacacacacgttccctatggaaatagataccttggaatactgccagttgaagtgctgcatcggtatcttccgtgcacttgcagattttatctgtgacattaagaaataccaacactggcttaatgtgttcttttaaaagtaaatctcacttaaccctaggtactgtgatctaagttgcacaaaaccaaactattgatcattttactttgatctatccttttgagttctacaattacatcttaaattgataaatttatgagtttttttaatccatcatagaaattttacatggatgtaactaaatcattttaaaattttgaggagtatgtaaaattggttaatgatgtggtttcgtgaaaattggttaatgatgtggatttgtgtcgtgcaccaaaatccctatgattttgtgtaactgttgacagtcgttacagacaaattttgaccgtcaatataactaaaataatggagaattagctatgcttacaatgcatatttgttttcaaataatatagttccacttatacttggagaacaatatgttgcaggaatttatcaaataaaataaagagaaagtggagaaaacctcactcctaagcaagcttatggatgagagggctcagaagccaggtgtaaccgtcctggaaaccgccttaactacaaaaccgtcaataggacccacctgtcaaagactgtaccgaagctggaggcctgttgggctagcccaggtttcggccgaactggcggtgcccaatcagcctggccctccacgtgtacgatccggatgcactcttaatgacggttgtgagggtaaaatgcacaattcgcattggtacaaccgtcataccggccctataaaaggaggagctcattcactctctcaacacactcaagttagctcaaattcctcttcatactttagtattagtattttagtgctaagtggagtagaatagaatagtattcggagtcctcggagtcttcgaaagagtttcggtatggctctagcagctcttgtattcttttctgtaatactttcaattttaatgaaatattcttctttatatatcttcggtactttgtttagtctgagtactgttcttaccttatatctgtgttgtaccgattttgtgggtagccatccagagaggtgcaatggtgcgggtttaatgtctgatttatcagtttctatgtcatgtgcacgggtgtagagtagtatttagtaatgtaagcacggtacttagattattaaatatcattaattagggatatatgctgcgggatagtagaggtgggcctctgatggtgacagctcaatgcaggtattcctccacgttagtacatattcctaagagaaattcctggggagggtactactccgtatttagccccggttggacggtcatgataggttgtcgtaaggaactcggcaacccggggtggtctctcgaaacaccaggagggcactgttagggggtattggctacatagttgtatactagcagatgtaaactaagattgagtgtatagaagtataggaattgattgcttttctatttcttcttccacatagtgtaggattgtttaatgagagatatgagttctttgcttcgtgtcactctaccgttatgaatatatcaacccctgcttagactctgatcatacaagtagcatatatacattattagcatagttctctcttacaatgttcccttggcattaaataaatacgataccttggaatactcccaggtgaaatgctacaatggtatatccgtgcgcttgccgattccttctataaccatatatatactaggaccatttctggcgtcattgctgggaattcatatttctagtaatgtcgttaagaaataccaacaaggaccaaaactatataaagaagaatattttattactggataaagtcttacaagggccatacccgaattctccggagactcgaagaactaaggaagactattctaattctaatcctactagcactagagcaaagtgagtaaactaagagaactttttcttcttgaatccttcttggtgtgtgttaaaatgaaggaggggaggtcctattatagcttgagaatgacggttgggggcaccaaaaccggtacaaccgtcattgggaggtcggtagtaaccgtcattggcttgggccaaacaagaccctgctgaagcgaacaagataggttcaatctactcaaatcgtgtttgctcagtacaggtattcctccacgttagtacatattcctaagacaaatttctggggagggtactcctccgtatttagccccggttggacggtcatgataggttgtcgtaaggaactcagcaacccggggtggtctctcgaagtaccaggagggcactgttagggggtattggccacacgattgtatactagcagatgtaaactaggatttgagtgtatactagaagtataggaattgaatgctttctaattcttcttccacttagttagaattactttattatgaggatttgattagctttgcttcgtgtcattctacccctatatgaaaattaacccctgcttaggctttgacaattacaagtaacatatgtataaagtgtattagcatagtccactcttattatcttcccttgggattaaaaatacaataccgtggaatacttccgggtaaaatgctacaatggtatatccgtgcgcttgcggattacttctgtaaccataaatataccaggacaatttctggcgccattgctgagaatgaatatttctagtaatgtcgttaagaaataccaacagtaacttagatataattctataaaatttaccttttctcacagaaatcacatatgtgccgatttactcactactaccgaatcaatttttcagatgagaccgcttttaggttgtaggcagactataattatcaccgtatgcaaaaatcgctccccctcggatcgttcaaggacagcttacgaaaatcaattttcgcatccgggtgtcttaacaggtccaccctcatcaaaaaaatacccctctctcttggcactcttttttctcccctcccctctctctctctctcccccacttcaagtctcccctccactcaagtccggcatctctccctctcctctccccacactactacatataccctttttccaaatagtcaaaacacatttttgcaggcaagcaaagcgctcacccactcgtagatgtctatgaagattagtaattttcgaggcgcctagctgaaccgcatgcgaaaatgaattttgcaaaaaacaaaatttggcaaaaaaattccgaaaatatcaaaatctagaaaccctagccaacccaaccatactgctgtcgtcggtgtcactatcaacgtcaccacagactaaagcacgcttctctgcttccctcgctggagtggatggactggtctttgctgctcagcgacgtcctacttgccatcgtcattgtcgccatcgcaaccgaactcgttgcctctgctcccaccgtccccagcttgactggatgcatatgaagctcccaagggcgccggtggtggatctggccctcttgaggccgccgccgccggatggacgatggagaaggagaggcgagggaggccagcccctcccgagttcaacggcagtggatccgcacctcttgaggccgcatccgctagatcgatgatggaaatggagaagctagggaggcctgctgctcatctgaggctagtggaggcatatctgaccctcctatcaccagtaacggtagatccatcgaggccgatggtcacccctgtcaccaacattaacatgtgcctcactgctgaactcacctctacatcgcactgtcgtcgacgccgagcttctgccgagagagagatagaggaggctgaggtgagggagataaggtgaagaagaaaggaagtggaggagaggatagtagaggacgaggatgaggaaaggacttatgcattttaaggaggagctcgacctggagggctagtggtaggtgggcctcttaacaggcctgcccgcaaaaatatgtctatttcgcagttaggcatgttaagatgcccgcccgcgaaaattgatttctgcatgcggtccttgaagcgtcctcaggggagcgatctttgcatgtgagggcaattatggtctgcctacaacttagaggggttctcgttaggtaaaatcgattttgtagtagtgccacccccggcaacggcggtctcggatgagagcggcgatggtgggtccagcgggcaagggcggcagtctcaagcgagagctcgggtggtggcggtggcttgcaaccatgcgaatcccgtcgacggcggcaacagtagtgccggatccagcacctcctccccctcccgtgctgacctcgccgcctctccaatgacgatgacggtggcagcagcagcgacgatagtggatccaggcacgatgacgacgatagtcgatccaggcgtcgcatcggtgatacattctagggttttgattttttttttttttttttttttttttttttttgcagttggatggcttaagtgcccatatgtgaatgccctacccgtatacaaaattctgatactttcacagacacctgggtgtaggtgaaccacccacccgctgcaaaattgattttgactatacgaataaatcgttgacgtagtagtagtgagttaatactgttgtgccgcttattgagtaccggttgggaagactggtagagagttttccaaccggcattgcttacctcttttttgggtagtgctagcttggtcgaggaggttttgagaaatggtttcttcaccgtggtaaataacaaatgaaacagaaaatacaacaggacacagacatatcattgctactatctgacctcgttatgataaccgtagcccatctagcacgtcgcaacaagactccaacgtattatgaccatgcacatcttggtttgcaccatcctagctatagcacggctcatacaccaactgtctagaaacttccatgccttatgggcgcgcatcactgcataaatatcttgtctgctgtcatctatgaatatctactaatgtgtcatcaaaatatagtaatttttttctacgaatttgaatatagacatgaccaagtcgtagaaaaaataattagattgcataatcttttatgcagtatcatacaaacatgttaatttgattaatcgctaaatttgccgagtcacaccgtatgtctctaatatatggaatccttgtataacaaaaactaagccattgcataactatgagaaatgaattaaccaaattatacaataaattgaaacccatctaagctttggatgtacgcatcaaactaaaatactatatgtatattagtagcataattgatatgttatgacttccatttataaattaactttcgatctcttccgataatgtaagaagtgaaaatttctagaatttgatacactggaaaagagactaattcaacatacatctcaactagtcatagcaaaaccacaagtgccacagagaataaaggcattttataaaatacctatctgtttgtaaaggcgatttatataagccacatgtgattttataatacccctacaatgttaaagaggcattagaaaaaaaatgcctctacagtattagttaaacacctctaggttttttccttgtagtgattgggaaagataaaattatttaactgtgagagatgacatctatttatttgagtaagagcaaggatagtagtacactataagccaactatgaacagttggaaatattggttataattcgacatattttaatccataaaaacaagataataaatatgacatgtgaataacgaaatggtctagtgatagtgctaatcatgaacatgctaaaaacagtaatagtatcatctaagaacatgtttaacactaagaagaaaataatgatatacccagagaatgttctagaggatgatgagttattggtattgccaccgttgattttgaccttctcaatttagcctcgtccagtagcgttgtttccttctcatttagtagcatcggtgccggtgctagacattgtgatgtagaggaagaagaccttgacgaagagaatgcagtgccaagagcagtcgcgcgtagacgcgctcccgaaaaccttgatcgccctactcaggcgagcggagtcccggaggattgctcgtcccaagcactagtgcgcacaagtgctcgaaaccggggaagtagaggcttagcacaagtggggttcagtaacaagcaatctggcgatctaaccgatcacaggattaactcggcaaagtagcgatctaatctggcgacgctgtactttgatctaaacaaaacccaattgttcttggcggcggctaaaggtataagaagagggggagaacaaccacaggggtgctggggtcgtgctctaaccctagaacgcgcccctaatgggcccaacttgatacacagcccattgggcccaatgaggtgacgcagcaccgtggacagaaaaggactcagtagtaaaacgatgattatggccgctccaaatcagatatggacatgggttgttccatttgaaactagacttgataagctttccatgaagcaattgcacgcccaaattagagttcgcacgaagtcgtggcggccatcagaagttggcactgtgctgcagtccgagtccaccccacgcaaatcctctccccgttggatcctctccatcattcctgagtaaaacaagagtgcacacgtctccgtggtataaagaagaggatgagttgagcttgtggaggcggggatgtatcgatggtgttgatgtcctcatcactctctctctctctatcctcttttcttctacgccgccgcctatgcacggtggccgatccggccctcgcctcctccgccgccaccactctgaccccaagaggctcatcgcctcgctctccggctcgggcctcgaaccgacctcaccgcgcctcctcgacgccgtcctccgccgctgcggcgccgcctccgcgctcgcactccacttcttccactagtgctccctgtcgctgccgccgccagagccgctcccttcctccctcgcactcctcgccaagtcctttctcccgcaccttcgccgcaccatccccttccctcctcgcctcactcccgcccagctcctctccccgtccctcctctcccccgtcctccgccgcctcccgcccccgcgcctcctccccttcgcgacctctctcgctcttcctctccctcctcgagtccctcaccaagaccggccatgtcgctgccgccgagcaactcgtcgaggagctctagcccaggctcccgctctcgctccgccactacaccgcgctactctacgggtggtgccgcatgggcaagcttgatgaggccaagcacgtgctcgcccgcatgaaggcagcggaggttgcctcagacgtcgtcttcttcaacaccctcctcgctggcttcgttgccgacgggaggttcgaggacgcgttcgagctggcatggaagatggagcagcgtggctgcccgcccaccaccgccacctcgcctagccttcacgctgcctctggatctccgcgttgtgctcctcctcgctgtccatggccacctggagagagggggccggcgagcctcttccacaccaccaccgttgccaccaccgccacctcgccccgccttcgcattgccttcggatctccgtgcctagcccccgcgccgccaccaggagagagagtggggtgggcgcaggagaagaaggggagaagggtagaaggattggagaggggggatgacatatgggccccacatatcagtgggtcccacaatatattttttgtgtgaatgacaaatgggtcccacgtatatattttttaaattctaatgccacgtaagtgtcacgtgggacgaataccaagtcaacaccgccacgtcagcgccacatcaacaaaaccgctctccaaaaccactagatagaggagtcaaattgtactagttttagtagttcggggagtcgtcctatccggtttttcggttgaggggtatgaatcagattcgatgtatatttaagggagtcaaagtggactttttccaatttttttgacatatactcgtactacgcacatttcctgtgaggccttattcgagtgggtctcaatgttggcctacgtacgtacgggtgtgtgagcagggatagaggcccatcaaaataggcctaattaaactggatatataatatgattctggtaatcatgccactactagaaaactcattttcggcgtcgtaggggatcgattttcgcaggcgggcatgtaattcggagccaaaaccccgccggcaaaaaaagtacccagggtggagggggcggtccgcctgcgaagatcgatcttcgcaggcgccgcttatatggcccgcctgaaaagaagcccctatatagtcttcttcctccccgagccctgttcattctctctgaagtttctctctcctaaagtgacttaaatataggggggaggttttgaacttcaaatcttcgggggatttttctacggtacttcaaatcttcaaatctactcatttccacactaggtatgcaattttttaagcttttagaccttaatttgtgatggatttattcatgtaaaattgtgaaggaagagctccatgttttttaattttatttcttttgatatgttgatgttaaatgtatgtgtaatacttgatgcctcttgttgtagtggtttaatgtggtaacataaattctcaattttttttatttttgctatcacatccacctcctagttctagatctagatctagatctagatcttgtcatatatagagagaataaaatttttaatgtatatttattcggtgcaatcaaaaaatagttatagtattttgaaatatgccgatgatatgattttgttagattttcctaatgtactaatttggcatgtctgtgtaaaaaaaattgaaataaactttgattttttattaatttacacttaacctttagttaattagttttgaatagcgataagttttttcaataaaccctacaaatttggtattaattgtgcaaatattttacgtgtatttttttagagatatggaaagtcaggaatggatgtatcattggccgaggtttttgtctccatatagaaacgaagtgtctaaatttattggtattgccaatgcacacgctgagaagaacaatatgaggaagataatttatccatatgctgactgtaagaatgaaatagcctgggactttgacgatgcttttaaagtgaaggagtacttagtaactcgtggatttatgggcaagtacgaaatatagacacgtcatggcgaagaacaagtggacaggcctgaaaatgtagtttttttttttgactgaaagtactgccaggtctttgcccaacagtgtgattttcatttattgaaagaataattatagtaaaatttacacgaagaaacaaaagaaaatgaaaaaggtcctataaagtttgcaaccaattagaaacagattgcttcagtggatctttcattctgcaaagctgcagaagaatctcatttgtgaagagagatttccaagaatggaagaaaggctgaaaaatttctaaagatgagtccattatgctgtttccagatatgccatgcagccacgaagaaaatttccagaaaaccaggctggttggactgccatcttgcaaaagctattctttggtaaaattctagattaccattacatgaaattcccaaaaactgccaacaagctttgctaaatggacaattaaagaagagatgatccctggtttccctttggttgctgctgcacagtacacatgatagatcatcatcttgtttggcacagtgtcttctatccaacatatctcttgtattcaatctgtcccagaagaatagccaagcaaagacttttattttcattacacactcggtcttccaaatccagatgagaggtctgggtgcttgaatagaagcaaagttgaccttatagaatcttttgggggtaaaacagttgttattccagatgaagcaccataaatctccccttccttgttccagctgaaggtgtgtcagttcatcttgaagattgatgtattcacaataggcttgataagagagtggcagcatgaagaatcctccaaaggtctggcacacatagcttggactgaatcatctttgtacagagaggaggcaaaaagatgttgatattgctgacatttgaattgatcattccacagatctgtccagaaaagagctgtagtacctgtctttatgttgcatttggcaattcctctaaaaatctccaccagagcaataacatcttttaaccaaaaagatcctttgtttagaagatgagggactttagctgttaggtatgaattagtcacaagattgacctaggggatgtcagctgtggtgtagattttaacaagatgtttcatgagcagggcagcattttggacttttaggttaaccacacctaaccccccccccacttttcttttgggatacaaactctttcccatgaggccaaagattttctggtagattcagggttatttcctctccaaaggcaattccttcttgctgtatcgatagccttgatcacagagagaggtaatt

SEQ ID NO: 82121 - DNA, 4962 bp, Oryza sativa
cagattgctaacccgacacgtggtggacaaggatgaccgatttgtgaccggtctgacactggtcatgttgtcagcagacagccatgttcccacgtcgcgcttgcttccgacagaagtggaggtaggtatgggccgtcccatcagaaggtcattcggacggcaaccatacaaatctccgtccatttatgaagagaagggaagtcaagttggaaaaaagataggataagtccccacacacaaaagagagatggtgcatgtggtatccccttgagatataaaaggaggaccttgcccacttagagagggggacgactctgggaatactggagcaggagaggaaaaaaggaagaagagggtttctagagtaagggcgctcgggctctcgagctctttgtagcttcttcatacacagatccaccaaaacacaggagtagggtattacgcttctcagcggcccgaacctgtatacatcgcccgtgtcttgtgtgtttccattctcgcgaactttctgtcatcttaggagcttagaacctcacccagggcccccggccgaaccggcaaaggggggcctgcgcggtctcccggtgaggagcctcacgctccgtcactgttgtttttgcaattgattttatttgaacccttttctgaaacaactaagggagtgcttctcaaacgacacgggtgagacagtgcgtctcgtccggtcggagtatgtgcaatgtatcagtcttttgaattgattaagattggctcccggccaacagctttcaaacgaccacccaggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaacggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccctggcgaatccacatgtcgcttagcatcatggctctcccgataagctagttactcagccaggggtgtcccattccacccatgtggttgtacttgtcttatgttcggatgaaattccaaggaaacggtccttaagtgcaagagcgggaaaccgtacacccggtatgttccccggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcgactaggtgggtacaagggagcatggtataataattacaatgggagggtcaaatgcaacaaattaggtaggtctgccaatctgccttgcagacgggacaagcagattaagtgcgatcctatcaatgcataatatttttcaagcaacgtaattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagactttcctcgggcggctagggcgcgacctgagagaaaggggcggctcggccgagcttaatgggccggccggcccaagaaggcggcccaaggcacgcgcgcgggcggggaggggagagagagagccggtgggccaggtccatcccgcgtggtcccgggtgggacccgcttgtcggcgactcggctcaccgtgagcgaggtgcatgcggggcgtgctagggtttggggagggaggcgcggcgcatgcgcgcggttcgcggaggacgcggtgcggcgggcccacgtgcaaactcacggctcgcggtggaccgcgcgcacgagggggtggagggaagcggcggaccggggtctacttgacccggtcgcggccgaggtggcgccgacgtggcgcctacgtggctgccacgcgggccggtgggaggtagacgacgacgccggccgaaacggacggcggacgacagcggcgagcggcggagcgaaccatggcgatacaggcgaaggcgagcatatcgggatgttgcacaggacgaggggagacgagccaacggctcggatttgccgggggatgctcgacggcggtggattgcggcggcggcaaccggcggagagaaaagggggaaacggcgatgaggtcacgaggggccgattcccggatacgcggatacgggaacccatcccttgcgccggattaggaggaaacgcatcgagggaggccggcgacgagaggcgcttctgagctcgggcggcgacagcggcgagcacacgacgagcgacggcagcagtcggggcggcgccggctagctacgtgggggctacacatgctactaccgaaaactaaggggaggagatggattgaggagggagaacggggagatgcactaccgagatgaggcggggcgctgtgacgagaggccgacggcacgggagtgatctctccggcctcgggccggggaagtggaagaaggcgagcgcccggagtccccttccgcgtccacgaatgcaccggctctcccggtgcttggcgatgaacggcggaggcgagacagaggggtggcaatggcgcggtggcggcgagcgaaatgggaggaggaatcgatgggagggcgccttggtttataggacgacgatgtcggtttggaaaccgaccttgggcggtcaaggcgcgagctggcgctcggcgctcgcggccaaaacggcgacagaggcggatgacgccggcggggaggggaaaaggaaaaagaagggagaaagggggcttgccccttgccactttgggaaaaggaggaggggatgggggcgacgcggcagagggaggaggagctctgcctccatcccttggaggctagcgcggggagaggcggggccgaggcgatgacgacggcgatgacggccgggcggtttggagcggagcgacgacacgggcggcaggcgcgagcaggtgcggcaggcgctgacggcggcggcgactgaccggtcggccaccatggcgcgcgcgcgcaggaagcaacaggcggcgcggcgatttgggcggcgttggcgggaaacggcagcgagggcggagggcgctcggctcggcgcggctcacgcgcatgcgtgcgcagcgcacgggcagagcgggggagagggagagagagagagagagagagagccggggagggaggggaagatgggccgagagggattcggcccatcgaacccgagggaggcgaaaaagacttttgcggagggatttgatttgggaaggatttggattcgggattgaactcgacgatagatcagggatttgagatctgagatggtacggacactagacaacaagcaaagaaacggatttcgcaaatagggtttttaagagatagttttcccgctaggcgccacgacggaacgggcgctacatagttttatgatacttaacctaaatatgtagttttatgataaatttagtgttaaatctataattataattttaagtacacaatcttaaatttctagtgttgtgatagtttagtcaaagtattaatagttttatgaaatttactctaaataaacaagttagatatgcctatatcaactatatttatattttctagtaactaacttattttttaaaaataaaaaagcagttcaggtttctggcttgtaggccggtacactatagtattctattcccctctctgatcaaaatataaatattttttgattgaagtaaatgtctattgaattttttgacatattttagaagagaaaaaaaaggaaaagcaccgacatattgatggattaaatggtgactgaggtaatatcttttttacttttattttttcccgaatctcaaaatcccttatatttgtagacaaataaagagatgttaggggttacctaatttatattagtattaagtgttttaaaattcttttaagttaaagccctactccgtatcaagtacttcctctatcccattttcctccatcccattttaagtgcaaccataagttttcacgttcaactttgattgttcgtcttatttaaatattttttttataattagtattttgttgttatgagatgataaaacatgaataatactttacttgtgacttatgtttttaaattttttttaaaaaattataaataagacggatggttaaagttagacgcggtaaaccatggctacacttagaatgggaccgaggtagtatcaaacgtcctgtataggacaagacaccttgatattgatgtccattggcatcaacgataatagtatgtccatatcggagtccttaaaaaaatatacattctggaagcctttaagaatcgattagtgctgagatcaaccaacctacaaattaaagcatagactttgccaacatatagctaaccaaattaatgccacaagcttagttagagatgaaaatcgatcgaattttggcttgttgcaaatgtaacgaacaaggtaataaatagcgtatagcgggt

SEQ ID NO: 82122 - DNA, 16199 bp, Oryza sativa
gacagtctcttacaagttgatactcctcctgtagtgagaagaaaatatatatgaagctttcaccaacatgggtcaaaattttcctacactattttattttcggcaatatagctctaggctaaactgtaatgagcaaagtgcgtacaacaaaggaagaaagcagaaaactataccaggctcagttgaccctcgcatcttctctcgatcagctgtcaatgaaaacatattttttttaatactaagacattggcagcaacagataaattgttgagcagaagggacatagagttccattacctgaagaaccttgtatgtgcagccttttgggcctccagagaatgaggcaaacacaacaggtacaggtctaaccttcagttcctggataccaaagacaaattcagcggatttcagtatttcaccgattaacaatcaaatacattggcatgtaagtatgatccacatggaaataaactaaggccaagttgaaagagtatccaacttgtaggagtgtgcatcctcttaaacaattatacctaatgactgaccttaactagttctgcaagcaccctatcagcaagcatggcagccttatcagggaaaaacctgcacaaaacaccaaatcaaatggtatgatcagttcaactcatatatttcacctagattaaatatctattttcataggttttccaagaacaagcaacatgatatctcccctggctatccggcatacgccagttcatccaatttgccgatctagaattcttgaacagaaatatagtcctacacacgactaactgattacacaggagaacgaattttgctgtcctcctattccaatcctgagaactgaacaaaactaaaattctaaaaagcttctggaattaatcaaaacagtccaattaatcaaacaccctaaaatttacactcatcaactccaaggagtcggtgccaggtgttcaagaacacttggaaccagaatcaagacaaaaatataatctacttccttgcacgcctgtacaatatcatagtactatcatctaaatcattctcccacatccacgcgccactcaccgacccccaagaaccaccaaaaatccatgaaacaaacaaaaaaaaaacaaaacaaatccacaaccatgcgaaattgccaagatgcagaaagagaggaagagagagagagacgcacagggtgaggaactcggagtggcagacgaggcacgcccacccgagcgccgcgtacagctccacgtacgcccgcacctgccgctcctggctcgacagccacgcgaacatcaccaccaccccgccgccgccgccgctcggccgccggccgccgccccagtactgccgcccccacatccctccacctccagaacaatctagaaccttctctccacccccgccgcgctctctcctccgcttcttgaattgggggaagacgaagagggggagaaggtgggtgtgttggtgtttgttggggtggaatttttggggggcgtgtggcgattaaaagagggcgtggtgtggttggactgtgcgagtatagggtaaaaacgctacggggcacccaggaagttaccacgatgtagtagtgtagtaataatccagtaataataataggtgaaagtgacaggttggatgggagtaaaccccatgacaaacccaggtggtccgtagaaaaaaacttaaatggatattgtttgatgtagagtcacacaaaagaaattgtattttttttaatattgtttgatgttgagaacacttgtactacaagctatgggttatccgttatagtcggagtttttatactgcgaaaaaggtagaaacatgatactacggatttaagtgtataattacttataagagaattgagaatattcatcgtataatgtaattacttataagagagaagagaattgagaatatgtatcgtataatgataattgaacgccgctgcaagctgcaacaacaatagcaatagctgtcgaacacacccaacaatagcattccaatattattttatagaacttttgttggataggattaataattatacgagtacgtatcaccagcaaggatgccatctttatcatccaagtcaaggaaatataggattaccaaagcatattcgatgacagtccaaggatcagataactcatgtgagttaattaggataagcttaaatagtaattagaaatgttaaaacttgatatactcctccatgtgtgcaaaatccctcggagatgagattcaaatgttgaacaatggcaaaaaagtcaaaaggaaaatcattgttgaacgagaccttgcaaagctgatgttgcgttgaataacactaattaatttagacgaatgaacgacgagtctgatgcaataatccactagttcttgctatattaaattagaactaatcacatgcattacgtgctcatgtacgccacgtaaacctgcactacgatcgaaaattgctgtacgtctcaaaagtctcgaaaggattgagatcgagatagaccatccacgacgacagcatcttcgaaaaaagcttaatttatcaacttggagctaattaaagatctacgtcatgtatgaccaatgcaaatggattggatggtgaaatattctaagcaacatttttttaacactacacttattaaccatatatactccatctgtgttttaatagagaatgccgtcgacttcttatcaacgtttgatcattcgttttatctaaaatctttgtacaaatataaaaaatacttatgtgagcttaaaaaacatttaatgataaatcaagtcataataaaataaattttaattatataaatttttttaataaaacgaatgatcacgttagtacttagtagtatgaaagggtatgtgtttttaattagttatcgcgctttatcgtactaaaagttgagctcgttttgctttttttttttctttcaagatttctgatgcacatagcacgtatagtcgaatgcaataatctggcatatatgtggccattaatggacgcattattgaaaagttacatatggtgtggccactaaaataaagtacgcacacgcatgcatatagcttggcaagcaatacactcttgagacaaatgcttagttggtcttaaaattaaaagtaaatttcaaagaaccacaaatatttttgatcaaactataaaagctacatatttaagattgtcacaaaactacagattttgtacgaaatctatcaaagaactatagatttattatacaagtttagtaataaagttatcagaaaattataggtttggtaaacaaaatatcataaaactatagttttagcgccaatttaatctcaacacttgggtgtttataacttaaatataacattagtactatggatttaaaccatataatatgtagttttctgataactttattattaaattgtagtttgtcacgccccgaactagtcccgagcggaactagctcgtgacgctccaaattaacctgttaaccgataccagtcccaggaaaacagtgctggtatcacaggaagacagaatatcacagcaacagaggtctctttattatagagtaggagtacagtcatgttgggctgcggacagaacccgagctcacaactgcattacaaaaggggaacggaagccagacttggaccaaacatcacaggcgcgacttgggaactaggccgaaatcctaaaactcatcgtagccggcttgctcctggaagaactcctcgtcagtgggatccgcttcatcttcttcagcaactggggggattatttatatagagcaagggtgagtacggaagtactcagcaagccatgggaaataagtgtttaatgcaggcttcaagaaagactgtttgtcggtgacatgggaccgggagtactatgacttgaggcttgggcaggagcaatcacccacgtggcctgaccccctcgggggggtcgggcccgagggtgatatggccgcccccctctttgtctccccgaggggtcggaccactcccgtttcggccccgagggctgaggcgccccgaccccttgtgggttttgcgccgcgtgtatgggttaggtgagcacagcggggctcacctaaccgtatttattgcggtttagacgagcgcgtcacgccacgcagtgcagcgtgctcgtctatccggtctgtgactggtcacagaccgatcagatcgtgggttaggtggcgacaggcggtctgacgcacgcctcgccccatcccgtcaggatgagagcctccgagcactcgtccctagccggagccggcgtgttagctcctgaagatggcacgttggccccggtcagatatatgccaggcttcatcctaaccattacaagcaagatattgtatgaagaagggcgaacatgcagattgctaaactgacacgtggtggacaagaatgaccgatttgtgaccggtctgacactggtcatgttgtcagcagacagccatgttcccacgtcgcgcttgcttccgacagaagtggaggtaggtatgggccgtcccatcagaaggtcattcggatggcaaccatacaaatctccgtccatttatgaagagaagggaagtcaagttggaaaaaaagataggataagtccccacacacaaaagagagatggtgcatgtggtatccccttgagatataaaaggaggaccttgcccacttagagagggggacgactctgggaatactggagcaggagaggaaaaaaggaagaagagggtttctagagtaagggcgctcgggctctcgagctctttgtagcttcttcatacacagatccaccaaaacacaggagtagggtattacgcttctcagcggcccgaacctgtatacatcgcccgtgtcttgtgtgtttccattctcgcgaactttccgtcatcttaggagcttagaacctcacccagggcccccggccgaaccggcaaaggggggcctgcgcggtctcccggtgaggagccccacgctccgtcatctggcgcgccaggtagggggctctgcgtgtgtttttctaagctctcgcattctttcgtgtgcgccaagcttttcctgtttagcccaatggccgaacaagcaaaggcgcacaacctctctccgagtgttagcggtgacgacggggagccgaacccacgccgtcgatctcgtactccaccgccccctccacgccaaagtcctaggcgggaggaggcgctcgagagggtcgaaggatccgcgacttcgacatccacgggtgatggagaagggcggtgagatggggagcgtcgcctcctcgtctacggcgacggcagcacgccccagggcgcgctccaagctgcgggcgcgctcctacgtcacccgcccgtcgtccctgacccggagtctccagcccaacgttggctggacgacgtggccaacttggtcatgacggcacggcagcgcctaggtgctggtgggcggtcctccgccaccaagacctctggcgctgctactaccggctccgtgtcgtcaaggcggagggcgcggcgagcggcggctattgctcgccattcggctgccactccctcgtcagcgcctccgacccgggaagatctgcgtggggggccagatgcccgcatcggcatcgagcgccggcgtaatggccgacgtgaagcccacgcaacggagggcgcctcctcgtccagagtgtcacctcaacacggacgcggggatcagccctccgtgcccccggttggtggtgtcggctatagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggatttgtgccaacagttcaccatgaactttcaaggcacatatccgcgcctaggtgaggaagcggacttgcacgcagtacaacgaagggatgatgagtcacttcgctcgtacattcagcggttctgtcaagtccgcaacaccataccatgcatccctgcacacgcagtgatctacgcgttcagggggggtgtgcggcacaaccgcatgctcgaaaagatcgcctccaaggagccccagactaccgcggagctttttcagctcgcggaccgagtggctcgtaaggaggaggcatggacctggaactcctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgtaccgtccacaacacctcccttcacgacctcgcggactgccgcgcagtcaaaagtttggctgagcggacgaggaagtgggaggaggagaggaggcaggaacgccgagagggcaagtccctggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttcaggccgcggcccctactcatgaggcgacgcgccgggcgcggtggtcggaggttgtcctcaccttcgaccagaccgaccacccaccgtgcgttgcccggggagggcagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccaattatcggagtgacgccggagcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcggtccattacgcctacctccagatgaagatgtcgggccccggtggccccatctctgtccatggcgacctcaaagtcgcgctcgcttgtatggagcagcgcgcggaccacctcgccgccacgtccaagcccgagggtggcgacgagaggcttggcacctccgtccccgccgccccgaggcagcggatgatcacatgcgacgaggtcccggtcaaggaggttgccctgggcgacggcccgtccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggtagaaagtgcggcggcaggccccggaacgtcaagccttcatccgcgaggaggtggcgcgacttctggaggccggattcatccgcgaggtcatccatccagagtggctggtgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagtccttactctcggatctagcggaaacttttgagagtctccgctccgctcgcataaagctgaaccccgataagtgcgtgttcggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcatggccgccctaagtcggttcatatcgaggctgggagagaaggcgctacccttattcaagctcctcaaacgctccgggccgtttacttggacggaggaagctgaacgtgcccttactcagttgaaggcgtatctcagctctcccccagttctggtcgccccggagccaaatgaacccttgctactctacttagcggcgaccccacaagtggttagtgcggcgttggttgtggagcgcgatgaggacaatcctcatttcgcgcatcctcaccctgtgctggcttggcccgggagagagcagggaggagaggcccccgagccgaacggtggcccaaggcccccaacgaccggagctggccctctgcccgcttgtcagacggtgccaggtgcccccgacccccaggatggcccgagggccactgcgggaaggccgcacctatcgccctctgaccccaaggctaaccctgtgccgactcgacccaggagagagcagggagaagaggcccccgagccgaacggtggcctaaggcccctgacgaccggagttggccctttgcccgcttgtccgacgacgccaggagcccccgacccctaggacggccccgaggccactgtgggaaggccgcccctgtcgtcctccgaccccgaggtcgtcggcacagaagacgagtacgccccgcgaggccgcttggacgaagagcgcccagggatgcggcccctagcgaagaggatcggccccaccaaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcgcccaaatcttgcataatcgagagggtactggacgagtggtgaaatgggcaatcgaactttctgagttcgatttgcactttgagccacgccacgctatcaagagccaggccctcgccgattttgtggcagagtggaccccggctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatacctggttcgccttgactttcgggcgaccaataatatggcagagtacgagggactccttgcgggactcagggtggcagctggactggggatccgccgcctcctggtgttatgcgactcccagctggtcgttaaccaggtctgtaaggagtaccggtgctctgacccgcagatggacgcttacgtgcgccaggtacggcgtatggagcgccattttgacgggatagagcttcggcacgtgcccagacgggataacacgatagccgacgaactctcacggctcgcttcctcgcgagcccagaccccaccgggcgcctttgaagaaaggcttgcccagccgtcggcgcgacccgaccccttaggggagacggacgtgcctgaccggcccccgaggcccgtcggagtccaggcctcgggacccgaggggagcgctcctagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaatggaatcctcctgaagtgcattcctcgggaacaaggcgtcgagcttctcgccgacatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaattcatcagccggcccaggccctgcagatcataccactttcatggccatttgctgtctgggggctcgatatcctgggaccgtttaggcgggccccgagcgggtttgagtatctgtatgtcgcgatcgacaagttcattaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcccccgctcaccccagaagcaatggccaagtggagcgcgccaatgcagaaatcctcagaggccttaaaaccaagaccttcaacatcctcaagaagcacggcgattcgtggatcgaggagttgccagcggtgctctgggcgaaccgaaccacaccaagccgagcaaccggggaaacgcctttcttcctcgtctacggcgtggaagcggttctcccatctgagctcaccctgaggtcccctcgggccaccatgtactgcgaggctgatcaagatcagcttcgcagagatgacctcgactacttggaagagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaagggggatcgggtgtcaggtttcgggctcgggccaaccccgcacccccctcgggtgtgcagggttggccgggggctaccacatatgcatatttttatttctcttatatctgtatttcaataaaagctttttcgatttcctaaaggctgtatctgtgctgttgtttccttttgaagaatcttgacttgaaataggttactcgtgctcaatcctgccctcgggggctcgggtcagctaaaatcgccaaaaggggcccagaaccgagccgtgcctcggggcgtggtgaactccgggggggaatcggcaaaaacccacaatcgggtcacccataaccctcggtcaccatgctcccggcctggccagtctcgacatgtggatctccccaggcactagccccgacccgcgccttttgaggactgggacctgggcacgagcccttagtcaagctaagacacaaaaggaccacggtacagatcatcctcatctcatacacatagcaaaatgaaattgacacaaaaatttctttattttaattgcagattaagttaatctataaaaaaggaggcccgaaggcctcggaagaaagaaaagaagaaaaatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgctgtccagggggagaagtcgggatccctggcctggtaactcgccagtacgagctccaccgctcctcgggcgaggtccctcgaggatgacttaatcgtcctctcgagctcctcggggagccgttgaagagtcccggccatctccgagaggcgctgggcgaggcccccctggttggcggcgtacttcgcagtccgcccgccccagaggcccgcctgccggccggcgcggtctagacgggagacggcgtctcgaagcatgccgggccctacctcgcctgccaagcgaagggcctcgacctccccggcggacgagtctagcgcgccctgcagatcggcgatggtgtgttcggcagctgcgaggcgggcgactaagtcactttcgcccgcagccgccccgccgctgcgcgccctcgcgtccaattcccttgcctgcgcctcgagttcagcggcccgctggttcagtgcggccctctcggcgcgggcaccttccagattacggcgcgcttgttcctctagcgcagcctcacggagggacgcgctctccgccagccttttcgccgcgacctcagcctcctcgagggctcgctcccgctcgatgagtgcatcttcgcggaggcggagtgtggactcctcttcggcacaggcggcttcgtgcgccgtcagtgtgacctcccgaatggcaacggcggcctcacggtccgccagatccttcaccatgacgcaggaacgctcttccagcgccatggcacgggcctcgagggtttcttcacgctgccgggatgccgcctcggtctccgccgcccgctgttctcgggcagcggcagcgtcaaggaccccccgggcggtgtcgagcttcttccctagctccgcctcccagctcccgtattgaaggcggagggcgtcctgcgcctcgttcatcacggtagtggcgatgagggcagccccccgctcctcctccacctccttggcgatctcccccagcaccttctgacgggcttcgagctctgagacgtgccggcggtgtgccttgcggcccacctccaccatggcctccactgagcgtcgcccctcttcgacacgcgcccatgtggcgtcgagctccgcccgctctgcttgcagggcctccatctgggcacttaacccgtccaacaccgtggtgtttgcgacggccaaggccttcagaaggggatctgcgctcagtggggcagcggaaggcgtgggggagagccgcctcggtgaggatgccgcgcggctcggcccgccaatggacgcgccggactcggggatgtcccccggacctggttggtcccgagcgtcgcccgagggagtgggccccagcgatgcgcccgcgacctcgtcgcgagctgcctcggaagtcgtcgccgcctcgtcctggtgaaatctgacctcctcccgagcggcttcttcagcttggcgagctcggacggccacctgggcagcttcctcggcttcccgaaggcgatccgcggcttcttgccggtcagtatcgcgggttgcctcggaggacatcgtcgcctcggcctggcggagtctggcctcctcccgagcggcttcctcagcatggcgagcccgggcggcctcccgggcggcctcctcggcttcccgtaggcgatccgcggcttctcgccggtcagattcccgcctccgggcctctgcggccgccggatcctcggcctcagactggccggacttggaatggcgggagggacgcgacgggatctcgctgaaacagaagaaagaccagaagataaacaagatgggtgaatgaaaactcgcgttgagaggatgaatacagccacgatgggcgtgggacgaacctgcgaggggatcggttaaacgaccaccttggaggggaaataaggtttccccgggatggttctgtccctcccatcttgcggagccgcttcttctttcgctccccctcgggctgcgacgtcggcgtggtcccctccgggcgcctgctgttggcacgcgccgccccgccccctcggggaggagatgggggaggggttcctccctgcttcctcttccccgggcgtcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagagggaggattccttggggaatgagtgatgcctccacggagctgagattcagcacccgttggaccactatcttgaagtcctcaggagcccagtcccatctgaccccctggtgggtcctcatgtagtcttcggacccggtgtactcccaggcgccccgggcgcgccgctggagcggcgcaatccggcgacgaaggtagtcgccgtacaccatggcccctgtgagcccctgggatcgcaggcccgccaggcggtcgaggacggcgtcatagccatctcccagatctaccggcgcccgcaagctggatgcctgcgccgggggctggctcggaggtcggctcggaggtcggaggcgcgcctcgtcggcgaggggggtgtagaaccagtcgctcttccagtcatcccacttcttgcggaggacgcaggggatgtagcggttcagcaccggcccccgcggctggaagtagcagccaccaaccaccgacggcggcgacactgactgtacggtgaagaaccaccggaacagccgaagggatgggcgcaccccgatgaacatctcgcacaggtgcgcgaagatggccaatgtcattaccgcgttgggggtgaggtgcgccatctggagatcgaaaaactccagaacatccatgaagaaagaagaaaatggcggaaccagccctgccattgcaaaagggaggaagaagacggaccgccccgggtagtctggcgccgggcgtccctcgcccagcgtgactatctcccggccggaggcagattccggcatgaagcggcgcggcagcccggcctgcctctcgctcacgatgcgggaaggcggcagcacgctaccatcgagcagagcggagccccgtgccatgatgccgggagaagagatgtttgagagcgagcgcgtgtggcgaaggtagggcacaggaaagaaggagttagggcgcaagcggcgaagacaaggggaataatggcgagaggaaggaagcaaatcttttcctcggtgtctttatacccttgccaacgctgtgcccggctcctcgcttctcgcgcccactatctcgctccctcgtttctcgcgcccacgcttccactaatcccattcgcccgcttgcggcgcatgaggtggatatgcggctgtggcagtcgagatggaacatatcgtgcgcgcgttaattgcgctcaccgaccgaagcgccatcaccatatctccaggcaaaacgaaccggctcgtcccgattcgcgtgctactcgagtaatgtggcagccttgaagaggccgttcattattgacagtcgagttaccgttgccagagtgcgtgatttgcgaccgttgggtttctgcccaactgtggagaccggtcccacctgtcaccaggcttttggaagtggcgtcacgcccgaccgcttccctcgaggagggcgatcgccctggcataacgccgggggctactgtcggtgacatgggaccgggagtactatgacttgaggcttgggcaggagcaatcacccacgtggcctgaccccctcgggggggtcgggcccgagggtgatatggccgcccccctctttgtctccccgaggggtcggaccactcccgtttcggccccgagggctgaggcgccccgaccccttgtgggttttgcgccgcgtgtatgggttaggtgagcccagcggggctcacctaaccgtatttattgtggtttagacgagcgcgtcacgccatgcagtgcagcgcgctcgtctatccggtctgtgactggtcacagaccgatcagatcgtgggttaggtggcgacaggcggtctgacgcacgcctcgccccatcccgtcaggatgagagctccgagcactcgtccctagccggagccggcgtgttagctcctgaagatggcacgttgg

SEQ ID NO: 82123 - DNA, 1614 bp, Oryza sativa
aatttgtttgcaaatttcgcacaaatacaacagtgatcttttttctctaaaaattgtcaacagcacaagaacgtacagatgaaatatatcttagcaatcttatactcacaaattaatttgtaattttgcctactttttcaacgcagctggagattcatttgtttgtaccaaccaataccttgcaggggtttgggggttttggcagaatcttgtcacgcccggaaattcacaagtaatttccaaacttatttgtgcataaaatcctcgtccaggaatcagccgaggtacacaaactgacaatttaatatacagattcatcaaagaaactaaaacgataaatacttacttatgaggcacttagtcctcatcatgaagaaaactgcagcggaaaataaaatctagcgaagctccggctccactcccacaggcagctcaactggggtataagccaaacgtcttctccttctggggtataagctcaactgggccgactgggccggggagggagagagaaagagaggttttgggccggctttcggcccaaagccaaaagaaggatttaaaaacatttttcaatttaaattatttcttaaatgcaattctatttattaaaaatacttccttagctcaaataaatcccagaaaaatctaggaattatagaattaagcaaagtatttaataaaattttatctagcccaattttatattgagatttaacaaattaaaattagatcttctcttttaggcttttaaaatcatttctaataattccttttaaacaacaatttataatttaaggatttttaaacaagaaaagctcttaacaattataattgatcaaataattactgaactgttctttgtatcatttaggaattgagctctgaaaaatccgagaaaatttcagagagttgacttaatcatggagaatttaataaaaattaaatccatccatgctttagatttaagaaattttatttcccacatttcacttcacttgtaattaaagaacatttcatataaactctattattgatttattagaaaatttttaaatcctgaaacgcaaatcaggatgtgacaaatcggttctgaatattcgcagcttacaagtacccaaggggactagtcccaaccaaacctttctatagcgagcaatcacgaactctcttccttgagaagcctgctttcccaaccagatgaatgtgttcagctagcaacatgatgcgggctatggccgaccaccatgcagaataatttcacatatatcatgcgttagcacaatcggttaggaacatacatgaatttcactgtctaaagtcaagtcaggttgttaggttgttcttgcattgatatggaagagcaaaatcgagtggaagaggggcgaatttgtagggtttgggggaaataccgtaccaaataagcccttcaaaaatctagaaccataaacatacatatctatcatacatgctaacatgcagtatcaatcttggtattcaggtagggctagttcttggtgaatcaaagacaaggaaatcaaatcaagggtacattatatattatatgacttgcacctattgttggttgttgctaggatgaagtacataagtttt

SEQ ID NO: 82124 - DNA, 7442 bp, Oryza sativa
  unsure (1)..(7442): unsure at all n locations
tacacaaactgacaatttaatatacagattcatcaaagtaactaaaacgataaatacttacttatgaggcacttagtcctcatcatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagttgagntaaaattttanaattccaanggaaaaaattttttttttttaaaaaaatttttcccaaaaaaaaaaccccaaaactgaacagcacacccatgctgcccaggcccaaccattctgaacaaccatacccggctgaacagatctaactccaaaccgggaagctaaccaaatattaccagttattaccatcaatacttattgtgagaggtgtgggactaatcacgaaaaacattgctcaactcgcccataaccgcgggcacggctattcgaatagttttactccggccagaggtgtaccactgtacccacaagacacagtctcaacatcatgtctaccatgcgtcgtgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaaccatgttatacaaaaggtaaagccgttgcccacgctggcttgtggttggcacggttaatgtttcacaataatagctcgcgaaccggtccttaattgtcatgagcacgactctcaaaaccatgtgctcacaacccaccattatcaagttttagttggcaggtaattaattaaccaatcacgattgaccatcgtgaactatcattaagccatcattaaataatgagtcataagttatcccaatagtgtactaatgtttctaagcatggctaagcaatcatatctaatatctagctgaaccaatatataaagctcaactagtcaagttataataacccaaggtatcaagaaataaagtaatcaatgcaaacaggccataacaaaagaataggttaattccacccaatgacattcgaaaataaatgcacagttgaaataaatagagaatttaaatataggatcaacatgctcaaaggaattgtgtttgggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtatattataattttagatgaattatgagacttgaacggcctcattctgatttcatatgaatttattatgaattttacaagattaaatctatttaaagcccatttaaaaagaattaaataaatttaattcaatttatggacaattttattatgtagatctttattttatacaacttttgcaacttgaaccacattaaactgagttaagatgaattagttatgaatttttaaagattaaatcggattaaaacacttatatggattttaattgaattatgacgcaataatgaattatttttgaaaaggaaaagaaggattattgcgtcagcggctagggtttgcggtggaccgggtgcacggcggcggctcacggaaacgaacggccgagatcaaccctatccaaaacggacggccgagatcgatcgggtccacggcggctcacgggagagggcgacgatgacgtcagcgatgacggcagcgatgacgtcagcaccggcggcgactcgggcggctcgggcgcgcatgctcgccggcgaacgacggcgcggcgacgcgaacggagggcaccaacgggtagagggcgacgcggcgaactcaccggtgaccaaaggaacggcggaagggcaacggacggcgccggcgacgaggaagaagcggcggcaaccttcgggtcgacggcggcaacggcgctccggcggtcttcggcggtggcgaaacggtagacggggacggcgacgaccttgcgaacccgacggcggtcttcccgagcgacggcgacgactggagcaacggcgaaggacgactggagcgacggcggcgacggcggcacgaagcggcacggcgctagggcgctacggacgacgagaggcgaaggcgaaggtggcgacgggtagaggagagctcggggtgcttatataggggcaaggaggcggcggcggaggcccacggcgaccggcgacggcgaaggaaaactagggttcggaggagagaagaatccgattcgatctcgattccatcgagtttccaaaccgaattaggcgatgattccaaaagagaaaaggaagaggagatctcaaggatcatttgccctcaaacgattcggccggagaaggaaagacgcggccgaatttggaaggagacggcggcggcttgcgttagggtttcgggcggcggcggcggcgcgaggaggacgacgggtctgacaggtgggccccacctgtcagcgacagagagagagaggagagcagcggctcggcggactgggccgactgggccggggagggagagagaaagagaggttttgggccggctttcggcccaaagccaaaagaaggatttaaaaacatttttcaatttaaattatttcttaaatgcaattctatttattaaaaatacttccttagctcaaataaatcccagaaaaatttaggaattatagaattaagcaaagtatttaataaaattttatctagcccaattttatattgagatttaacaaattaaaattagatcttctcttttaggcttttaaaatcatttctaataattccttttaaacaacaatttataatttaaggatttttaaacaagaaaagctcttaacaattataattgatcaaataattactgaactgttctttgtatcatttaggaattgagctctgaaaaatccgagaaaatttcagagagttgacttaatcatggagaatttaataaaaattaaatccatccatgctttagatttaagaaattttatttcccacattttacttcacttgtaaattaaagaacatttaatataaattctattattaatttattaaataatttttaaatcctgaaacgcaaatcaggatgtgacaaatcggtactgtatattcgcagcttaacaagtacccaaggggactagtcccaaccaaacctttctatagcgagcaatcacgaactctcttccttgagaagcctgctttcccaaccagatgaatgtgttcagctagcaacatgatgcgggctatggccgaccaccatgcagaataatttcacatatatcatgcgttagcacaatcggttaggaacatacatgaatttcactgtctaaagtcaagtcaggttgttaggttgttcttgcattgatatggaagagcaaaatcgagtggaagaggggcgaatttgtagggtttgggggaaataccgtaccaaataagcccttcaaaaatctagaaccataaacatacatatctatcatacatgctaacatgcagtatcaatcttggtattcaggtagggctagttcttggtgaatcaaagacaaggaaatcaaatcaagggtacattatatattatatgacttgcacctattgttggttgttgctaggatgaagtacataagttttaaacatcatactaatataatttgttggataaagatagaggaggccacgttaattggtgactgctgtcaaaaggaactgaccatatattgtctcattgggccatagtatcaatgcattaacattttcttcctaatcttttgaccggataggtacaattatgcagatcaaaatgcttgtggaaaaatcaatttgtgacttctgttctgtcctattcacatacttctccttattggtaagaaaaggttcaacattttattacttgaggtttgtagtatttattacttaattaacagctagctcaaatcaagtttatcaacgattaacatactattcagttccaaccatcctatgtgaacaaccatgaaatgtttaggaacagatgaaaacttctcaaggggagctccaaccaatcattttttagggatatctccaatcaatcataatcatagatgtataaccagatgagatatacaataaggagcaaaagacactaaatctgtgagaagcttaccatgctgtgcatctatggtattttttttaaccatcatactaatctaatttgttggataaagatagaagaggccacattaactggtgactgcttaaatagctagctacatcaaactcgacaaacagcaccatcagttctaatcaagacagaacagcaccataacgacatattaatcatgacactgatatggttcaaacctaagccagattaatcaagacactgcatcaaactcgacaaacagcatcatcataatcccaaaaaggcttattccaacgagaaccatcggtcctctagaccctgattaaatagctagctacatcaaaattgcgcaccatgttcaaggccttgttcttgacggtggatgaggaggagcccttgcagttggagacagggacagaccaagaacccaaggaacaagaaccaaaccctaggtaggacagggagaagagaggggaaggaagagagactcaccggtgagaaggtggccagcggaggggacggtcgccggaggggagaacgccgccaccgccgccgcactcgcctcatgcgccgtctcgtgcactttgaggcccagaatgagggggaaaggccggggtaggcctggatccaatccttgccgggcttaaccgaacgcaatttttttggtgggccggggtttaatccaagccgggctgatccaccggtattgggccgcaacccagcccgaccccacccaaaacgaacaaggcccattgtaaacgggctgggattctatccaggcctaagcacgtggacagaccggaattgaggccaattcaggaaagaataagttcatctgaggtcccttaagtttacaccgaatccgattttcatccttgaaccccaaaaccagatgcaaccggtctctaaactgtcaaaaccggtgcaaacgaaatccctcggcggtttggaacaatcaatagtagtaaaataagcattcatatgaataattagacggcaagtgaattaaacataccagttatctccattcatcacacgacaaacaagttcgtcgtgccttaacatcattgataacccgatgtctgactggcggtaccgaaacactctaaatctaaataacaaaaaataacactcaaaattggataactacaaatctaaaaggtaatctttagtcactaattagtcaattaaaatctaaaaagctaaactttacgaaaaacatgacctcactgttctagttataatcctgaaactactttaacaaagtatagaaaataaatacatttagagcatttacagaaaattatctaaaactttgatgttgagtaaaaactctaagtcggtatctattggttgtggatttaaaaagaagaaacgttgtgccagtttgaacctggttagcagcactatcctaaaccgcttatctgatttatatgaaactagagccgttctataaagatagcgacgatactgcaaacgtcgcttcgatcatgacacctaatttatattagattaataccaaaattctaattaatggtgtgtttagttcataccaaaattgaaagtttggttgaaattggaacagagtgttcgaaaagttgaaagtttgcgtgtgtaggaaagttttgatgtgatggaaaagttggaagttcgaagaaaaagtttaactatatcctattgatcggagaatggtaatccaacagactaaaattatttaaccgccacgatttcaaattaacggacaccaattgctgtatttcgcatagctcaaagaactctatgtatctactgtctcagatcgtttgtccataggatggttcaaaaattgaattttcacgccacccgtttaaccggttctgattaaatcttagggcatcacaatccattacgaattgggaatagccaactccggagaataaaaaaagaacgataattagaaactacatggatttctctgcaaatacatcatgcggcatagccccttttttagaaaaaaaaataaagaagaagaaatatccagtgtggattttggatatctggatatcctctttggcacggtttcgaatccaaaatctatctggatattcctaactccacaactccatggatttagatctatgattattttgataacatttgaataaatcattttgttcccaatttagataaaattttaaattttaaaccagtataatttcacatacaaactttaaatctaacatactttcgatattcggagctgtgccaagcagtaccttaatttgatttagcattagctctagcttggaattttttactctaaaaaaacccacgcaaattttgaatttgaccccagaaaccacccacaggctacagtacaatggcaattcaaaatactccaattaattaagtaaaatagtttaggaacaaaaccgcttgaaaccctacttatactccccttccatggtttggttctctccgccttgtcactgccgaaggtggtcaaacgatgctactatccctcctccctgagtaaataatttcatcatccagctttatattcagtgggaatccaacttgtaaaaatctaaagaagttttaaaggttctagttaattttctagaatgtgaagaacaactggattgatttagagagcttttaattttcggagaagccgcggcagttagaaactccttcaaacattcccttaatttgatttggcatttaactcaagcggtaagcctgtaacatttcccctgtacggaatttttactctactaaaaaaatctcaggtaaaatttgaatttcaccaaaattgacgaaattccaccaaaaatccaaaaccacctacaggctatactggaagtctgcaaattttaacactccaataaagtagtaaaacagtttgggaacccacaaaacccctcaaaaccctaccactacactcccccccttccatccatggcctgattccctccgcctcgccgccgccggaggcggtcaaacgatgctactacccctccccccgcgccgacgtctcctcctcctcatctacc

SEQ ID NO: 82125 - DNA, 13236 bp, Oryza sativa
atgggccgcacgaacaatatgcacgagacgttcgtagtctaccattttataccgaaaataaaaacgaaacgagacgtattcgcccacagtaactgcctgacgatgggcctcttacgtcgtgtaagcaaccgcaacgttcgtcccccaaaactacacccacagtccctgaccaatggactccacccatccgggaaccatccgggcccaccatgtcagtgactgcctacgacacccccctcggagaaaaaatccctcgcacacggatcgcctccggcgaggagaactagttgctttcttccacctcgtctcctcccccccctcccctctctctgaacccgtcgccctcgcctccccgtggaccgccccccgagacgccccccctccgccgcgccgcccaccggagcgggcgcgcatcggacccccctcctagcccgcggagttcaccgtcagccgggccaccgcgatgtcgcgcggcggcggcgggtgctgcccgtcgatggatctgatgcggtcggaggcgatgcagctggtgcaggtcatcatcccggcggagtccgcgcacctcgccgtctcctacctcggcgacctcggcctcctccagttcaaagacgtacgcaccgctcgctcgctcgctcgctttcgatttcgatccatttttgcgcctctggacggtgtgtttctcgatcgagggggtgggggatttgttagggtttgtggcgtggtgttcctcctcctcccgcacggatctggcgtggatcctctagggttttggggctccggtaccgtgatcgcctagccagaatgagtaggacggtaattaaggtttctgatgcgccaattagagtccaggaggtgaatggatggatgtgtggatgctatttgtgaaatacggtgggagtttcgcaaattggtagtggtgatcgcagagtagttagttagatgaggtgatcttaagtggcagtttaacatgggcgatcctgttgctaattatagggtgactcttgatgagctaaagatagcaggtaggatgcttcaaattgtcgaaatggttaaaacagttttgtgacagttgtacgaattatttttctgctaaaagggatgtcttgacaaaaaccaaattggaaacatttctgcagaaaattaataataataataagaattccaacagttactttgctattacatttttcatattccatattgatgtaaatcttgttagtagagatcttatatattgttttccctaactgatttaaatgttttaggtgatgcaagatatatagaatgatatgatgctacgaatgaatataaatatcctttccaaaagatcaattgaaacactaatggttttcaagttaacaattacctagtttatgtcccaatgatacatttacaatacattaaaaatttgagataatggtttgacacatttttttctggaaatcctttcatggcagtcctatcatgtgaataataataaggaatctaaggcaaacttactttattgttgctaccaataatacctaaaacctatgggcacagggtactggaaactgctattgggtcatgccatgcctttctagttctgttgtatggtggtttagcctggattgatctgacatttgtttattgcttcagcttaatgccgacaaaagcccattccagcggacttatgcttcccaggtactcttatcttctgtgtttgttttgtcttctctctgatgtcatgctgtgttttatgatcttatatctagctggtttatcaatagaaacgattgtttgaatacccaaaaaagcttgtagtctattctattttacccagtcatgaaaaaatgttttggacatcgacatggtttaaaaatgaagctttgaccactatttccattataacatatttatattactcaataaaactacattactctgaaaatttgagacaaaaatacacatgattttcatacatccagcctaagtaagtttggaaaaaaaaagcccagagcatgaaaagtatagttggatgccaaagtttggaaattgcatgtcaaaaagacatgttttcatgaccagagggaatatatacttcagtgagagtgctgttgttggaaagagtacctattgtgaatgcctaactttgagcaagtaatgagaagacttattttgctatcaatttctatcatcaattcaatttttaaaactaattgtaagatttgacccctctatatattccactatgtctatttgcaatcaattatgcacacacgaaatatgtccacttgaggcaccctagacgtaatcgtcttgtgctggttgacattttttagattagtctcttgggaattgactaactcttttactttatgttgtgttgcaaatcttaacattttgttttacaaatgcatgctgtcctatgaatatttaccatcttactgttctgcctatactttacaccctgcaaagatcaagaggtgtggtgaaatggctcgcaagttgcggttttttagggaacaaatgtcaaaagctgccatagcaacttctacacaattttcagggacttctttggaaattgatgatttagaggtatttagcaaagaaccatacaccattatcttgtgcaaattgtgtataatgaattttgctctaaccttgtgaaacaaacaggtcaaacttggagaactagaagttgagctgactgaagttaatgcaaataatgacaagttacagaggacatacaacgagctggtggagtacaacattgttctgcagaaggtttgattctagctaatagcatcaattcttagttagtgacaagtgaaaagagctaggttcttaaaattatcattaggtggaactctggaaagcacaaaaaggaaaaaaaaagtgcatgccagtaaaatcttgaataaaggagaattgttctgctcataccactattcggttcacatatttattttaaacacggaaaattagtaatatacactctcttgcaatttgttcttttacatgtcttgaagtttagcagctgatcttcgattataggtagaaagctacaaagataaaatatatagtcactgatgtgtctttctccaaaaaccatctcattattttgacaagttttggcacatggttcaattttttttttggggttctcattttctaaatcaaattttaactttgcctagaagcaggtcccagagtgcttttgtgatgtagtccaaggctatttctcttaactacatgttcccacccagccagtttgcgatgccttgtttgccttactatgagtttccaggcagtccttgtctccttttctcttccatgcgcggatgtgcctagcctttaacctaagtatgtatcttgtgatttttactacactggatattagctcgttctcttttatgatggatcaaacttgatgctcccttttgtgctgctttttgtacttgcacatgttcatggtgaaggatatttttcaacattactataaattcctccttactgttttatagcacaatatacatagttaaccatactttaaccattcttggaccacttagtactgtgtttttgactcttgatatttgctttcaggctggtgaatttttctattcagctcaacgaagtgcaacagaacaacagagggaaatgtcagcagatcaatctggcgattcttctctggagagtcctttattgcagcaggcataaaccataactctagaaagcaatatcttagatttctttctgtgttctcctggagccccccttgatggtctttttccttatttcaggaaatggtgacagatccatcaaaacaagtgaagcttggttccctgagcggtcttgtgccgaaggaaaaggctatggcctttgaacgcatacttttccgtgctactaggggtaacatgttccttagacaagaacctgtcgatgaaactgtcactgatccattatctggagaaaaggtcactatctctaatatcccttcgctggaaatttatggaatatttctaatattttttaatattatcctgtttcccatttttgtttctgcattgaagacagctgtaatcatttcaatcattttaatgagtgaaagatgcacctaatgagcatactatagggcacactgtaaaaagcttaagtgacatgtatctgtaaaacattagttttacaaatttatttttcctgctagttttattattctgaagttcagttgttctttctctcttttgaatgcttgtactatattgacaggtcattaaaaatgcatttgttatattctactctggggagagagcaaaatccaagattgtgaaaatatgtgatgcttttggtgccaaccgttacccatttccagaagatctaggcaaacagctgcagactattcaggaggtatgacacgccacacttgttgtcttcattttgatcttgttgcagtagttctatgagattttaattttctttttgtgtctccaaaatgtaagctgtttttttctcatctgaaaaatagttgattgcttgctgtagcctgaaacttgaaagaatttcatgccagatgattcttgatgtgggaatttctttatgtattaatctttcatgttggatgagatagttcctcttattttgtttattcacactattcatgcttaaattgatctctttttgtttccaactgcatttttcaaaacatatgttttatagcaattgtataatttaagtcagagttattgtctgttctgaaatatttgcaactctgtatttttataggtatctggaaaaatatcagagttgaaggcaactattgaaataggtttagctcaccgtgacagcatacttaaaaatatttcttccgagtttgagcaatggaacaccctggtaagcttgtattattcaagatgttttctgtaaattccctaccccacaaattttcaacctatactatttgaataacttttacgtctgtatattttcttttgcttgaatttaagttcttttgtgttttttatacaaatgtgccaggtaaagaaagaaaaagctatttaccacacattaaacatgttgagtcttgatgtgacaaagaaatgcttggttgctgagggatggagtccggtgtttgcaacaagtcaggtaaccagatgcactctcatccttctgcacttttttcttttgtctattgacacatttttagttttctatctgttttctggttttcattttctttatttcagatccaagatgcacttcagcgtgctactgttgatagcaaatcccaagttggttcaattttccaagttctcaacacacaagaatctcctccaacatttttccagacaaataaatttacttctgcattccaggagattgtggatgcctatgggtaagctcaagaagcatagtgctgagacacttactcttatctattccatgatttggatgatttattttgtctttatatttttcttaaaaaatattttagctttttataatacatttcttgattccttagagctattgtgtatcgttgctgtttatttcaggggtgcagtttccacacataaatcaatcctaaatgttataattcatgatacactcatagtaaacatctcaaaaccattgtaggttgcaatttttttgcttgtcattttggcaacttttgctttgtacttttaaaaatgttctttattaacttgcatgctacatgaagtacataatgagcatatacagatataaacggattataaatgtgttgtgagttgtgactttaagttataaaatctatgccaatacaaattctgctaaaaatgtgaattattctgatgtggtattattataattaaagagatagctagttttaaataatgagttgtgagttgtgactataaataaagtaaatttttaccttaaactaatatttttagttttactccttagtcatcaaagaaagatattcatggcttattagcagctaccaagaaaaaaaaattagttcttttacaatactaccctttgaactcacctccattgggaatttgggatcataacttgctgtattgaatacctggtgttgtttacttattaagaagtgcataataggggcctaagtggccaaatccaaacaaagttttgtgtactaaggccctgattggtacagctccagctccagctctagttccacctctcttggagctggagctcagccaaacagtttcagctccacctaaaatgggagcggagctaggtggagtgctctcacaaaatgaactagagatgtggagctgggttttggctgctctacaactccactccagacccaattcctggagctaaattttggagttggggctctaccaaacagggcctaagtgagaggcccccaaacaacttcactccttacaggagggagtatatgatagcataaaggactcaaatcatgtactatacattgtttgtatactaatattatgttaaaacattggctgcaggattgccaagtatcaagaagcgaatcctggtgtctttaccattgtaacatttcctttcttatttgctatcatgttcggagactggggccatggaatttgtttactacttgcaacactgtacctcataatcagagagaagaagctagcttcacaggttctcttgacagccttcattataattttattactgtggatgtcactgttactattaccctgttgaaattatcttagggattatatatactcccctaaagattaattaattaagcctaaagagaaagattaactacaagaagacattccattgctcctttattttctgtcagttttggatgcatacgtatcctggaacttagtttctaataactttgaatttggctttccagaaactggatgatataatggatatgatgtttggtggtcgctacgtgattttgatgatgtcactcttttcaatttacactgggttgatatacaacgaatttttctcagtcccatttgaactctttggtaaatctgcctatgcgtgccgtgatccttcttgtgggtaaggagcttttgaactgctaatttgcaaaccttatttgatgcctttctaaaatttaatgttctgccattgttttatagagatgctactacagaaggattaattaaggtgaggccagcatattcgtttggcgtcgatcctgtatggcatggtagccgcagtgagctgccttttcttaactccttgaagatgaagctgtctattcttattggagttgcacaaatgaaccttggaataatgatgagttactttaacgcaaagtttttcagaaatgctattaatgtttggtaagtaagaatcttctatggaatatgccatgattgagttgtatgacaataagattacatatgatacatgatatttttttagaactattatattgttttacttaaaacagtaggccattctcattcagttgtgtaactatgtaacaggtatcagtttattcctcagctgatattcttgaacagcttatttggttacctttcactcctcatcattattaagtggtgcacgggctcaaaagctgacctttaccatgtgatgatatatatgttcctgagtccaactgatgatcttggggagaacgagctatttcctgggcagaaactagtgcaggtttggccataatcattttttgctgctatatgttgattgtgttgtacatgcacaccgtattctgaacattttcttaatttcttatagcttgtactacttctgcttgctctggtttctgtgccttggatgctgattccgaaaccatttttcctgaagaagcaacatgagcaggtatgtgtttgcttgtctcagttgtgttcttaactgacttcccaccagagtttataaatacccggcttaatttctgtttttgctctgtattagaggcaccaaggccagcagtacaccatgcttcaggccactgatgaatcagtgacagagctagaagaacaccaggatgaccctcaccaccatgaggagtttgaattcagtgaagtctttgttcaccagctgatccacacaattgagtttgtgctcggtgcagtctcaaatacagcctcttaccttcgtctttgggctcttaggtacctctgaacttacatgatacataacaatgccacctcttaatgtcacatggaagaaattgacggttgagtaattctattgttcgtgcagtcttgcacactcggagctgtccactgtcttctacgagaaagttcttgttctatcatgggggtaggctgctctctattctactgttccttttctctctcacacaagttcgtgcgcgcacacatgctgacttgcttgctttctctgcaggtacaataacattttcatcctgatcattggagcagtgatctttctctttgccactattggtgtcttacttgtgatggagaccctaagtgcattcttgcatgctctgaggctccactgggtggagttccagaacaagttttacgagggtgatggatacaagtttgtaccctttgctttcgcatcaatcatcgaggaggaagattgaatctgaattgttgtatgtaatctagaatgtaaaatcgtaagagtccttcccttgaataatcattgtttatcaccattggtgaagattcagaaaaccccagttcgttgtgtctgagcaggggatgccaaatcattcttttttgcctacacgattagccatgctaggttattctgtatattatgatctgttattactttgagcggtgacaggagcggctgggacgaagttgcaaataagtctagtgcatagcataactgcctttttacatggtgctatgttaataaaagttctgtactcatggctgtgacacgagtgatgtgtcttttgaattacacttgtggaaataaataagttccattctttgtgattattatttcattgtagtggtttatcatccattgaccgtgaagctaaagtactaggactctggatttcactagaaatttggcgcacctgttggtgcgcctgttagatttagcccgttttgtattatttagagttaatatataatgagctttatgaaaatcattgtaaatcttgtaaaaaattatacattttatttaaatttcagcaaatagcttatatttatgtgttattttttgttgttaaaaatattattatttttctttcaaactataaataccataccttccactgtgtttgtagttctactttgtgattatatttcaacttctattgtacttccactgtgctttttatggaattaattcagctcccattgaatttctaccaagacttggaagaaacacttgatgggttattaatttgtaacttaacatgtataatagtagatttgttgaattgaaaaacctcaagattccctttgctagctctcatgagtctaaatcttggggttggatcgattggggcaccttccatattctggctcccatcggatggcctattcagccaaagaaaaagccaaattttgaatttttaaacttaattttgacattgattttaagatattttcaacgtagtttctttttcagcattggcttttaagtcaccgagaacacacatataaaagttttacctacaaatttatttttattttctaataagccgttttggcttattaaaagaaaagccaaacgatggggccctcttattggagctagtgacattcttattggagctagtgacattcttctagatcgcatctgttgccattttatatatgtagatctccttcataatacaatagcaaaacactaaatagtaaaataattagtgaagggaatttagcttccaacttaacctatgataaatcgaggttttctcattatccctgagaaccagaaatcttgatatttcccgtattaaacatattctattttttcgcatgaaagatacattataattttcaatagatttttttagtgatgtatggaacatagagagtttagtttatcttcatacatacagtgttggattcattttgtttctttcatcatctctaacgtaaagaagtagataaaaatagcttctatatgtatgtgatttattagatgtgatattagtaattttctagacatattacttaagcaactaaaaaaatatatagcgcaatatttttttttcttttgatattcttttgtccacttcaattgggaacttagtagaagttgatggggatgtgttgttgttgttgaagtcaaagaaaggaagaagtgcgagagaagagtatttgagacttttagcctagaaccctctagaagtttgtgctctcaaaagattttttttttcatatatgatcttatttacctgcaaatttagaggtgccaagtggtccaataggcttgcaggaaacctgccagctttagattagtagatttattgcagatgaaccttatgtgcaagaatcgtttgtcgactagactgaaaagatatcagagtaaaatgtattccttccatttcaaaatatagaaagttggataattttagaacgaaggtagtaattgtgattctcacaaaatgggtagaaattcttctgcaatcaaaactattttttttaaagaaaaaaaaatcatttttactccctcaaactaattcgatggatcacttaactccctgaacattttatcccccaaattattaaaaatggtttgttttactagaactactattagagcgcacttcgttcctagtattccgttcacattattatcggagtaaacgatttactttaataataaaaacaacttccctgcttcctattacaccccatgtctcgtcatcttgcttctagtattatcggagtaaatgatttacttcgataaaaacaagttacctccttattgtattttttcccgtacccaacttaacactcgcccccactttattttttccttttttttatctgaatcgatccaccatcccagcgcacagatcggtgatgcaccatggagtaggacgacgacaccgtggcggttgatggcagtggctagcggcggttgaggcgaaggcgctgcttcgggcctcgcagtcggacgccggtcagcaccttaactagcaaggaggtgctaagagcaacaaccgacgactgctccacgtcggcgacattgacaaaacaagcaagtgaggaaatgacactctgatttgcatctgcatactatccttcaccttcacgcatgaagctccaattttttttttacaaatcaaattaatgtgcaatctccaatattacttgatttgaattgatgagctactcaggtcctacatttgcacatcgtgcttcatgtggctgggtgcagaggatagggtggagtccgccgtgatggaggttgtttgctacttttcctttgctcgtcgtctctatgacatgaacaagaatgctttttgcatttttttttgcttgctagatgaaggatggctgctactgcgcaacgtcgagcccatctctataccacgctgctacatacttccatgattccatcattgactacagctcaccacccggttgccctctctactaccaatcacaagagacagatcaacctctttatccttattgcaaggtctagcaaagccaccaggatccctgtttcacgatggatttttggctgaatcatttttttcctttttggtttgattcacttgagagtaattttatcacttgtgcgtgattgtgcctgtaattttttttcatttgtacggccattttgtgatacagattaacaatattctcagtattagtttttactcctatactgtgacatcagtaaacatattactacacagtgactacgagatcatgggctatatcgagaggaacatggtaattgttttattcgtagaccacaaaatctaaataatatttataacattggtaaaataatttactactctctctgtccctaaatataggggattttggttggaagtgacgtattctactactataaatctggacagtgcacatgtccagattcatagtactaggatacgtcccatccgtccaaaaatcatttatattttggaacggagggagtagcgttctaagctggtagtaattttttacgaccatctaggaatggtgccgtatgatgtgggagtattcatgcaagtaaatttgttacttttgaatgagtagatgatggaggctgggagtaatggaaaactccacagagtaaattcgttacttttttgaaacgtgggagacactagaaaaatagaaaacttggaaagaaaaactagacggtaaatattttactaaaatgcgaaaacagaaaaattggagagaagaaaccgaaaaggaaaaggtggggtggtaaaaaagaggaaaaccggaaggagggagcgttgtgtggcgctcgaactaatatactgtgcgcagcacgtggatgagcgctaccgtcattttactccttaataacaattctctctttttgttactctttgtataagttttattttaagctgaaatttattagaccatggatggcacaattaccaaagttcaaaaatattttgaaatttttcatggcgtttgctcgaactataaaattttgatgtttaaatcagtttgaagtgctttcaacatatgtaaatagtgagaagaaaaaaaaatcaaagaagaatgttgatacgtaagttgtggatgcatctatattctaccaaaatttcaatgcaaaatatgacttatacagtgagaactgaagaagatgaatagagttaatggggttaagtgaaccgttttcagtagttcgggtgtaaaatgaaaaaaaatgaataatttaggggggggggggttaagtgctccagtgaaatagttcgggggagtaaaatggtgaggccataatcatggccactttatatattatcaacctaagttgcaagctatgtaaaaattgcatgttatatatttgaacaaatattgttgcatcgactttttatgttctcgtttgtaaaagtttttgtttggtaaagggaaagagaccgagcgtgggaaatgcacggatgatcaaagcaattgattgagaaccaaacctatacttttcccaagtctactcctatatcattacgtcacttttgatcaatagaaaacaaaagatgaaattctgcacgttttggattcggatttggaccccctgacagcatcatcttcaaacggactagtcactatctagaagggttttcgggggccatgagtacttgttaga

SEQ ID NO: 82126 - DNA, 1371 bp, Oryza sativa
caatggatttacttcaaacgaacatacaaagttacattcgttttgttctaagttacttctataatatatgtaaagtacttttaggctttactgaatttaattttgtatgtctaataagtaatttagtgaaatctaaaagtaatttaggcatatcataaaagtaatttgtgatttttcatcaaaatataatcatgtgagatcttgttgtaaagatttaattgttacgaacataacggtgtaatcgaattatagatcggataagtaatttaagagaaaatttcataacaagaaaaaaaatatgcataacctaatagaaaaactacttgcatgcatgtatgtaacgctactagtacttctcacataattatccgcgtcgctcgttaaatctaaattgagatgcctctcgaaatagattttgcgttactaaatactctcttcgaattttaatacaggacattcttgacttctaggtatataagtttaaccattcatcgtattcaaaataataatttattttgttaatttaagcatgacttaatttgcatctttacagaaagaactgaataatattaagaaacttaggaaacgtatatatattctttaaaacgtgaaacaaataaattgtttcgataattcgatcaataaagtgaaaataacaagggccggagtagacgcttggcttctctgggcttcaaccatgtttggttgaagggactaaattttagtttatgttacatcggatgtttaaacactaattagaaatattaaacatagactaatggcaaaatccatttcataaccctgtactaattcgcaagacgaatctattgagcctaactaatctatgatagcctatgtgatgctacagtaaacatatgctaattatggattaattaggcttaaaaaatttatctcgcgaattagctctcatttatgcaattagttttattattaatatatgtttaatacttctaattagtgtctaaacatccgatgtaataaagactaacatttagtctctgatccaaacaccgccttatccaaacaccgccttagctttcatggcctatcacttaaccctttggtggaggacggtgagttttccgaatgctctcgtctgatagtgtctagtgacaaccgagtttcaatggattaagttataggtaaaatttaaattttaaacttaattttaaattaatctatgcgctttttcattcttttctattacattgcaaaaagcaaaagtataatagctttatctaaaattatttttcctcatttatttttctttacagcttatcacgtggaggcgtgtagctaatcaatatgcttgggtcatcctcaatatctggcgcgaggggcttaccaacg

SEQ ID NO: 82127 - DNA, 1943 bp, Oryza sativa
agcatcacaaagtagataaagaaacctagagtctaaacaatcaagtaacaatcacttttcaggatggtagatgccttaaccaatctaatgtagtaggaagatttagctgatactggcaagaaccctaaaacgagaaccagccgatagaggtaaatctagatactaagactagattagctaagacatatgatagcagatgaccatgataaaaggattaaaatatctaaagcgacataatagccccgatagcacaagccatcgagacatgttacctcttgtgaagcgaactcgtcagaaagtaaaaatgaaaagggtggcaatgcgctgaaattgtattggattgtctctcatattacaatgctagggggttcatatttataccccgagtacagacatagtctattataggcacgactcaaacctttctaaagatgaaatacaaacaagaccatctacgacggtctcttacgaaatctctaacaaaccgacataacctaattaatagatacaattgtcttgcataagctctatttctgattggcaatgacggttatcttgatctaggcccatgtcgagcccaagttataccgtatcggctgcctgccatatcggccaagtcaagcttctgtccggttatcaaccgatacaatatttaaccgatgcgcagtccaactccagattcaactcgattcaacaccaaattcgtttcgatcttcttccttcttctccgaatctgacgcaaaattccattgttaacaaccaggtactgaaacctcattcttttccttttccaatcaatccacattgggctgaatctctctaactagtccattcccagaatcgtgtcatagcttcccaaactcagcaccttcaggtcacttgagaaactctgcccttgacaccaccattcagcatttggaaccatccttgtacaagacaactgcctcctatcagctattgtcactttagtggaagcaatatcctagatagccaatttcaactcctcaaccagatgctcagctaggaaactgctagaactccctgagtcaactagaatgagtaactcctgattctatatgagcccgtgtagtctaatagttcttttacccattgcaccagtgggagcacattcagataagaccaactcttcttcactgctttcatcttcttccaccattgtagactcttcttcttgattttaaaatacttccaaaagttcctccagcacctaaagttgcacagattttggacacttgtgccttgggccaaatttctctccacatttaaagcattcacctctggctcttctagctgccttgagtgaatcaaacctctcttcccacttgggcttttcttcaatcttcttattctcttcagggcttgctcccagtatacccttgccttgaaatggagccttgttgaaacttttgtatccttctctgaatgattgctttgagaatgccttcaagaagcccagttctccaagaagctcttcctgtgttttagccagagaaaacgcggcatcaattgaacgaggcttgtgcagcttgatagttgctttaatttcagtcttaagccctcccacaaacttagttacaaaaaaatgttttatcatacccttgttgtaaaccaacactttatgcatgagctcttcaaacttactatgatactcctccacacctcccatttggttatgattttctaattcctctagatgttgctggtacctatccttcccaaacttgctatggactgccacagagagttcagaccagttctctacacaatgcaattcctcatatgtctgcaaccatagggctgcattaccaatgaaatgcagggtagcaaacgaggaccaagtttcatagggcacttgatacatgctaaagtattctcactattagttttccacagttttgggttatctccatcaaattttgcga

SEQ ID NO: 82128 - DNA, 3212 bp, Oryza sativa
agaaatacaatttttgaattttaaacgcaacaaaaaacctcaaaaaaatattttgaattttactagccatcctatacatggttacacatcactacctataaattcacaatttttcacacaatataacttgtatgctacaagtgagattcgaactcaagacctcaacctccatatagagctcccttaccaactcacctactcaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgtgtgtagatctgattgagttgtatgactttgatacggggcatgtatccatccatgtcatttgaaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgcttaatcgtagattattttgtggtgtttacactttttaatcagtaaagataaggacatgcatataaaaggtttacctatatttttttattaagaaaaaaaatgtaaaaatttaaaaccataaataaaacgaaggcaacaatactgctctcactcccttcatctcaacaccataaacactagagattaaaaaccctagcattttccagtttcaccaaagatcatgaattgagaaaattctagttctttaccataagacaaacccatgtataatgtacgaagaaaaaaagacttaatgtgatagacacatataagagatttcaaaaaacacccattcaagaactcatcttttacaccggttagaaatccccattaatcccggttataacaaccctgacatctttagtaccggttgaaagtatactaagttaaaaaaatgtggaatgcaagattcaaaaaaaatgtggaatgcaggattcaaactcaagatctcctcagccctcatacgtgtcaccatcccaagtgcatccgacttgaatagagatgttgtcttttttaactaaccctagagacgtctttagtaccggttggtaataccaacggtaactaaaaatgtttctagggacttgaacttttagaaccagtaataaagatgtatttttagtactggttgttaacactaaccgggactaaaaatgtttttagtgacttagacttttagaaccagtactaaaacatctttagtaccggttcttaatctagccaaaatatttatgattttgggtaccacgacgaaacatttgcttatgagaagacattggcagagaactcatcttttataccggttggaaatcaccattaatcccgggtataacaaccatgacatctatataataccggctgaaagcataccaagtcaaaaaaaaaatatgtgaaatgtgggattcgaactcaagatctcttacctcatccctcaagcgcattatcatcccaccttctacatacgtttgacttgaacagagatactttctttttgaactagcccgggagacatctttagtactggttggtaataccaaccaggatttaaaaatatttctagggacttggaccggtactaaagatgtatttttaggactggttagtgttactaaaagtgtttctagggacttggatagtgtttctagggacttggattttcagaaccggtactaaagcatctttagtaccggttcttaatctagctaagatatttgtgattttaggtaccacgatgaaagatcggttctccagtagtgagagactgtcagaatctctactaatagaaagataatgcacgcattagatcttaaccaagaatgcacatactatgtcaagaaataaaatgatcaccagagaaccagaattgatagtactatagagttatataaaacataagcttgcattaaagttcctttgatttaattatcatataaaacttgtataagactgtaggaaattattttaatcgcattaaacatgcaaaaatgaaagcatgaagtctctgttccaaatagtgtctggtccactttctaaatagtgtctggtacacttccaacttcattcattaatttctagtgaaatccaattggaagtggaccagatactatttggaacagagacttcctgcagcggtaaatctaattggagaggcctctccaattagtcttaaccagagacacccacgtgctagtactttaggagttttggttgctattaatccattgagcaagtagaggaaatattcctatcatctatgcttcaaataaaattctcttaaattactcatccgatttataatccgattacaccgttgtgttcgtaataattaaatctttacaacaagatctcacatgattatattttgatgaaaaaccacaaattaattttatgatatgtctaacttacttttagatttcactaagttacttattagacatataaaagtaaattcagtaaagcctaaaagtaatttacatatattatagaagtaacttataacaaaaataaagtaactttaattaatgtcttttttcattgaacagattatcatatatactcccaggagtatgtactccatcttctctattggataatccattagcgtagttcaaaatgatttgtgctgaaaaataagtttttttttatttgtagcgtgcatgcccagtttttcggtgggttcaaattt

SEQ ID NO: 82129 - DNA, 21435 bp, Oryza sativa
ccctccctcgcccataaaagcactctcccgagccccctctttcgttttccctcattcgccgcgctctcccgtgcttcctatcgtcgccgcgccgctcgccccttacgccgccgcctaccgccgtctccggccgcgcgccaccgccgctaaagccgctaccgcgccgtgaagccgccgtcgtcgcgctcgcgggtgccgtccgctcctcggccgccgcttggttgccgccaatcacccccgaaaccccgtttccctcgctcgccggtgagctctcctttttcatccatctccggccggccactttggtcgttgcggtcgtcctctccacccctaatccctctcctcctttcctataggtgtcgcctccgcccgtccgcccctcctcgtcgccgtgtcaccgccgcctttcatcctccgctttggtcgccgtgctcgccggtgaggctcccctccgctccccttttttccctctctcccgtgtgcgccgccgtccttcgcgcgtgcgccgtcgccttcagccgctgccgccgcttttcgccccgtcatccgtcgcttcccacgccgccgattgccgtcgccggcgaccgtgcgcgtcgccgccggttgccatggccggccggccggttttgaagccgagccgagccgtgcctagccgccgccgtgccgtccgatcggcctcccggccgatccggaccgtcggtcccgtggaccggcggtggaccacccgcgtggtcccggtccacggtggaccggccaccttgtgccgctgacccatggggcccgcttgccggcgcctctctctcccctctcttgagccgctgacaagcggggcccgcctgtcggcgccgccccccccttggatgacgtcagccctgggctttattgcgcaataaagtgattaaggacttttctttattagtaaaaacacagtttatcttctaaaattcataagtaattcatccgagctccgtttaagtccattcaagtctcagtaaatcaagaaaaatgcaaagaatccattaaaaatggttttgttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatgtaacgtgggatgggtcctatttctcagccacatattggttaccctatgccattgataacttgggtatcaaaatgattagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcaattaaggatcggttcacgggaaaccctgggagacttaccgtgcttaccacaagcgggagtgggtaactgcttgatctgaagtatagctcgaccctttcctaggcaccggtggcgagggtgggcgtgacggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatgccgacatgtgtggaatcgtgtcttgtgggtacagttgtacacctctggccagagtaaaactattcgaatagccgtgcccacggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccaccccagagctgaagatcttcctagttggagctgttttgtcaaagttggtttcgtcgctgccgtcaaggattgcctgtggagtggagtcgcccgctgctgaagtcaagctttccggtttagctcgcttttatcttttccgctgcatttgcaatcttttccattttgtaagacgtggatctgtatgtcaacaattgtcgtttgtgtaccctggctggtcctggacagggatttaatgcacattcagcttagaaattctggttcgagaatttctgggcgtgacagtgtgccaattagaagttttaagagagaggatgaagaaaagatacatgaaaatgctttcggttgagcacccgaaccaggcccaaataccgggtgacctccccctgattccatcgctgtagcgtcgtctcatctgccgtgcctctgcatgcatgcatcataagattgtatcatgatctctcttccttctctctcctcctggatacatgtaaaacttttttaaactaaagtttaaataatttttatcttaagttactaatctgttttacgacctaagccaattgtttggtctgttgcaattaaatctttataacaaaatctcacatggctatattttattgtttttaactttttttttgtagtggatcttttataaatgttgcccatggtgttattgaatatttcaataagtatttgctcatgtttcacctggtcatttatagttgttgcatgtaaaatttcttttagatgtttcacgaagtatttttatgtttcaataattacaactcgatgtttcatacgtgatataaaaatattttaataaaaaagtgtttgaatatacattatatgtttcatatatggattttttttcatgttttactcgttgagacttaatgtttcgtaaggtaattgtcattgttgcatctatctcaaacattagttgaaaaatttgtaagtgatgaaattatgtttcataagagataaaacaatggtttttaggacatatatgtttttattaaaatattatcatgttatatcttcttataaagaataaattacaacgtacacaacggttttaagcggatcataaatcagatgctccctccatttcatattgtaagattttttttgacttttctctaagttaaatatggttttattaaatctaacattgaatatattttgattatatgtttaattggtgttggaaatgttgctatgttttgccataaacttgatcaaaattaaataaatttgatagcaaaaggtcaaaacatcttaggatatcaacaatgtttactaccaaccaaatgaaaaagagtatggtttagattagttgttactagttgttacgaaagctacaatggtaaaacaatagaagtgggtgtcaaacttgccccccccccccccataatccactagcaatacgagggggaaagagataaatcatattgtttatcctttattgctcggtaatagcactataacctgttatttgctagtatttcctagttctacaatgcttatagtttgattaaacctagtaaggcttcatttacttattgctttccttttgtactttctccgtttcaagttataagatattttgactttggtcaaaatcaaactgcttcaaatttgactaagtttatagacaaatatagtaatatttacattaccaaattagtttttattaaattaataattaaatatatttttataataaatttttcttggattgaaaatattactatttttttttctataaacttggtcaaattttaagtagtttgactttgaccaaagtaaaaacatcttgtaacacatattgtggacgtacttatgatatcaaacagatgaagtagtattctaggagaaaaacttgcttaaaattttagtaaaaatgtggatatacatatatcagagaagggggagatagaaaacagaggtggggaggggatccgaaaggcctatattagggtgtgtttagttcttgggtgtaaagtttttgaagtatacggacacacatttgaagtattaaacgtagactaataacaaaacaaattatagattccgcctgtaaactgcgagataaatttattaagcctaattaatccgtcattagcaaatgtttactgtagcaccacattgacaaatcatggagtaattaggcttaaaagattcgtgtcgcaatttacatgcaaaatgtgcaattggtttttttcctacatttaatgtcctatacatgtgtccaaacatttgatgtgatgtttttggccaaattttattttgatctaaacaaggcattaggagggtaggtatcatttatttttttttgaagaatcggataactaatttgtagtctcctccattcaaaaaactgatcatcacgggaaaattttggagcaggttaaaattcaaaaattgaagctcgatctcgaaaacaaatagtaaactccaactgaatctagggctgtgcgtgacggctccaacagggttatgatcctgccctcctgcaacaccgacggcggtgatatcaaaaggagaaagacgacaccgcgccgcgcgcatgtatggccggttgcacagttcgatagttgcggaatcgcagcatctgttgcggttcacgggactcaagttaatttttctcttctcactaattaacacagctacagtaattaaatcagcattaataaccaagaaaagaaaaagggagtctaagcctctaattaattaacattaaactgaaatgaacatcacgagccccgccgccatcagcccaacgcctgcgccggccaccaccgcgcagcttcccgccgacgttgttgtcccgtccgccgccgcacttgtcccgtttgtcgacggcgatgtcgtcttcgtcggcggcgtatccacaattcccggaccatcaaccgccgccggagcgatgggatcgtcgtcgtagtccgtcatcgaggaggccgacgcgtcgtcggcgctcttggccgtcgccggagaagacggcggcgtgccgccgccggaagaggggccgcccaagctcggcgccacgatgggggcgctgacctgcatgacggagaggttgtacggccggcacgccacgaccttcaccagctgcgacccgatcggcgcgccgggctcgccggagccgaacgccatctggtcgtcggcgacctgggtgtacttcacgagccccacgcctccgccgccgccgccggcggcggtcggccggagcagcgtggggaggagcgccgtcttcgccttgaggctgtacagcttgacggggtcgtagtagtcgaggagcacctgcagcgccaccacctccccctgcgtggcctccgggagcgacgtgatggcgccggcggcggcgtcgtcgacgacgaggacggtgacggccggccgcaggttgacgtcctcggcgagcctcgtctgcgagaggaggccgttgaacacggagaactccgggaactcgtgcaggatctcggtgacgttgaacttgaccgccgcggcggcgggcggcgacgacgacgcgaaggcgagagctaggatgagtccggcggcggcggcgacggcggccatggttgctgtgctctccgcggcggaggaggccgtcgtgcacgtggagatagtgaaattgggaagggaaggaacgtgagggctaaactgggggtgtacgtacgtgcatgggagtggattgcatgcatgcatgggcgcgccaaaaaggttagacgttgttgacgtacggtccatgacactttgaccgagtctctggtgggtccatgtcatgaagccatgaagaacgttgtgcacatgggctgatgataaggctgataaactttctcatgctccaagtccaaggctttttgttgtcattaaatcagttttctctcccttgtctatttatatgtatcctgtttattatatgtccatggtttttttattatgaaaactattatatctcttaaaatatagagttttagctatactagtaattacctatgcattaactatgcacatgctcatcatttaaacattatctagtctgtctctttccaacccctgtaactatatgaattccttcactacatgtaagaccataccaaataaaatggacattattttgtgtagacattatttttttatgaaacgtttaaatttattgagcatgtgagtttcaccgacaaggagaccatacgctagtgctaaaggtagtggtagcagattcactactactacctttaaattagtatagaaatctaggcacttgctatatttcgagaccgaggtattaacttcaaaattaacttctatcatttgagcttttagatggtctgtttggtgtaccttcaactctcaaatccacttctgatcaagttagagcacaaccaaatgtttcatgagagattgccggattgctccacaaaaatgaactagcagcgtggagtggcattctcgccactgcactactccaaagacaacaagatttcaggagttaaagtggcaatcccgcttagtatatactagtataaaaattaagaaaataaattgctagtataaaatttgagagaaaaaaaataactagagtggcgaattcgaagcgaggggaaaaaaccgtttatccgctctaattgcatccctagccgacatcaggaagagaatcaaagaaacctgtttgtcttagaacttggaagtatatttaatttgtcgtcccattaaaggaggacttggaataataagagatattcaagctgttaacaaattaacctcatcctcaacactgcttggagagtatccacctcagatgattgagttgccaaaatcactaaagccaatgctatattaagaacgaatgtatggtgggaggggaagcagtacaagatgaaatccttgatgcccacgtctgaattcttcaaaattttaaattttgagccaaagattttaaattgcatcatgtcaattcttcactttctatttttaacttttttttatgatttcttgaatttagtgaaacataaattatttttgaactctaaaaagttaatttcagaacttccttctttttaatgtctctgatttgaatatttgaatcttaaacctttgtagaatcatgtgatgattaatctttgtgatgaacaattattaaatgtaagtgcttgttgaaaatatggtgatgtgtttttggacagtgaatagtgtagtggtcggcattgtgaggccggtcagatcgggggttgccaccagttagaccggaggtgttggtgcggactgacctagtagcccgacggtcaagttggtgtgaagttgtactcagatatgaagtttcttgttgtacatgtgtaggtgttgcttgagaccatgggagtataaatgttaatgaatcgggaataggcttggtagaagttgaggttcagacggtcaaggatatcacgcgggatacttaggttacagaataatgcacgtcgaggtgaaggtttccatatggtatacacgtggtgttgtgtgcatgtggaaagaggagtcaaatttcaattggactccaagtttggaaagattggagtgtagagttgtatggggatattgtttccctcgtttggtaggtttcctatgtgattaggagtcctagttctagttggatttgtggctaggggcagccacaatgtgggtataaatagatgatgggttgaggctagaagatatcgactttttgggagagaaaaattagggtttctttcgaggttttagcactaggtcaagagttgagagatgattgctttagatgcacttttaaacacatattgatacaataaagttaatttactttcttgagttttgtcggtacatgtttttctggatcccaacggtgaccagagtttattgggcggcctaactggcggcgtgatggcggtgtaagtgatagtcagaggtggtccaaccggcggcaaggtggcggtcagacaagcggcatgcatgcggttagaccgtggcaatctaatggtgccatcggttgaacttcatcaaatatgagggtaacttttatccccgctaaaagttttggtttttggtggtcctaccagtcatccctcccctcttgtaggcttgatttttgtctcgatcatacaacattttcttttctatgtgtgacatccttggatttaaattctttggatttcaaacttttcttattttcaccaatctctataaaatacctcaaaattgacaaaattagcttaggagactctagctttgtggcgtttgcttagttttatggtactttgccaaaagacattcaatatattattttaatatatcctattcaattgtagagataaaacttttcaaaaaatgattttacccttggttcacctagcatattcaaacccaaacaaattctagttggttctaaacatttgcaaaaatttaaaagctgtcccaatttctggaaatcaaaatgttttacaaaaaagtataaattcagaaaataatatttcaattttcattttttttaaaaaataatgtatttgatttcagtaattttggatcaagttttgaattttgcaaaaatatgtttaaattgtacaaaaaaagtgtttaaattttaattatgcttggcgaaccaaaggtaaaatcatcttttacaaagttttatctctctatttgaatgtgatatattaaaataatagatggagtgtcttttagcaaagaactataaaactacggtgtcgtatgggaaaaccacaacctagaatgccctatagaaaatgtcacaaattaaagctagagtgtcctagagcaaattttgtcctcaaaagtctataacatgctttattcttactaattcaagtgtaacctatcaaactaaacgaatttactgttaataatatttaacccttttcttcattttggagttctagattcaaattcttgatatatattgcaaacgattagttctgtctttcgctaaaaaaaaaaatccaagaatccatatcataatctccactaacaaatttcagatccggtcctccaaattgaatgaaactaattccgattttcatagtttaccttttctcaaaattaaagtttatttatccaaattttgtaatccaaaaccttttatattcccgtatacccatgttggtatttgatattgtcacagataaatcagcaagcacacggataccactgtagcactttagctcaaagtattccaagggtattgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttcttttttcctttttccttctttttcctcttcttgggccgtcggcccagtccaccccgtctccccgcgctcggcctttctcttgtgggccggcccgttctccttcccctctctccgggacgctgacaggtggggcccacctgtcaggtcgtctccttcctccagccacccgcctccgacggccgtccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaatagggtgggttcccggccacgtccgcctccccctccgcctataaatcgttccccgcgtcttcctctctcgtttttcgcactcgccgcgctctcccgtgccgtctaccgcccacgcgccgtcgcacccgagctccgccgcttgccgccgccttcggccgcgagccgccgccgctagagtcgccgccgcgccaaaccgccgccgccgttagcttcgccgctgcaagagctttcccggccgccgcctcgcgtcgccggaatcccaccggagcacctctcccctcgcgagccggtgagtttttccctcccctccatctccggccggcaatccaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctcccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgccgccacccactccctcccccttgagccactgcccgtggggcccacatgccggcgcctccctctcctttccccttgtgccgctgccagtggggcccgcttgccagccgcccccttcctctctcttgaaccgctgaccagtggggcccacctgtcggcgcagccgccccctcccctcgctgacgtcagccctgggccatattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaaatatcccgcatttctattaaatgttgcattcttttacaatatcatgtggaatgggtcctattactcagccatatattgtttaccttatgccattgacaacttgggtatcaaaatgattagatgttggtttaggaaatgcttagccatgcttagttcaactagcacacaaaaagggatcacattattaaatagactctgactattagcatagctttggactggtgccaccgcaagggtgtcagttaattaaaatattctgagtggtgggctgtgggtgcatggtttagctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatatggagggtcttgtcacgatttccccctttgcagtatcatggtgatacttcggggcatggcgacatgtgtggaatcgtgtcttgtgggtacagttgtacacctctggccagagtaaaactattcgaatagccgtgcccacggttatgggcgatcaaccagattcaccgtgattagtctcacccctagtttagcttaatgaactggtgtagttcaagtggttggttgggccttttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccaccccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacttggattttgttttggaaaaatttggagttttgcctctttggtttgcgggaaaaatcttggtcgttctttcggatcggatttttttttaaaaaaaaaattagctcagtctagggctttagaaaaattttagttggagtttattcgacagtcagtcgggaatttattgggggttatgcattaggtcgtgtctatattcgatgggggcaatgttgcgcatcattttccatgcaactagtctatgcattaatttattgtttagttgcattagtgtctttatttgggttcatgaaaaatgttctatgcataaaaatcatcatgttcagttattcgtttgagtcatttgttgcttcgtttaatttggatttgagcatgaattggttcctatcccttgtctactttagatgtcagtcctatccctcgtttgcaagcgccgccccgagcttcagagtcgccgcccttagctttatcgccttcttagtctatttgcttgctagttttcgtgtttaggtttgttgcttgtgggttagtcggcggtcgatatcatgtgtcagtggtatgactgcctcaattaggagttgcgtgcccctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccacccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgctgagaggcaggagaagtttctgtcgggtcttgatgatgaattgaccaaccagttgatctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatgggacatcagggtggaccttccaccatgattatccggcagcaccgtccctaccacccgggtaatttcaacaagaacaacaacagtggcagtcacagcagcctcaacccgactccaagtccattaatgattccagctcagtcagatcagtcagatcagctagctcagccagctctgccagaacagcccaagaggttgggagaaaaacccgaactctgcttcaattgtaacaaacccggacacacggttggaaagtgcccgaagccaagacatgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcgcactcaatgaggtcactattaagaacaagtaccctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaacgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcctaatcctgcctgatcagacgaaagattttcaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggctaatgtggtagcagatgccttgagcaggaagagttactgcaacgtcgcatgggtagaggaactatgctgtgaggttcaacgtgatttggaacatttgaaccttggtatagttgagcacggattcgtggctgccctagaggcacagcccacactggtggagcaggttcgcatagctcaggcaagtgatcctgaaatagccgagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaaattctggtgggtcagcatgagaagggaaatagctgagttcgtagcactctgtgacgtctgtcaacgagtaaaggcagaacaccaaaggccagcaggtctgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggagcatgggacaaaagcttgccgtatgctgagttctcttacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcaccagctcttccgaatctcggggtcgagattccgtttaaggggggtaggtttgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttcttttttcctttttccttctttttcctcttcttgggccgtcggcccagtccaccccgtctccccgcgctcggcctttctcttgtgggccggcccgttctccttcccctctctccgggacgctgacaggtggggcccacctgtcaggtcgtctccttcctccagccacccgcctccgacggccgtccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaatagggtgggttcccggccacgtccgcctccccctccgcctataaatcgttccccgcgtcttcctctctcgtttttcgcactcgccgcgctctcccgtgccgtctaccgcccacgcgccgtcgcacccgagctccgccgcttgccgccgccttcggccgcgagccgccgccgctagagtcgccgccgcgccaaaccgccgccgccgttagcttcgccgctgcaagagctttcccggccgccgcctcgcgtcgccggaatcccaccggagcacctctcccctcgcgagccggtgagtttttccctcccctccatctccggccggcaatccaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctcccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgccgccgcccactccctcccccttgagccactgcccgtggggcccacatgccggcgcctccctctcctttccccttgtgccgctgccagtggggcccgcttgccagccgcccccttcctctctcttgaaccgctgaccagtggggcccacctgtcggcgcagccgccccctcccctcgctgacgtcagccctgggccatattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaaatatcccgcatttctattaaatgttgcattcttttacaatatcatgtggaatgggtcctattactcagccatatattgtttaccttatgccattgacaacttgggtatcaaaatgattagatgttggtttaggaaatgcttagccatgcttagttcaactagcacacaaaaagggatcacattattaaatagactctgactattagcatagctttggactggtgccaccgcaagggtgtcagttaattaaaatattctgagtggtgggctgtgggtgcatggtttagctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatatggagggtcttgtcacgatttccccctttgcagtatcatggtgatacttcggggcatggcgacatgtgtggaatcgtgtcttgtgggtacagttgtacacctctggccagagtaaaactattcgaatagccgtgcccacggttatgggcgatcaaccagattcaccgtgattagtctcacccctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctctttttccccacacaagagctgaagatcttcctagttggagctgttttgtcaaagttggtttcgttgctgccgtcaaggattgcctgtggagtggagtcgctcgctgctgaagtcaagctttccggtttagctcgcttttatcttttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacttggattttgttttggaaaaatttggagttttgcctctttggtttgcgggaaaaatcttggtcgttctttcggatcggatttttttttaaaaaaaaaattagctcagtctagggctttagaaaaattttagttggagtttattcgacagtcagtcgggaatttattgggggttatgcattaggtcgtgtctatattcgatgggggcaatgttgcgcatcattttccatgcaactagtctatgcattaatttattgtttagttgcattagtgtcttta

SEQ ID NO: 82130 - DNA, 11755 bp, Oryza sativa
gagcacatgtagtaagtgggtattgatgataggacagagtttattaaagtcagtctacctccttgaggtaagaacattgaactaactgtcagccttctttcgactctatccaccagggggggcaaaatcaatcacccttggccttgtagttcctagaggaagccccagataggtgaaaggcaattttccaacagaacatcgcagaagtcctgcaattaaatcagtcttttcttcagatagattgagtgggtaaaggcttgattttgcataattaacctttaagccagtcgacagagcaaacatgttgagtagtgccttgaagcagaagatttccttttgtgaagtttttaacaaaatcaaagtgtcatcagcatattggatgattgggaacccacttccatcattcgcattgattggctttgaaattaatccaaggttgaaagccctgtttactattctttgtaggagttcagctcctagaacgtaaataagtggagacaaagggtctccctgtctaactcctctcttgcaggtaaaagaattacccggaaccccattcaacagaactgcagtgcttgctgaggaaaaaaccatttgcacccaattgagccatttttgtgggaatcccatgctttgcattacagataggatggctgtgtgttcaattgtatcaaacgctttttcaaagtctagcttgaggatgattatttctctttttgactgctgacattgatgaatatactcaaaagcccatgctaaacaatcctggatggttcttcctttgatgaatccatattgatttttactaaccactttgagaatcacaccttgcaatctatctgccatcaactttgtaagaaacttgagacttcatctcattagagaaattggtctgaaatcattaactgtttctggagagagttttttcggcataagagtgataaaagaactattcaagacctgtaaatctgtagactcagcatgaaaatgagctacaagtctgtagaaatcttgtgcaatgatatgccagcacttcttcatgaaaaaaccattgaaaccatctggaccacgggccttgtcagcagggattatagagatgaggttgtcaatttcttgcgtgtaaaacatgtcgatcaggcactccaaatctgttctaggtacaaaaagctcagtcaaattgaaatccattgttggggagcaagagatacccatcctgttcttgaagctgtgatagaacaagtttgccttctggtcatgtaagtaaactatctggccactttgattcgaaacttgtgaaactatgttcattctgtatctttctgtggcaatagattgaaagaatttggtgtgctcttctcccagcagcatccatctgttagtgcaacgttttttccagtaaattttcttgtattctagaagtttgaggatctgatgtttaactacctccctgaaattccattcaaataaggagaggcttctatcttcttccaacagagcaagaaaatcaatcactttattgcaattgttcaagagaagcatgattcttgatagatttttactccagagtttgagttttttcctcataattttcaacttgaaggatatacatttagccggatcatcaaaaccaggatccagcagccaaacttgctgcaccacatcaaagaaaccctcagcttccacccaaaaattttcaaatctaaaaattggagatttggggatttttgtatcaatctttactacacaaggaacatgatcagagatattcctggtcaaagggatcactgttgtattagggaaggttaaagtccaggaagcagaggtgaatacccaatcaagcctttccagcaaaggattttgttgcatgttgctccaagtgaaccttctcccttttaatgggatttccaacagtcccagggagctaataatctcattgaaaatgaaaatatcattcatatcggctcccactttatttctgtcataagtagatctgtagaaattaaagtcccctagaaagagccagttctgttgagcatcgatctggatgttttttaaccagcccacaaagtctggtctttcaggcccattgcatgggccatacatgctagtcaaggaccaaacttgtgaagtaaatgtagaagttaattctactgtcacagagaaagggttaacttctttgagaatcccactaaaggtccttgaagcccagacaattaaaattccccctgaagcacccatggagggggaaaaagcaaaagagtcaaagcgcttgggagcaaattttttgatctcagaaaggtcaaagttctcttttttcgtttcttgaagacacaaaacccggcaatcactcttatcaattttctatcttaaagacaggagcttattctcagcattcattcctctaatgttccagcataaaacattccaggatttaaaattactagtcatttacacaccattgagaatggggcaaaaataccaaggctagcatagctaaccaggaccaatccaaaagacaaacataccagtgttgacatgctgacaggataaaattctggtaaagcaactttgacagcatacagattacagacccttgtaacatgataactgtaaaacataggcctgccaacagaacaaaatattgcttcatcaattatcttccatgtttagcctggggatcttctgccttctttcaccccccaggctagattcagccacctccttaggagagaggccgcacatgtccacccccatcttttgtatgaccgaaagtgaacaatcagagggagaggagtcagagttcatatcactataagaagtttcattgaaatcagactcgtgcaaactgctatcaataaagagttttgcaatacctgcaaattcttttagctttttagcagactttccccttggcttcctaatccccattcttgggtccatctgcaaatccttggttgcatttccttgcagaagtcttgagctttgtcttctgtagggactgtagagaatggtcttcccatctcacttctttacaggtgccttggggggagcagggccacaggtgccatactgatgggactagccacagtggttgggctagtagggggcatcacactgattggaatgacatcttcaatcatcctttcttgagggggtaaaatagactcaaaaggttgcagagcccatttagattcatgctggcccacttaaggagtggaaccatagatggactttcttggcaggaccaatgccgaaaagttggatatctttaaagcagcaggaataggcttgtcgtggatcaaagtttgcatgataccctttgctttacagagcaagtcaaacttgtccagtatacccttcattggataaaggtaggggtgacttggagattctgttttggcaattctattcaaccgagctaaaaattcctggacttgcggctctagaacaggatcctagattggtgtcatcatagaagaagggcaaggtgtggccatctgctgtggtataatcaattgtcctgggttctcctcaatctgccccattggatgatcttggccccatgcatcttcttgttgttcatttgcagcctgttgctgctgcactgcctcatcccaacctccagctccctggttaccagggttgccaaactgccaaacattgccagcatcggggtcatcatcagttgcatcatcagggcctggctgaggaccagcaggggggaggtcctcttcaggggggaatttataaaatctccctgaagcatgaaaaccgaaacagtccaagattctcccccacccccagcaccaagaggatcaaagaggacaatctttctcggcacagaatcctggtccctgtacttagctctaacaaaaaacccttcccaacattctgtccgcatccgcccaaaaagttaactgaccaaaagaagcaactgccaggtgcacatgatggagatcaataaaatctagcgggaaatctaggaacataaaccagccttctctatgaaagtttgccgccctccaattaggaccttggtcatgattaacaaaagtaccagggtgaaccccatcatagaactcaggcaaagagaggaccaaagcatccctattcatggcagacctcatctggaaaaaacctaccgcaaacgggtgccggaagctgttacgaacctcgtagtgaagttcatcttgaatgaagttggcaatgagggcccaatgatgatcccagtcttgctccaaggggattggctcaacaatggccacacaaaagtcttcatggcaccgagcagggcactgcgggacagtgaggtcaacccgcgggatgcatgaacagcgagcccctgccttaggaagcgcagcggattagggtttagattggccattgggggaagagggaagctatgggtgggaagcactgtgcattcaggagaggaagggtttctagaggaagaaggcgagatttccggaggaatagttttggccttccaaactgcagtagtccgagccgacggtttcggattgttacggtgcggggcttttgtgggcttagaggccaaacaggaacgggctaaatggcccggcatgagacaggccttacatctaagaggcctagagcaagaagccctcgaatgacccctttccaggcaacggccgcaaagattgatttccaaattcaaattgggtgacaaattaggatcccgcgtacctctggtatgcgaaattaactccgttgccggaatgggcagcggcgagacgtcagccgccttggagttcgccggagaagagcctgaacccatttccctctgctcaagctggtggaaaatagagattcttcattggtcaggcttagaggcacacagggagtcttttaaacaagaaaaaacatgcttgattgagatatcatgattctgaacagcttgagcataagaacgatccggccgccttaaggaagacgaagatcttttcttgggagccacaagcacccattccttttcctgttcccgactccaagagtcaaactcccactgccaattcggccccccatgtctccagaggaagaaacgaagagcaaaatcatcgcaagtataagatttaagacgataaacccacaaacccacttgcttcgatgtcacaccctaaaaattcaaattatataaattgttgtttaattggaatttctagaatttattttaaaaaaaagtcttgaaaagaagatatagttctaattaataaaatccaatataaaaagtggccagataaaatttcattaaatactttgcttaattctataattcctagatttttctgggatttatttgagctaaggaagtattttaataaatggaattgcatttaagaaataatttaaattgaaaaaggttttaaaaagtcttcttttggctttgggccgaaagtcggcccaaaacctctcttctctctctcctcggcccagccggcccagtccgcagccgcccgcgcgcgcgcgcgcgttcggtcgctgacaggtgggtcccacctgtcaggcccgtcgtcttcctcgggccgaaaccctagcgcgccgccgccgagccgccgccgctgtttccttccaatccggccgtttctttccttctccggtcgaatcaaaagaggagaaacaatctccgggatctcctctaccttttctcctttggaatcatcggttaaatcgctttggaaagctttgggatcgagttcgattcggatcggttttctttctctccaagccgaggtttccttcgtcgttgccgtcgccgtgggccttcgccgccgcctccgagcccctttaaaaggacccccggagtcttctcttttcgccgccaccctcgccttcacctctcgtcgccggaagagctctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccggagatcaccggagcagcttcgccgtcgttgacccgaaggttcccgccgcttcctcctcgtcgccgtcgccgtccgttggtcttccgccgccgtttaggtcaccggtgagttcgccgtgttgtcctctacgtcttggtgccctccgtttgcgtcctggcgccgccgttcgccggcgagcgtgcgccgcccgagccgtctcctctgccgagccgccgccgctgtcggtgacgtcaccgctgacgtcatcagggtcgtccgccgtgaaccgccgtggacccgatcgatctcggccgtccatcttggatcggttagatctcggccgtccgttcgcgtgaaccgccgcccgtgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcctaaacacaatcctttgagcatgttgatcctatatttaaattctctatttatttcaactgtgcatttattttcgaatgtcaccgggtggtgtgaacctgttcctttgttatggcctgttcgcattgattactctattccttgataccttgggttattacaatttgactagttgagctttatttatattggttcaactagatattagatataattgcttagccctgcttagaaacattagtacacattcgggataactaatgacttactaatatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgtaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctttaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattcgaacagaccacaaaggagtaggagcgatccttaagatgagagatagcgagattggcaggagatcagccaatggccgccctaagggccaaagccaccgaagaagaagtgagatgaaagctagcacggggaagatccacaactaatcggaaaggtgttgaactgaatttcgaagaaaaatggaccggcgaacggaagcgacgccaggcctcctcacgaatagcatcgccgggagagattccatcctcccggtggtgccggcgtcaccatggacgagatcaccggagatcgcccatagtcgcacaccgagaaaaccggagcctagcccagtcccctgaaaatgtagttccgacacaagttgaagacatggtgcatgacgatggttctgttgaggacaaaatcgacctagaggaaatgttacgtcatgcagaacccgaggtgctgatgggatcggctagagggttaaataactttgaagctttacaaaaggcagcaaaggaagttttgtacaatgagtcgaagggctctgacagtgagttcacaacactccggtcagttcttgaacttatgaggttaaaggtgaggcatggatggtctgataccagtttcgacagtctattagaacttttgcagaaaatgctcccgagacctaactcactaccatccagcacatatcaagcaaagaaactcatatgccccctttcacttggtgtggaaaagattcatgcgtgcgtaaatcactgcatactgtacaggaaagagtacacttctttagatgaatgtccaacatgcggtgcaagccggtacaagtcgaatagcaatactggcctaaaaccctctgaagcaactgagggacgacagagaaaaatcccgcagcttgtgatgtggtatcttcctgtcaaagaccgcattaaacggttatactcaaacccgcgagatgcggaactaatgcgctggcatgaagaagggcgcaagaaggatgggatgattcgacactcggcagatgctcgtaagtggataaactttgatgcttagtatagagagtttgctaaagacccacggaacattagattttccctgagtacagatggagttaatccttttagagacatgagcagctcacatagtacttggccagtgcttctcaccatgtataatcttcctacctggctttgtcaaaagcgaaaatacgtactactctgtatcctcatacagggaccccgacagcctgttattgatattgacgtatttcttgaaccattgttggaagagatggctgatttatggaaagagggattgaaagtgtgggacgagtacttaagggaatacttcacagtgaaggccatcatcttcgtgaccatcatcttcacagtttcaggtcaaattaaaggtaaaacaggatgtgtgatctgcttgaatggaacgtactataggtatctcccgggttccaacaagcttgtgtacatgcggcaccggcggttcttgaaagttcaagtgccttaatttggtttcggtgattaatgacaaatctatttatatgagactaacgtttttatgagcctttatttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatgtcatctctctatattgtttatatcgggttattatccatcaccaaagagagaaaagaatgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatataccacttcttatctcctacttttggataggttcatatatatgatttccatgttattgatatataagtgtgagactaatgtttactcgaatgttatcttatttagtctcatttacattgagaacatggagatcatgaaggtatatgttttatgttggtctacatcattactacatatgccttcactatatgtataggataaacccccattggtcattctctaattatgcatacacttgcatctcttgtatatttatttgtatgcatatatttagggggagcaaatcctatatatttattgtgcatgttctagatccatgttgttcacctattatttatatcgaatctttgcacttgagcttgcatacgagtatatgaaacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaggtcaagcttgttatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtttgatgagttttctcaagtcctaaaccaagagagaagtgggcatgtccaataggagtgagtgacatcttgtgggtatgtccggtggatatcctttggagtgtgagccctttatccttgacttaagttgtgtttattgcatgtatttttcatgggttggatggccctttgaataagctttccatagagtccaagaacgccaaattccgagacccgagtcaagagatatcgccgttttactaacggtcagttaagctgaaaagtgacctgcggtctgaccgtgggccttaggccggtctgaccggtcctgttagccggtctgactggcgtgataaggccggtctgaccggccccactggtctgttgcattggtctggtttttggtggcgatacagagccgccagagtcgcaaccggtcagaccgagccgatggcggtctgaccgagcggtggacggtctgaccggctactacactgcggtcagaccggccaggttgagtgggctcaatgattgccctgtaacggctagttttctagccgttacaaagtagtccggtctgaccggccactctatggcggtctaaccggcagagcacagagttggggatttcgacataacggctagttttggtggttgggggtatatatacccactccccagcagcaagggtaaggttttggcactccattgcattatcttgaacccttgcaagagctttcacacccttgtgcact

SEQ ID NO: 82131 - DNA, 12827 bp, Oryza sativa
  unsure (1)..(12827): unsure at all n locations
tattgcaaactctgggacatatactcttaaggaacatctgctcgttatttgtactagatgctggggcacgccaatggcgcgccgcctgcatatagattgcttgattagtgtagactaatcatttgttttcaggctgaatcaatgattatgtaagaaaaaaaaacctatgaatacatttgcagtgaatgccgttgatgagtaattttccatacattgttttacagattctgctgagaacaaaactcttacactttacaatctaaagatgaagcaccaatgcatataaaaaataaaatcaaagttttacataatgatcagagtaatgtccatggtgatgatacaactatatttgatcatacaaatctaccagtcaaaagaagacatattgtggcaataacattctccgctgaaaggttcacatccggagtattaattgcaatggacctgtccaagcacaatccatcggtattagtgagtttttttaaaaaaatgtttcagaggatatcttcaaatcagtatcagtgaacatattggaagctcagaagacacttattaattggatttaggaagtgtggcaacataattttcattttacctctcaatacagatagttatatcaagtgatacaacacgagactacatttgtatttattacatgaaaatgcagtgagagcaaaagaactctagaatttagattgatatgaaattaaacatgaagggtaagaaatttacaggataatcaactaataattatccttaactttttcctacactaaggcaaaagaaaatgtgtgtaaattaaattgactgtcactgtgaagatgatattctgtcagtcgaaaacgctaaaaaaaaatgcaatagcaatgcaaaagtaaacacctttcatcgcttgagttgtctcaagttgaaagccattcaagatccagaaagtttgaatcaccagaatgaaggcaactttctttcaacggctggaacatgatgtatctgaggtaccatgggtgtacctgtagcaaattttgagagaggaattaaggtttcaaaaacaaaaatggtagtagtccactatttaagacaccatgctttttcatgatttcctagtaaaatacttgtatgagaaggataaaggtcaaccctgaacgaatagaaaccaaccttaattttgatacctcactttcacagctcaatgaaatttcattgccatgtactgaattagattccaatactggaaattgtgacccacttttaacatgaaggcaaccactacatccagatatggatgtatttttttcacaaagaatgctgccatctgatctcactctttttattgtatgtggaattaaagaaaacagtataagaaccccttactgtttacagagtgcatatttcaataaggactatttttgttttattagaatgtaaccagcagggaagctacaaaaggtaataaatggctaaaagctctcgtttaaataggaacaaacatcctgctacagttcaaaaacgttttggaatagcaaaacagcataatatgcaactcctaaccatgttttcgctactgcgtaccattgactcctgtaccatgattttttcgctacttactgttttttaaccatgctttagatgatctctctgcggagaatatcttcagaaaatgatcatggtacagataaattagacaaatgttcagctaaaatgagaaatagaacaccatatggaacagagaaaataaaaaatgtgatgtcaagcaaatgggcaaatatattatctactgaagttaagtaatagaacagcagtgcagaatccaccaatgtcctccttcaatgagaaagagccttaccgcagcttatcattgtccaactgaagctaagcaggtttgtcaatataaatattgatttcataataaaaaaatcatgcaagggaagttcttttatgcgtgttaaataattcatagtggaagtctgaaagataagaaaaaggaagcactttagtgagcccaaatgctacttaagctattaaatcttaaaatcaaatgatgtaattccctttcaggcagccatgacaaccaacggatatcacttctccctagaataacccaattaaaccattgttcctaatttaatccatgatcaccacagagatgcacggtcacagttcaagtcagaaccaaaaatagagggaatgccatccagagcaaatattcaagattaccagaaccacttttaagcctagaacattcagaaattactccctaattaccaatttgcttttaaaggcagacgaattagtaatgaacatgtgcggaggcttgatgtggacggatcgaaaccaccgacttttaagcaactaaattaaatatacatggaacaccgacaaattccacgccattacatcaacataaaaatgcctagaatattggagtcccaactcccaaactaagctcaagtagtagggaaaattgtaaaattaatatatggtgcctacataatgttggcccaaacactgccaggaacaacacaacgtttaagtactatgttccaggtaaccacaggggtgaagaagagaactctgcaaatgttattaaactcaataagctatatagtactgaaaactgcgtccaaaccacaaatatagtcaagttgacattggcacttctcatatagattaagcttcaaaattagagttcgaaggacaataaacatgcccacgaaccaaccaaattgtccaacttggtagtataatttgaaacatgccaaaactctccatcccaagtttagatttgcaaggtgttatgtaacaccagtaacataacaaactgaactgagtgcagtcctgctcgatgaacaattattacaaaacacatcgagagataatccagaaagtattttctaatccaagataaatcatgcaatagcagtcctgtgaaatgcgaatttttttgacactgttcctagtggcaatgcaaaatgttgtatgcatggaaacacctctgccaccacccatgttcacactgtcaagaatggcaatctatacaacaaaaggaaatgtgcaattttatagccaaaaataaaaactaaatgaaaggtttaaaaaaagttcaagaccatgctgttagagcggcttcaagtaggtgtctagaacatagataaaactatacaaagggtaaagaaaatccttacactcgttcaacttacctagtagtttgataaataaaacaaggttaatacggaaggaagcctttggaaatgaaaagaaaaaaaatagttgcctgtgtatataaaagtttcaagcggcaaaataaatttaatttatgcactacatctagccaaaactttgctccaaacagctcaattaaaatgactggtactcaggtttcagcatcaagtagcaccatttgcatctctttgcaatgttgctatttccttcagcaaattattaaacagtagcataaccacattttcttggaatattttttagagtatagctaccacgcagtgaatatgctgataactaaatggcttgtatcaagacttgtaccaagatttttctggtctgaaatgtgtagaattcatccggacaaaaagcgagatttgtgcatcaggagagatctagctaagttttgcacttctgactggaaactaatcccacatatcatttgaatgtgcaggcaatcattcacagcaaactatcgagaaacagtaatggataaagaatttaatatagagtcaaaaggaccaaaatttgaaaataataccagcaattatattgttttatttgtgtagcaacaacatccatggtagatgcagattcctactgctcaagcacttcacgtatgcagtgacctttaagccctgagagagtggaaataaccattagatgttattatgatacaagtaatcatctgccaattagtgatcaaaataaactttaaaagattatttgggcgacatattgcattaagatcaaatngactgtcactaagtagccatgcgaaaatttcagtgagttggcatttatgatgatagatcaagagttcccccattgtgccaaagacataaataaacaccggtaatcgaactttgttagttgaaattatcatattcatcgactgctgatctaatacaggaaagtggcaagtctgctcgcacttgaagctcccaacgtctagtggagatggatgaggacttaccgatcatgcaccttgacaaatatcttcagctggagaaacctattgatagagatcctgtgcttggtggagtactcatcaagcacacactccttcatggccgcagcggtcaccgacggcggtgaagatgctaacaacaactctagtgtgtcttcgcgagcggcctacagaacaagcgaaacacttatgacagcaacaaaaaaatggatcacatagctaaggtccgcagattagggacctgagcgcaggcaccatcaacgcgacgtgcacgccgttgccgagccctgaagccgtttgtattcccctttaatccgtcttaacatttttgtgaacattgcagctagatttctgctctagaaaccaaaaactactcatttttgtaaataaaacagggaggatacaatataaacttctaaactaccctaaaatttagatgcaaagaaactcaattttcagatgctatattacttgcaaaaaaaaacttgagatgtaaacctgagtgaatgaagtgcataccgggagcaggcacagcggtcacggtactgcaaaccgcgcagcaaaccgacgttgctctggctggacggcacccaaagcagacgagctggctttgggcccctgaaattgcacaattatggctcttcagagttcggagactgactgaatgtcacatttcagcagctaacattttcattttcagacaacaaaagaatctaccatgcattaatttcttttaagacaacaaaactcagcagtaaaaaaacttccattttctcaacagggagttctctaaactttcaggatttctatgagcagaataaactgcaacctctgaaccaggaacaataacactatggcgaacactatggcatgtacatcttgggaaagattcaattttttgaatggtcgtgagaaatatcaaataacacttaggccaacatttctaggtgaccaaccaacatcagggaaaaaaaactcaaaaaagtagctgtgttcttgcagtgccaagttgtaatccataccatcgggaggtgtaaatggaacaagaggagttggatatggaggcaaggggaaccggcattgccgtgccagctgcctgaaccgatggcatcgcttgtagatgcttcgcagattgcggcagcagtcaggtaactaaaatcacatttcctttccctacatgaaagaaaccttgcagaaagatgcaagagaagctgatgagaaaacaagatttcagttctgaagaaaccagtgaaagctccaatggaaaattgttaaacatcacttcagtttgcaacaagaagtttcaggactctttatgcaacagaaaactggtttagcaatgcacatcagttgtaaaaaatttcagcttcttggttgaatctctcattaaatctgatgttcaggttctgtttacatataccaaaaaaataagaaccaccccataattcaagaaagacatatgcaaaaaaaagttaattattaaaacagaaatgaacgcgctgatgaagcctagagggggggggggggtgaataggctgtccctgaaaacttaaaaacaaatcgcatcggtaaaattcaaacagacccagaacttcctggtaaggaactccggaacttccggcctcccaggcccggaacttccggtgttctaagacatgaacttccgggtaacagaacagagatgaaattcaaatttaaaaacaggagactaagccaatcttcacaagatggtgcacaggtattctaagaagaggatatatcacagaatcatccacagaaatatcacagaaagagacaagagcgattttttcccaaagttcggatcttgcgatcctactctccgttgaggagctccaaagagctgggtctcgattaaccccttgcctcacttgtgcaaaaaccccagaggaaatccacagccttcaaccccaaacacccctaggcaagtttctagaattgagtgaccaccaagatccaactcaacctacttctagaaatccaccacaagtgtgggttgctctacttggaaagcctctagaatctcagcacaagaacttcactaacttacctcgttccctttcggaggagaggaaatcattcacaaacttacccgggacatccacaatatgcaacggattctcgcgggcgacacctaaccgtctaggagatcatctccaagagtaataagcaccgagatgacagcccacgagatattccaagtgctcacacaagttcctagtcttcacacctccccaaatcttcttctctacctctcaatctctctttctcacaagaattaggctctagattgagtggagaaggcaagaaacacttgggagaggctagcaacagctctaggtttgaaaagtgaaagtggaatggccaaggaacgagctggaaacgagctgtatatgtataacggctaggtgacgacatctagccgttactcataattttgaactggaaactagacaggaagttccggacctggaagacaggaacttccggactacacttaggaaaatctttttcacaagaccggaacttttggacctggaagacaggaagttccggacttgcacttttggacagatggagtatatgcaaaaaagactcctagggaaacttgacacttggttcacactaagagcacttgacatatctcagatcatcacctggaacccctcttaatagtacggtttttcctaaaaactcgatttcaaaagataaactatcctatgcacttctcgagttccggtccgctttgattttgtacttttggggggtctccaagcatccatcttccacacctttggactaatgcacctgaaagttactcaatgaactcattaatcccttaaccacatttgtcatgaatcaccaaaacccactagggggattaatgcactttcaatctccccctttttggtgattgatgacaacatggttaaagcttacaaaagattgaaataaattttgttttgaatagttagaggtgaatgaaactcccccttagtgtatgcatatggaagatatgagtgaagctcatatgcatatttataagggagcaaccgaggagagtttccttcatctctactcattcgtgggatgcaaataaacagtaagaatagatatgatatgcaaaagatacgacatggtgagcattcaaaaggataaaatcaacatcacatcacaatcaacaaataagacactaatagcataaatgaagtgcaatatatataaagagcagctaagagcatctaacagacattacatccacacaaatagagaattattacatgtccataagttcttaagagaagaggccaaaggactgccaggtccggaacttccggataaaaaacccggaacttccggacatgttgacaggaataaatagcgagggagctgccaggttcggaacttccagataagaggatccggaacttccggataaacagacggagtaggcagcaagcagcaaaaacaatattttgacccccttcgattgcaattttctccccctttggcatcaaggcaccaaaagagacaaaatcacaagggaagaagaggatcaagcctcatcatcatcgccatcagagggaataatctcggtgtcgccggagtgaggagagtcgatgtcttgcccggcggcgtccactgcctcatctggatctgtaggtacattctcagtaggtgcatcggactcctgatcatcactgctctcctcggagtgggaggactcctcattgaagaaacgagaagtgccagagggaccctcactactagcaatgtctcgagcagtctcataagcagcaaaaggatcaacaaactccttatcatcagaaatgtcagagacatccttgcctgctgcaatccaatcttccttctgacgcctctctatcttctttaccttcttagctgtcttggcacacatacaaaagatagccctgagagccttctttatgggagaagaagactcagaacgctgtggtgcagcagaggaagaaggagcagctgaggtagaagcacgagttgccctggtagaaggagtagctgaagtagagggagcatgaggtcaaaaaggcttgtgttgattgtccttgaaataacaaatcccagtcttggcctcaaccatcttcatgatataaggagcataaatgcagcccctccttggctcacacactgtctcatagatctcactccagataagcttcataatgctgaaatctggcttgttgtagcgcatgcgactgaggaggagcgcatgcctacctggaagggctgtagcatctcccactttggggagcaaagaccaccttaagatggagtaaagcactctatagtaaggacgcaacccacgagtagtccccaaacaatccttgggagcatccttctcatacaagaaagtagtgctggtcggtgacaaagcatcctcgacaaagatatgtggacgactcaggtcatcatcatctaaccccaaactacagcaaactgtgccatagagaccctatattgctgcccctgaatggtccacttcacaaaatcaagccccttcttggtggtgccaaagaaagcagtggagtagaactgtccaatcacttcctcattccaggaataatgcaaggctaacaaatctgccacgtgcttgcgctcacacaccttgcgtacctcattgaagactatgttgttctttgaggacatgtactgccagtctagccacttcatttctaccactggatgagatcttcccataatcacagagttataccaatcaacctgcaccaaggtcttgaatatgtcatcctgagagtcagcaggcagagtatcaggactcaccattctgtcctttccacacttgagcagattcttcagatagttcactcttggccgtctaggatcaggatcaacagcccttgtcttgtacagcctcaaaggattgctttcagaaccaggctcatcctcattgccaccatcatctgactctgatgcagctggagagggagagcggggagcatcatgaatgacaatgctaccagccctcctggaatagatcggaatctgactctcactgtaaaaatctccaactttttctttgcccaatctccccctaggaccacgaaccggggggctcaagtcagcaggaacatcttgtgaaagcttctgtctcttctcacgaggcatactgaccactgcaacaagagtcaacaaggttggagtgcaatgattaaaagaaacagtagaggaatcaaggttactggctgtctggacagagaccggaagttccgggccaagaacaccggaacttccggcctgcaaaactgaagaacagagggttcaatcaggccagtgcatgtgataaaatcctatagttcggcaaactacaaggtagcaggaagaattctatccaaaatgttttctccctaggttcacatatttagagatcggggcaaaaacatgatgaaccaaaagagaagatcaaaagtgctaccttgagagaggaagtcgcaaatcgatcgtgggatgatcctcctagccaccaatgtggttgattccatggagaggtatcaaatttccatggttgaaagtgaaaatcgccaagatgagtactgtagcggaggctagggtttgggaatcggggaggagaagaagtgaggagagagatggcaggctcgggctccctctgggtatttatacccccgacccccggaagttctggactgggatgactggaacttccggcctgacagaacagaaggcagtcaggcccaagttcaaaggaatagatgagaattcaaaggaatagattagaaatagaaacctatggacatatagagacttatgatgcatatgaccagccaacaatcaacattacataacaatggtcaatatacatcataagaagaggataaaaaccaaattttcgcaataaaaacacacaaaaatttttgcaaattttcacaaaagggtttttggataagagagggaatgtttgagctttattcttggtatcaagaccatcttctacacaagaagtgatctcaagacacaaaagctcaattttttttatatatttttttaaatttacattttagtgatacatgtttggctatgaattagccaaccacccatcacctaatgttacaagagtctaagatattgagctcactcccaaacttcttgagtatgtctttcacgtagttggtttgagagatgaaggtgccctcttgtgcttgcttcacttgtagcccgaggaagaaggtcaactcgcccatcaaagacatctcgaaccttttagtcatgatactactaaattcttcacaaaaagaggcattagtagaaccaaatattatgtcatcgacataaatttggcatatgaataaatcactcttaaattttttagtgaagagagtagtatctgcctttccaatttcaaaaccattcttcaaaagaaaatctcggagacattcataccaagctctaggggcttgcttgagcccgtagagcgccttgtggagctcgtacacatggtttggcaactttagatcctcgaaccccggtggttgctccacatagaccaactctgagataggtccattgagaaaggcactcttgacatccatttggaataacctgaaatcatggtgagcggcataggctaaaagaattctaattgactcaaagcgagcaacaggtgcgaaggtttcaccaaaatcgagaccctcgacttgggtgaacccttgcgcaactaaccgggctttgttccttacaaccaccccatattcatcttgcttgttgcgaaagatccacttggtgccgatgacattttgcttgggtctctccaccaaagtccatacttggttgcgagtgaagttatttaactcctcttgcatggccatcacccaatccggataaacaagcgcatcttccaccgtagttggttccaaagaagagacaaatgagaagtgttgacaaaaacttgcgacatgagagcgagtagttaccccttttcttatgtcaccaagtatgttgtcggcgggatgatctctttggacagtgtgatgtatccttggatggtgcactggggggacttgagcctgatcaatatgctctaaagtgcccgcagcatcgatcccatccacttgtgccgttggcacgtcttcactgccactggtccggaggttccagactatagaacccggaacttccgggcctggagatgtccggatgttccggtcaataggacccggaacttccggctcagcagacacagcacttgtagggctattggatgtcgatgacggaggttgatccctatcttcttggtcatcctgcgtttcgactggtcgtatgtctccaatagccttagtgcctatagcttgacttggatccacatcacctacaacatgtacaacaacttgctctccttgggagccattagattcatcaaatgtcacatccctagtgacttcaacaataccggaggttctgttgaagacacaataggcatgtgcatttgattcatagccaagtaagaatccctcatccaccttagatgagaacttcgatgagcgaggcctcttacttaaaataaaatatttgctcccaaagacacaaaaatatgaaacattaggcttcttaccactcaagagctcatatgaagttttctttaggattttgtggaggtacaagcggttgatagcatgacatgcggtactcacggcctccgcccaaaagacatccgaagtcttgtactcatcaagcattgcccttgcggcttcaatgagggttcggttcttcctctcaacaatgccgttttggggaggaccatagggggcggagaactcgtgcttgattccttcttcatcaagaaattcctccacttgagtgttcttgaattctcctccattgtcgcttcacaccctcttgatagtgagatcatagaggttttgggcttgctttgcgaagcgcttgaagacatcttgagcttcgcttttgtcatggagaaagtacacctaagtgaagcgtgaaaaatcatcaacaatgacgaaaccatacttgttacctccaatgcttatgtaggccacatgcccaaataaatccatatgaagaagctcgagtggtcttgttgtagtcatgatattttttataggatgtggactcccaacttgcttcccggcttggcaagcactacacacacgatctttctcaaaagaaacattagatagaccaagaatgtgttccccttttagaagagatgccaaattcctcattccaacgtgggctagcctacggtgccatagccaacccatagaggatttagcaatcaagcatgcctccggattcactctatccacgttgaaatcaatgagatagagatcaccctttaacacacccttgaatgctatgtaagagtcatatcacctaaaaacggtcacatccacattggtaaacaagcaattaaatcctaacttacacaattgagacacggataataaattgtagcttaatgaattgacaaggaggacattagatagagattgattcttggaaatggcaatcttaccgagacccattacctttcctttaccatcatctccaaagacaatatcttcacgacttccaccctcctcatcaagacttg

SEQ ID NO: 82132 - DNA, 4002 bp, Oryza sativa
tagggcggtcaggagagggaatattccacgaatatgttggatgagtgcatgtgcttctggtcaaattgggtagatgaggatatccacccttactagtcttgactgttagtaattaatcagtgataattactatattctgttgttaattagtaattaacttgtcaaaaatagtgttgataagatataattagtctattttatggccaattagtatagtttggggtaaggttaacgataactaacatatgtcattgttacttaatagtttattgttttcattctattcaccctcattcatctaaccatacaaaaactagatggttgtatccactcaactaaacaaaatatggatcaccatatccctcaaatatggatcgccattattgtatccaaccttgaccatcaactaaaagcaccctcagctcatgagctactcgcaagccagctcaagatggctcgagcaaacaaaccatgagtttttcatccagccctagggccgaggtgaaataacttctaagttaggggtccttgaacttgtttaggctttgctggcaagtggtctaggtcattttgtttgctagcaagttcattgtctttctatccttttgtttatttttgagttttgtacttttttttcctattctttgatgaaataatatgcagttctcctatgtattcgagaaaaaaggtatagaaggaaaaaatcacttggttttgtttttgtgttttaaccaccaatctggataaaacccatctctcaactttctcaaattagttgatactcatcccttatacttccattattcttgttgacaatggttttcttaccactgttgaactaatctaaataaatttgggcaatctacatttctagcccttaaattttgctcaatatctacttcttattctaacctaaaaagcaggttattttttgtccccaattttctgaactagacaaaataacccctcagagtatttttaagtagttgtgtataaaatggaggtggttatacttgttcataattttattttgttgacatatgtgtgacttaattaattcacaagcattaaacttacctaattaaagttcgccttagcataaaattcactattgtaccaatcaaaattaccataaatgtgtttagggtgtcatggccccaactttttaaactgacacatatcttgctaaacttttcgtgtaaagcaggatgtgatgttgagtagaacagaaccatggaagaagtagtactatatgtgggactagctggatgatgatgtgactccatggaatcctttcttactataaagttgtaacgcactaattcctaaaacttaacatgcaaagatgccacatcataaccctttaacaattattatatttaagcatcatgcaagcatctacgttacctggatactcctctcaggcctcgtatccgtatcggatacgaggccggatacggatacgtatcggatacgccccgatacgtatcccgtacatatcctctcttttcttgattttcaaataaataaaaaaattcccgatacatctctgatatgttcaaaacctaaatccatcgatcaaatccccagcctgcatcgagcgaaccaaattccacagtccacaccaccagcgccgcctccccaagccctgattctgctcgctctctcctgcgtggctgcgtcgtcgccggctcgccgcgtcagcgccaccgtcgtccaccgtcgccgggccgcgcctccgtcgtccgcggccgccacgccgcgcttccgccgtcgccggcttgccgcgtcggcgccaccgccgtccactgtcgccgggccacgcctccgccatccgcggccacagcgccgcgcttccgccgtcgccggctcgtcgcgtcggcaccggcgccgccgccgtccaccgtagccgggctgcgcctccgccgtctgcagccgtagcgccgggcctctgccgtccgctgtcggctctgccaggcgcagctctatcgtgaagggaaagaactcgatgagcattcttcctttttctttcatgtgaatgagatcttacactctcgatgggcaaaaaatagtactcccctgcattgcttggcacactcactaaaccccaataaagttctaattcattttgttttttttccatatcttgtaatagttgctagcagcttgattttttttttacaatgtgtaggtattattgtgaaacttggtcggaggatgttccaactagccaaggctctcatatggatgcagagattttagaaatgagaaataaatgttttagaaggtatttctctgaggatgacttaagaaggatcaaacaacagtttgcagatttttcattgtctgagagtgggtttaattcctttgactcaattgaagatagagcccataatggaatctgatggttggtcgcttggtgttggcatgctctgctctgctaattgtctagtttactcttcaattttttttgtattttttaatatatatatatatatatattaatatatatatacgcgtatccccgtatcgccgtatctgggttactgggtaacataggcaagcatatgctatattatctataattttataaaagcttaacatgcaaagatgccacatcattatccactaacaattattacatttaaacatcatgcaagcatgctgtattatctataactctataaaagcctaacatgcaaagatgccatatcatcattcactaacaattattacatttaagtattatgcaagcactctatattatctataactttatagtttattaaattttagagatataaaatgtaagcatgttaaatcattccacataatttacataatatttcaatatatctctccatcatttttttaatattctatatatctatatagtttatcctcacttggttaaatattatttctcttttctctcattaagccataccacatcaattgttttagcccttggatatatgcataaattatcttccttctcttgttctctcataaagccacatcatcttacttttaaatttgaatcatcattctatatactatttaaatttaaatcatatcaacttatgtaaacttatgttgtttacgttatcttacacattgttttttacttattgttatcatagtaaactcccgctgcaatgcacagggtttcacctaggtagtgatatgatcgctacaccacaaaatcattctcaataccaattaggaactttttttaaaaaaaaaccaattaggaacatattttgtctagttttgtaagtttattgttgccgtcatctagtttcgaagttgagggacaaaaattagacaacacaagtttaagagagatattggagaattggcttgtaggaattgatgaaaaaactaacaaatttatggggcatttgctatatgttggactctataactttgtagaaataatatggtgttggacaaatccttatctaaataaaaaatgcagatccttttcatagcaatgttctgattttggttttaggcacaactacaaatatgtgatgatgacagtgatcttatacatcatatcgtaatttagaatgaacagttatacttttttttttgtcaactatggatggagatttataaataggtttcaacaatgttggatttctatttcatattaaaggtcattagtttgtgcatcgtatcctattcttccgtgctatttgttgagaggatagtatgtgctcttctttaagagaatggtttgtgctctttattgagtgaattttagaataattagctatagttaatttgaagcaaatgctaggatttatatccttatctttaaaaaaagtttaagagaaagataaactttttactcataggaaaacatatacttgccgtatgggccgcacgaacaatatgcacgagacgttcgtagtctaccattttataccgaaaataaaaacgaaacgagacgtattcgcccacagtaactgcctgccgatgggcctcttacgt

SEQ ID NO: 82133 - DNA, 10469 bp, Oryza sativa
aaaaaaatgtggattgctgagggatttgtcccaaatataagaggatatacacaagaagaagttgcctacagatatgtagaagagctggcacagagatgtatgatccaaattgaagaaagaagtaaaaacattgggtggataaagaaaataaaagttcatgatgtgttgcgtgagtggggaattggacaagccaggaaggaaggtttcttgaaagtttgctcaagcggcacagatgtggagacttattatgcagatgaacagaggtgttaccgtgtagcatttcatggttactttgataatgaagtgggaaaatcagttctgaatctccgttctgtgctggccttcaaccctgatggcaaacgtctgttttctttcaatgggttgcatttgttgagggtgcttcatttttgcagttccttaaagacatgtaccttgcctgaagaaataaacaaattggtacatctgagatacctgggtttggaaggtagtactgttttcatgttcccttcttatatgaaaggtcttagaaacttgcaaattcttgaagcaagtacagctactgtcaaggcacttccaagttccctctggagcatcgcagcactaaagcatgttcatgtctaccaagtactgcattggaaagcccaggagattagaacgaaacgaagcttgcagactctttatgtattttccataatgcagtgtgatgctctgacgtggaaaagaacaatcaggtctctgcaaaaaatgagccaacatgtttcctggtgcttagggatagcctctactaaacgcgtgaaggaaaaagagacccaagaacatgaagaatacaatttagatataagggtagatgccttagaatccaaagttgatggtttagaattgtctggatgttttaaagagcgtcacgttctgaatgatgtgcttccacatcataatctattcccaaactttctattgcagctcaagatatcttgtcccaatatactaaatgatgatccaatgccaattctggagagacttccacgtcttgaagtgcttgaaattgttaactcatcatacacaggaaagagaataacatgttcttccgagggattccttgcattacgcagtttggtacttatggatattggtttggaggagtggaatttgcagcagggatccatggcgtttctcgctgttttgactctcaagtgtaccatgctgaggagcatctcaaatgtacttcaccagctggatgatttggtagagcttcgcttgatttgcatgcctcagctctctgttgatgatcatgagccagctagggggaggggatgccgtgtcatgatttcagttgacgaggaacaaacttctgatacttgaatttgtaagtgaccccatgcttgaactaacttcattgccatgcctctctagtttcagctacaagaaagcttatattctttccccattttggataaattgcaattttgttattcctgaggatgcatagcaactgacaacatatctgatctatcttcttatatgttaaaccagagggtttcccagcaaaataatctacgacgtcatcttaaacacaaagacttcccgatctttcattctggccatataggctgtttgatcattcatatacgcaaaatatattcagcggccttcatagaacttccatcacttgcatttgcaaccaggtctatctctttctctcctgatgtactatctcccactccttcctttccacacttgggatgccgcctcctgttccccacaaagcatcataccattcccaccccttttggtgaggtccaagatatcgaggcagaactgcagcagaatttccatccacaatcaccttctaaccagacaggacgagttttatttcttcctcaagtaagcagaggaattccattttctgtaagtttgtgataggttgtttttttcttgaccagagaccaaagaggctagctttttgtagaaagcagtatagtgtacataataggatgtgtttaactcaattgtatatagtgttttagttctgtatcgaaagagttcttatgcatagaagatgccccttaaaaaatacatgcaagatatgccatcctgacccacatgtcattgactcatgtgggtcctacatatcattgagataccgatggcatatctcaaactttacaaaattataatggcatggttccaaattacccatactagggaaaattggaactatgctatatcggggtggggctttctatcaaaaaagcaatttctcaacagtcaggtttgtgtgatccaaattatgggtatttttaaagtttctaaatgtaaaaggagcagtttatggattatggttagcaatattatggattatgcttctgccatttgttaagaatattgaagacgctgtgtatatagccaaatatatttatatattacaaagcagtgtgtcacctagtttagtttgtgcttctactgttcaatgtctgctgctcaactggcttgaatggacgcctagttggccagggttcagaatttcataatgaaatttatgaaatcaggtcttccgatctcccttaggatatcttttccccccaaaatagaaaaagttgtttaaattcagtcaatgttagttcaattttaattgtattttttaaatattccagatatttctgttctatttgtaccccaaaatgtttttatttccgcaacttgggatgaattttgcagaaagaattaaataagccatatttcgttcagatttcaatttttttgcccgttttataaattattttagaaagtttcatctatatggtcgcaaagtattgctaaccattacttagtagtaatatgcccgtactaacgctacggcgatatttagtaatgtgaattaaacaatcatatgctaaaagatacatattttagcaaaataagttcaaatgtctcaaaacctgaaaaaccaaacaatggtatatatattgttgtaatatatttggtctaaaaataatttcatattcctgtaaattatcgtacatgttgtagtaacatggtaaatttgaatttaccaaacctaagggactgtgatgccaggatctacaggaactctagcataatgttcatatcaagcagaacatggtgaaattcttcaactacttgcatacacaaagtgctcaaatctgttgattacttcaggtgatggaatataatcacggaaaccacaaatctaactgtagatgcctaccaacaagtaaataattgattgtttaaagaatctcaagaacgtgtgttagcttgctattcctctatagcacatgaaatttactatgatggtgggaacaaaaatcatgaaatttatttgtcgcagctctaatttcctaatgaacatgtacatccatcaggtattttagttgatgcagacacacatggaacatatattactcccatagatatgcacctacatagtgaaagtagtagaaagaactatccatgtgacaatcattaaaaccttgagaacaatctaatcctaactgataatatttctggtcatgcaatgcagtttgaaaatcattatctaggcagactttagtattatgggtagcagcagcacaggtatatcaagatagtgactaaattagtacaaaatccctatctctgaaggacacaaaagacaacaataacctgaaaaatatcttcaagatattttctttggcttcattagaattgaatcctaaaaacccacacagctccttgttcaaatggtattcacatagacactacttagaattgattatccgacacaaattacttgtgcctgaataaagtaattcagcaagattcacttagcataatgccatagtagcatgaaatgcaaattgcggttcatgcacaatccaatcatcagacttgcagggtacaccaactctgactctatattctttctgtttctgctctctaattagtgatagtgaaagcctctgttttgaatattatacaattgctaaatctagcaaagtaatcctgcaaatcaaacggcacaaaagttaatcaaaacaaaacgccattcctccatcagaattaataaaaatccaacagggagattgatcaatttgtcatagtaattaaaaaaaaagctagctagcaatagaacagagctattcacctattcttggcccctcgtctgcatcggcatgccggcaccccgtctccactttcacctctccacagtgcctttcctccaaccctaggattacatgcagattacgaaaaaaatgggactgcatcctgatctagtagcaaggaaccggatcaacagcgtgtgacagcgtctctcccgcaacctcctccatcgtgctggcctccgatcgagaaagcgtggtgccccagcggttgtgctcatctccggtgaccgcatcgctcactccgggtgacgagcagcagcgatgagcgcgcgacctcgagcggcggggagagaggagaggttagggtttagcgttctacgggaagctggggtcagcggcgacgtcaatcgtggcgaggcggtgtgatggtgaagatagctggcggcgcgtgacggcgtgagagggagaagagagagattagggctggggaggagcgatcacggtttgggcgcggttggggtgggaagggggcactcgtttgtggggagggtgaatctggagcattggatttcacagggataatctagaccgttgagcgatgaatgaaagaatgaaagaatgagtgaaagtatttgttgaactatagggtagattgccaagttgccattatcaagtcatggaaggatttcaattagaaggataattcagtcatattttttgcatgcatatacagagtcacatacgcatacatatacagatttagctagcacggcacacattcaaacaccacatatatgtaaattcatatgctatgacccatcaccaaattgttcaatcaatcaaattccaattaaaaataaagctgttaaatatgaccacacactaataattgaaaatgatagtctaacagtttcttgaaccactataaacattgggttaacgattgggatggctaatctctaattgttcttaaactactatggaatcaatgatctcaaaaactatgaactattgcattattacattacatattgtgataattcaaaaaaatgcaagaaaaaatacgcctttataagattttgcgattttgcttgttgtttgccatggccaactagttgatctcgtcatatcaccttgttggagcgtagggcaagggcattgagatagaacttcttgagccatgcactatcgatattatttcgccttgccttgccagatcaatgacccaagagcttggagtggccagattcagcaggcactaagcttcgagtggccaaattcagtaggcactgagcttggagtgaccagatctaaaaggcttcatcttcctgtcgccatcatagtggcccatccaaagatgttaccatgcatcggcatactgtgttggattcgataacctaagctcgaagcacttgatccgcttggcattttaaagcgcgccaaccatgtggaagcaaccagagggtgccggtggactctgcgtctcacagtgcctaactggcttggacttactcacaacaacaaaggagggagcgaaggggatggcaatggatgagtggccgctgtgagcctagatctgacaggtggaaaaggggggggggcagatgagaggcaaatagggcaagagatggcatagctagctaggacctcatgtgagaagaaaaaagtcacataggaagcccgtggggtgggagaatagaggcagagtggttgatcctgcctaatctgtaaattgttctctcttcttttttctttgagaaacatagtacaaacgcaggcactcataaaacacgtatactcacctctatgaacgtacacatgcacatcctaccttatgagcacctccagaaaacttggtcggcataccttgagattgacgaagtcaccaatatggacgcctcgctaccgacggctacatcgcctaccactgaaagaataattaaccataaatgcgagtaggcgtgtctagacttgaaccagggtaggttagttctaccacaaggaacctaaactacaaataataaataatgttttttttatcaggaagtattaaacatcggattcacatttttaaccgttctcaaatatgaccattcgagtttgatctctaatggttcaatgataatattaagaaccgttaaagattagcatatgttgctttgtgcttagccaccatggaaggagagtaatattgacgtagtgaataaaatttagttgtatgtactaaatctcgttatatgaattaatgtgtaaaatttgaaaatataccttgtttttgaagtttttgcgattatatacatttttttgaaagaatggtgaaaatatatgagtaccgcgatatgaagacgcacgactggttgtttcgtgctgcgtggaggcacgagactagttgttacgaactctgggttcctgacgaatcgcacagggatttgagggatttgaatcaacgagattttagagttgcaagaggaagaaacagagcaagcagaggaggaagaggagataggtagttggtttgatagcttcttgtttcagctgtcgtaggttctcccatgtcgccagagtagcaggaagaccagtccatattgcaccactcataatgtacaactgccttgccacgcttgatcaactgtcggcgaaggatggcttcgggctgcacaactgtagaatcatcaaagcagttaaggggaagatctgcgctttctggtgtgttaggcttcagagcttttttcaacagggatgcatgcacgactaggtggatcaaactcccttctggcagttctagatgatatgccactgctccaacatgagctaacgccttatagggaccaaagaagcgaaagctcaacttctgacaggatcgtcgagccattgtcatctgaacatagggttggagtttaagatacatcatgtcacccacttcaatttccactcagatcaatgtttatcagcttgtgccttcatttgttgctgacctctaagaagttgttggtggagtatctcattgaggtgtgctctattctgtaaccaaatctgaacatctggcacagtacctcatatcaaccaagccaaactgatttggttgcctggcaaacagtgcctcatatggggatttgccaagagcacagtggaaagatgtattgtaccaatgctgggcttgtgccaaccaatcagcccatttgtgaggacaagcatgaactgtacacctcaaatatgcttctagacattgattcagcctctcagtttacccatcagtttgtggatgatatgaggagctcatattcaacttaacatctgccaaacgaaacaactcttgccaaagtgcactggtgaagaccctgtccctgttagatatgataacttgaggcatcccaaagacatcatagatattatgaatgaaagcctttgctactaacaaggctgtgaaggggtgagtcaggggaatgaacttagcaaatttggtaaatttatctaccaccgctagcactgtatcatagccatctgacttgggcaatccctccacaaagtccatactgattgtatgccaagcatgcagaggcactgggagaggttggagcagcctaggagttttgcaatgttctgctttggcctgctaacaaacagggcatgtctgaacaaaagtaatgacatcctatttctgacctggccaagcaaaaagattcttaactcttttgtaagttgcatgtataccagagtgacctccaacaccactgctatgtaaagacagtagaacaacttgtttagcttcttgatggtttccaagccaaaatttccctttaaacctgattactccatcaacaagagtaaaattgtacaatcctgcaggctgaagggtaagtttctgccgtaactgttgagtgttagcatcctcatgataactttctatcaccacttccaaccacctaggctggcttactaagatggcctgaagcacttcttttttgcgatagggatggcctgaagtacttcagtctcttcttttctagataaagcatctgctacactattgtcttcccctttcttatacctgatttcgtactgcaatcccatcaatttataatgaatgctttatgctgcatgttggtggtcaatctctactcatctaggtgaatgagacttttgtggtctgtatagataacaaatggggcatgttgcaaatattgtttccatttctcaacagccagtaacatagccatacattccttctgataaattgacatggcttgtgatcttgggctaagagccttgcacatgaaagctagaggatgtcccccttgcatcaggactgtctcaattccttctctacttgcatcagtttccacaatgaatcccttagagaaatcaagcatagacaggataggagcttgcactaatctttgcttgatcagatcaaaagcttgttgttctatgcctgaccacttgaaggccacatccttcttaagtagatgtatcagtgtctttgctaacactccatactgttgtatgaatcttctgtaatcgccggccagttccagaaatcctctcagttgtttcagggtctttaccactgaccactcctgtactgctttaatttttgctggatctgtggcaacactgtccactccaataatgtgtccctggtactccaaatgttgcaaggcaaaagaatacttaatgattttaatcaaaagctgatgctgctgcaacctagacaacactgccttacaaacttcttaatcatatcagcaaaaaatctgttcatcagctgttgaaaggtggctgaggcattagttagcccaaatggcataaccttgaattcatacaacccttggtgagttctgaatgcagttttatactcatcattctctatcagtcgaatttgatgatacccagacctcaaatccaactttgtaaaccactttgatcctgacagctcatccaacaactcattcacaactggcattggatacttgttcttgacattgatgttgttgagagctctgtaatgaacacaaaaccttcaagttccatctttttccttcactagcaacacagtagaggcaaaggggctgaaacttggttgtataattccctattgcagcattgttttcacctgtttttctatctcatccttttgagcatgtgcatacctgtaaggtttggtagtgacaggtcttgcattaggaaccagtggtatcccatgatcaaaatctctatgtggaggtaatttttttggctcttggaagattgactgaaattcttgtatcagctcctaaactaggagtggcactttttcacaatcatctgaacttccagaaattgcacacaactgcactagctgagagattgatcctgctttggctaaaccagttaattgcttccctgatatcaacctacactggctagttagatccttgactccagtcagagtaatgttgcttcccagtgttcatgtaaaaacacggtagcctgggagatctgcttaactccagtgcaggtccaaggctagccttgagtgtataaaggacgtgccagctaatttaatcctgcaatcagcaagcaagacaaaatagtcagccgatcggccgataggctgatagcgtatcgttggtggtctcagctgatgtagttagactaaatcggctatggactggatatatcaaagaatattaaaccctaaatacgccttattggctgtaacactgtctatcaagattgataaagaagcttaagacaatattatcaaaatagccgatgtaatagtatctagagcaagaaagaaaatgtactagctaataccctagtacggacttatataggcaaatcaatctatataaatatatcaaactgtgatcagtttgtagtttagataactcagccaataccgatctagcctgatatagctatatggaatgatatgtctatatatgtggcaaatatatataaaacttactaaagaagcatgaatattaggtaagatcagctgaaactccgatgatatccttaattataattgtttccaggttagtttctagggttcaataaaagactagagatgatgcatcacaaagtagataaagaaacctagagtctaaacaatcaagtaacaatcacttttcaggatggtagatgccttaaccaatctaatgtagtaggaagatttagctgatactggcaagaaccctaaaacgagaaccagccgatagaggtaaatctagatactaagactagattagctaagacatatgatagcagatgaccatgataaaaggattaaaatatctaaagcgacataatagccccgatagcacaagccatcgagacatgttacctcttgtgaagcgaactcgtcagaaagtaaaaatg

SEQ ID NO: 82134 - DNA, 21162 bp, Oryza sativa
agctccatgtcatcatggggtacatcaacacctatacaaacaactttccaaatacttggatgcaaagagattagatgcaacttcatcttgtgcttccaagcggcgtaatgtgtcccatcaaattgaggagcacgcccggaaggcatggagacaaagttgtgaggggaatggtaagtttgctgtaatcaaaaggtatagtagctcccttgggtgatggagttcccttgctgctcgctccatcttcatttccattttctccgttctttccacctaagtccgacatcgtggatcactcaaagcggtgaagcttgaatcaagagcaccttgctctgatactaattgaacacgcagatgaagtctagagggcgggtgaataggctggccctgaaaacttaaaaacaaatcgcggcggtaaaattcaaacagacccggaacttcctggtaaggaactccggaacttccggcctcccaggcccggaactaggaggattaatgcactttcaagatagactaaaatttgcattttgcggtgaacaaagatgtactaattattaattattagacagggcaataccatctatccatttgctcgccatacggccaatcggggatatgctctgcaccatcgtgacactctcgctccttctgtccagtacacacagaaaaacaaaaaaaaaaatcagaaaaatgaggattgcagtcaagagagatgaggaaagaccaaaaagctagattagtaaacaggtcacaaccgatggaaatatgcacaccacagcagtagttgaagcacaaacatgggtgtggaggtggtgccgttgccgatgcccaccatcaacgaggccatggcttcctgatccacggcagcaatggatccgctcgcgcgaggatagagccagacaaccggcgacgcgtgaggataatggtggcagcaccgagatgcacccctaaaaagggtattaggagagccagaaactcttttctatactcttttctatcaaacaaaatatagaagttcatttaccccaacaattgtagtagcaaacaagcgttcaatttaaaacaacactaagtctgtcaatcattgtaagcgatgtgtacttcgggaatttcctaatgattttacattacagcagcatggaaaagcctaaagcatttctggtctgctatagcagcaagtaaattgcatatgggataaaatcaatatggacataccagtattcttttttcataaagatacatagacagcattctatgtataacgagcttaaaatcaccgaactcttgactcccgttgtcagataatagctttcccatgattactgtaggggtatatatatgtccagccattgcctcaattatttctccaacaaaatgtgaaaatacactccgcggtgcattcaagctcctctggtaagctgaaatccttgttttcatgagaatcctttgtcctttggctgtctactcgatgattcactcccattgggcctgaaaccttttccatttacatccttgtttttcttttcttttctgtattggtttttgccggtttcccgtttaattaaccgtgcttgtttggttttcgggcccgatttcccttattaactgggccaattctgttcttctataaattccggcaggagattctcctgccgttggttcctaaaaaaaaaaattacatccttgcttccatttaaggggctctgagaagctgaattgataacataacaatattgatgtcaatacatctaccagaacacaagacggatatctttgtatgaccacagcaagcaacaaacgtgacaaatcacacgactgtaaagaaagccttacgcaattccaatactataggttgatttatatccttttgaaagtcctaattaatctaatgaaaatttatcataaaaattaaggccttgtttgaattttttttgtctgaactcacaatggacaaaaaatgaaaaaagagaaagatgatattagacaatataacagtgagaaagagcccaccccatccacgaataacaacaatatgattacttgaaggagttaatgtacgcagcggctgacggcgtgtgaagaggcggagcccctcgtccaagtgtccaacacagcgacaaggtgcggatggcggcggaaagggtgattccggctggtggcaggacaatggttgctccaaccacctaaccatcgacagccacgagctcaccgccatcagatcaggcggccttgagttcgtgccatcagatctggccactgcgatggcggcgagcggctaggccggccagttgacgacgacggcggcaggttgacaacgatgacgatggcggcgaggcacagctcctcgcaggcaaaggagagacgagagtggaagaggagaggagcgttctcctcgtcgctttctccgcgtccgcctcgaagtccgcactccgcgacgacggtgacgcgaggggggagaaggaggtggaggcgctcaaagacggcgacggcgacgtcgacggcggcggaggtggaggcggcggcgctaggggaagacggaggcgaaggcggaggtggcagaggcgaaggcggcggcggcggaggcgcgaggcgatgcagacgacgatggcgacggcgcgaagcggaggtggtggcgcgaggggaaagcggaggcggaggcggcggcggctgctagggctttgggtagtgggtgccgttttgcgaaaaaacccctcagcttacacattttagagcgcaggcctaattcgcggttttcctctccttctcatagaatatccggattttagaaggggctaaacgtaaaatgccagctcagagggactgttagcgagggacgccggacgaattacgaaaaaacggagggcttttttgcaaaaataccaccccgcgcgctgtacatatactgtagaaaaatccttacgtggcacacctcctcgcccgcccaacctgcgcccctttatggccctctttaggcttataagccaacttataagtcgaaaagtctaggcctaaacttttccgtttggcttttttgaagccataagccactctaacactattaagccaaaagctaggttggagaagcttttttggcttatgtaaggtagatgtatgactcaactactaaacttaggacattaaatccaccggcttataaatcatataggccaataaactgactagtccaataaagagggcctatgtactccgatgacactcagattatgaaaaatgaaaaaaattcaacaaaatcctatgagaaatacagtgtggtcatgatgcacctgcacatgttttgatatatggaacttgtatatcattcgaatggttaaaaaaatattaaaaaatctattatatacttaaaaatccattaaactttctataaacgtttctaagccgccacttagcactctaataaattagagaaatcaaagaaattctaaaaaatctatccattgattttcatttaaattggtagacccaatattttagatcattatattaaatctattaaaatatttccaactaataaggatccgatgcatacatatggatggtacgtatgtacgtactactcgtaaaaaaaagaatcattccttctaatatggatccgatgcatatctatgcagaggaaggtatgtatgtactactctacttttaccgtatgtactactctacttttacaaacgtaacgtaaaatacgattggaaattaaaagaggataaagcggataaaaccataaaaaccataaatacttttcttccctctttttcattcttttctccctgcgtatacaggtgagataacaattaatattagtgataataaattttaaataattataattcttacaaacatagagtatatatatcatcatatgactctttcaaaaacatcattcctccgtttcgtaaagtaagtctttctagcattgctcacattcatataaatgttatatgtctagattcattaatatctttatgaatatgagcaatgctataaagtcttgcattataaaacggagagggtacataactaaatttgctctataatgttcagtgataaagtttactccctccggttccataattcttgacgttttgaacatttaaacttttataaattgaactattaataactttaaaaatattaaagatttaatggcatgcatacgaggattttatgtggtattgatgatttgattcttttaccacaacttttaattgtacatccaatttataatcggtttcaaccactgtatttctattaattgaatgacaattaaagacctgtattgctgaattgagtcccaaattaacataagctgaattgttttcaaatatgaacataaggatatcacatacatgacactaaccacatttatcattagtttaattattaatcaacatttttggacaacgcttatttctaaatctataaataaatattcttaatatgctacttctattggttaatgggagatcaccgttaaaaattagtcatgaatgtcccctcttaagaggtggaaatacatgtctttatggttccgtatcaacatacatgtgcctttcaaggacagcgtttagtgcaattttaacgcctaattcactatcagcacctttacagatgattgcatcagtaagtagaaatttgaacactattgtcaacggtggtttccaaaagggctacctcaactaaaccatatatatgcccctactatacttgtaaaagcttctcaattccctttagagaaagcaagaaaatatggatgtaatgaaaataattcttcccataaaaacatagttgtttttttcattttgtgtagacataatttgtttgtagtattaatcagtactacccgtttatggtatagatacaacattctcttttgttaagtgaggttaatcattaaaaaaaaggagagaatctattctacaccactgagtttgttcgagttcaacgatttaccatcaacattgtctttttttataatataccggcgactttatcaattgttctacgatacgccattggactggacaatcttttcaaaaatacccaaaatacccttagagacatacaagattaacaattgatttatctcatctgaatattcaaaaaaatatgaaaatttctatgtggcctccttacacaatatggaagtttgtatacaagtttcaagttttttctgatatatttagttttttgaagaaaatatttttatgtggaatatgagagagagtttgctaataaaagagataatagcacaaaaatatcttatgtagtatgaaagatgatttatattaaaaacaacaatatacaagtattttatgtagcatataacagataagttatattttttataaaaaaatagaaatgtaacaaacttgaaacttctatacaaatttccatgttgtgtaagaaggccacataaaattttcatattttttttgaaacttctaatgagaaaaatcaattgttaactttgtatgtccataagggtattttgggtattttagaaaagaaggctcaacccaatagcatattgtagaataatggataaagttgccagtatattaaagaatgcgacaatgtcgttggcaaatcattgaaatcgaacaaactcagtggtataaaatagattctctcttaaagatgtatcgctaaatagatatatgaccgtaaccatgttcagattatcatatcactaaatcacatttatattttgataaagatctatattttagcgtctggtttgttttcatcacctcttgttgataattgcatgaggcacctttactaattttaaaatgtatttattttccaaaatatgtacaataactaatttgttggagcgcacttatagcatacattcatcaactatcaactatcaattatgccatattagaattcctcgactataaaaaaatatatcatgagtagtttaatgcacatgttatttgttggtttgttaccaaaccaatttggcaaagagaaaaatgtttggattaaggggccgtatagcaagatcaatgcctaaaaataccaatgaaatagttctgaaaagtctaaaaaaacatttgagaatattagtctccatagattaaaattaaatcatatataactgataaaacataatgttgttttgttttcacacatgtagatttcagttagtgttatatatttgtcaaatggtatttgacaccataaaatatgatgtgaaattatttcaaagatatgacgaaattaattattataagttgcctaaattatttgaaaattattataatattaattatgatacgtcagctccatgtgttgtaatgtatttagcatcataatataactatgataagtcatcaacatttgaatacaacggattatagtttgagcttatgatttaaaaataatttaaaatgagtgtataaatacctttgatttgatatttatattgatctagtttaacttgcatatttggagtaataaattttgttttatagcatagaaaatcctcaactgtctatattattttccgatggctgtaccaacgtacatatgtattttttgaactttatggcttttttaaatggtatgtacatatatttctttgttttttaatcaaatatccggtaaacagtttctcttgtatacgcaagagattaagaggaagcgggctaaggtaatggtgtaaaataataggttcattaatttatgtaaaaatcgatggtgaaattacgtagtatcacgtggtggtctacgagcgcttgtagaagcaccaaatgatcatatttgtagagtaataattttatttttatagtatagaagatcctatttaaaaaggctttgatggttataacattgtacatatattttgctttaggctttaatcttgcgtacattggtacctatcctttgttttttcacgggtgaacagtatattattttttgtcattatttttttagcgtattttcatgcaacgtaacgaatgtaactatttgcatgtaggtacgtaaatatttccagtaaacggattatcttggatatagaaagcataaaatttttaaatagatctaatccgacggtatagaataatggatccaccaatttaaatgaaaatcaatagtaggattgtagaatgccacacggcggcctaggagcgcttgtagaaaagccacgtggcggcttaggagcgtttataatatgtttaatggacttatagtatataatagatagatagctatttttagggcatgtttggtttggagccaaattttgccctaccaaaattaattttgatagtacctatttatcaagcttgaagcatttagatttacatttcctcaaaaccccaccacctgtttatcaattgctttcaactgaattgttaaattcgaaaccctatattggaaaaccgtttaaacgaaattaaaaattgaatgcttgaaacttgtggtacgaggagttcacctagggctttctctacacaagaaatagcttgatgttgccgttgacccataatgcagcttgtgcttggtggctagggtgggagagagaactaggggtctgtgggatcctttgcagggaagaaaaggagacttgagagcaagatagactcaatgcaatatattgatctcagtgtgcagagtacatatataagcacgtcctttcctaaccactcaaccaacttatttatgtagaaacagaatcgggagagatattggctagatagcaagagatgaagcatgccaaaatacaaaagatactaaccctctcaccccagtcattctattaaagagaagttccagtggtggattagagatggtagttcggtgcgattgttgtaagacccttggctcggtgggactgcaccggatagaaggcccggcgggtgtccgaacattgagactggaacggaactctaagaagatggtactagacaaacccttggtgaagatatccgtataatgtgacatcgtcgggacatgaacacacaaacagatccgacagcaacatgatcatgtacaaagtgtagatcaatctccacatgtttggttcgctgatgctggactgggttggtatgaatccttagctagtttgcatatacaagaacgaagtatgcttgtgagataaaagaaactgatcgagttattctctgtgtatggacaaatccttccattgataaaataatgcaaatacatggaatatgttagactaactacagatgtaatttggtgcaaaactcttgttggaccttgtgtacaatagaagatgggtgaagtgttgaggttggcacagggaacattgaaaggaaacatatccttggaaactaaacctgctagctagccttgattggtaagtgatcaatgatggatggatgggttaattctggttctgggtggcagccggccttgggacatacttgcggagccagatctggcgatggcggatggagatcttgacgagacgctctccgttgagcaccagctgcacaaatgcctcgctccggaagatgattcgcccgtacattggctgtgagcctcccgctgtcttctccatcaggacacgcaccacgcagtcgccccacttcctgcacgtatatataagtcgttgtcaatgccaatgcatcaatccatcctgcattctgcattctttgctatgggacctagctgcgctatggggaggattgcagactcactgcctgaagtagtcgaagatctcttcacggtcgattggcgctcccctggagaaggtgatgaacatggagcggcagtcctccggcacggcgacggagaggcagctataggccgccatcagctccggcgggttgccgactaggccggtctggtagcggcggagcatcttgttgaggtggttattgaagatgagcgagccgacaccgtctaggatgtctgcgacaccacgcaccaccaggtcctggtggaatgtgaaaaagcgcgggtccacatcgccgtccttgcagagcgcggagatgagcgggatggccggcactacgggctccggcccgcggaggcagtccaacaccgagttggcctccgcggcgacgaggctgacgacggtggggctcagccctgggaggtgctggatggctcggacgttgcactggtccagccacaccagcagcgccaccgcgttgcgcgcctgctccgggttgctgccgatgccgacgaagcggtcgtaggcggtgcgggcgtcgctgtacatgtacagcacgtcgcggacggtgaacatctgttcggccatgatcagcgtcgtcgtcgccttccggaagctccgagaactagatagcttagattcttgtgctgtgtgtggtaggctgctaggtagcaatagctcaggatgatggagtgctgaatggggctagctgaggcctgtatttgtagccggtggtcgccggcgagtggttgcaaggaggagttgagcaaacggatgtgttctcgctacctgcctcgcatggcaacctttggcctagcttagccaaaataaggaggaaacgaaacaggtatgatggtttgaaacggttgcagcgtcggtctcctctgctttacgattcgtgcttctctggcctgaagcccattttgtttcctatttttttccctgtcctttttagatgagcttcctcttttattccctagttgcgctcaaactagcagctatatatgaatggatcaacgggatagtgctatcgtatgtatattttggcggttaattataccttgatcatgcattgttgctaagtatacctttatatatcgtcctatctttgtttcagttcatatgtatctttggctacaatcgacttaatcattattacttgcctttatcaagtcatggcaggacatcaattttgaagggcaattcgatcatattgtttgcatgcatatacacattgccacgtacacgtacatatatagatccaaccagcaagacaaacgttcaaacttcattactccctccgtttcaggttataaaatattttgactttggtcaaagtcaaactgtttcaagtttgactaaagtttatagacaaatatagtaatatttgtaatactaagttagtttcgtcaaatcaataattgaatatattttcataataaatttgtcttgggttgaaaagttactatttttttctacaaacttgaccaaagttaaaacgtcttataacctgaaacggagggagtacatatgtaaatccatatatgctatgacctattaccaaataaacaaatcaaattccaatttaaaataaatttgttaaatgctccacacactgctctagaaagccacattactaacagttgaaaatggcaatctctaacaatttgttgaaccgctatatagacatttggttacgcttgagttggcgtgaataatctctaaatgttcttgaactactactgaaccaatgatatctaactgttcacaagctataaagtattacatttcatattgggacaattaaaaagaatgcaaaagttacgaaccggtaagatttgcttgtcgtcgtttgtcatgctcagctggttgatcttgacatcaccatgccagaggggagaaacaagagcaccgagcgaggacatcttgacccatgcaatgtcatagtcatctcaccataccttcctagatctagaatcatagagcttggagtgcatctaagattaccatctcaccatacctttccagatctaggatcctaaagcttcgagcttggaacgggtagatatagcatgcaccgagcttggagcggctagagccattgttttcttgatcacacaagagcaatgaggagaggaggcctcaagccatgctctgttgttgccatcatagtggccctccaaagatgtcaccatcatcgtacgtaccatgttcgatccggtagcccaagctagaagctctagatcgacatggcattttaagctcgccaaccgcatcgaagcaaggaaagggtaatggtggactctgtgtatctcgctgaacaaggggagaagaggcaatagtgcatgactagcttggattagttttttttttttcggggaagagctgggaattactattgctcaaccgacagactagcttggattagttgacatcaccaaaggaggtagcagctaggatggcaaaggattgaaggccagcgtgaacttgggtctggcaactagacaaggagtggcggatgaggggcaaatgatgcaaaatatggcaaagctaggagtggaagatagatgtgcctcgatccggagcccaaggaacgggtctatgggaggatagaggcgaaatgtggtaatataggtggagtggttggagtgggagcacgttgatcttacctaatatgttgttcttgatatgaatccatgacaaatatgatagggttaattggatccatgctattataacgttgccacttttgagaaatgtcactactattcgttaaattagaaacatgtcattatgaatcagctgattttggaaccatgcttctctctgcaccccaagcctcttttgttgacttgaatagacatagttgcccctggttgaatcataggtcgatggcgatggcaaggtggggaagacgacggtgaccacgatgaggagatctggcgaaagcaaggtggggaaggcggtagtggcgaggtcgacggagacggcaaggtggggaagtcgacggcgatggcagcgagatctggtgaaggcaagttggggaaggcggcggcagtgaggtcgacggcgacgacaaggtgggaaagatgatgacgaccacggagaggacggtagctcaggaagacgacgacaacgtgactacggtgagggctggagcttgggaaggtgacgatgacttctcggggccctagattcgccggcgagcaggctggatctagccagcggcgcggtgccgatatgggagaaaagctacggagctacaccggagaagcccgctgccaagctcgcgcttgccgctgccgtcgccgtctccaccttgccaccgccattcctgaccttaccgttgcgccgagctcacgcctgctgcagacgttcctgacctcaccatcgccggatctgctggcgagcttgcgctgctgcttcacgccccgtcgccaacgacctcgtcaccggcgttgctcgtagctccgccatcgtcaccatcgccgcactctctggtagggatagggatataatatgatgcaggggcattttagtcaatacgaatatacggaacaacaaatacggtcaacaaaggggcttggggtgtagagtgtggcatggttccaataatcatcatataggtttatgcaccaagaccaagaataatttaaatcgcatcaatcaaaacaccatgcaaatattctcccacaatgcatgcatcaattaaagcaccatgcctagcatgcacacattctcccatgctacatgaattgtattccgataaaattcgtgttcatgcagttatacgatgatcaatttgagaaattttgaatttcattataagatgatcaatttgggaaggagggagtaggctctacttgaaatggtgttcttgtgcgctatgtggaaattacttagttcgattgtcattatcatgaatagattattttgctatagaaatatggaaaaatcatagtgcaacattataatttccatatgctacctcttcattagagaaatataattgagatttgaaggtagaagggggaaaatgccataaaatccttaggttcatgaatagttctggtcgttctcaaatttgtcatctggtcatgcaaacaaacattatacctaggttatgacaaaaaaagttcaggcatgaacatactcttgttatggaacaaaaaatagtcactcacattggcatatacacaagctctggctcttggactacgtatttacatgctcaggccgtggccaaataaccagttgcagtagatatgccagattttgagtaaaaaaaaagaagcaaagatacattcaccgatcaaggcttgtgtacattatatggatacacaaaatatgagctgcttctgaaacaggatctgacaagttccacggttatttccttacgcatagcctcccgaacattttctgaaacaaacgcacaactgaactctgatcattatacaacatcatgttagatcgtaaagggcctttccaactctaaaataggtccatccctttctacaatcaacatgaaactattcatcaatctccatcttcacatatttatttctcaaccgttcaccaccccttcaccatactccaacggtgccttgggtgtatggctccgcaggccgcagacacctatagtccattaggatttgacactagtatctatcaggttaaagatattgaactagctaggctcttataccaattataaaattgtaaagagcatatcctacacattagtattaattcttataacgagatttagtacatattcactaaatcaatattattctcccttgcagatgatgaccgaccttagtacatacatggtgagtgagaactaagcaaatatatgctaatctttaacggttctttgtgttaaaccattatagatcaaactagcaagatcaacgtgctctagctccaaccgctcctatattacgacaccccacctcttttctcccaccccacaggtttctgaggtgacttttctcttcctcagttgaggtcctagctagatctaccatatctcccactatttacctctgccccttttcccctttcccctttctagatctaggctcacacaggacgctcatccatcaccatccccttcgctccctcctttggtatcctgaataacttcaaaccagttaggcattgagagacagagagtccactggcaccccctccatggtacggtgatgcatggtaaatccttggatgggccaatatgatggcgacatcagagatcggattgaggcctcatcctctgcttcttgctctggtgtagactggaaaacaaagactttcagatctgaccactccatgctcggtgcttgctggatctagccactacaagctctagggtcctagatctagcaaggtatggcaggacgacaatatcagtgcacgaatcaagaagtccttgctcaacgcccttagtcgtggctccaacatggtgatatgacgagatgaactagctaggcatcacaaacaacaataagcaaatcataccggtgcgtattttcttttttgcatttttttaattatcccaatatataatataatcattcatagtctgtgaaaagagaaaattgattcagtagtagttaaaaacaattagagattatacatcccaatcgttaaccaaatatttataatggttcaagaaattgttagaggctatcattttcaaatattagtaatgtggttttccctttatgcgtggcaacattaaaatgtttatttttaattggaatttgatttttatttttgatagcatatgaatttacatacatgtggtgtttgaacgtgataggtaaatctatatatgtatgtgtatgtgactgtgtatatgcatgcaaagaatatgaccgaattacccttctaaaaattgtagtaatgacttgataaaggcaagtagtaattattatcgattgtagccaaacatatgtaggaaccagatagacaaagatggggtaaagataaatttagcaacaatgaaagaaatataattaacagccaaaatatacatatctcatagcactatctcattgatccattattcatcgctgctagtttgagcacaactaggaaatcaagaggaaactcagaaaggaaaaaagaggaaagaaatgagcaccaggccagaggagaggctgacgcggcaaccatttcaaaccatcatacctgctttgtttccctcctaattttggctaggtcagaggttgccatttgaggcaggtagtgagaacgcgtccgtttgctctcaactccttgtaacggctcgccggcgaccagccgaccaccggctacaaatacaggcctcagctagcccaaatttggcactccaccctcctgagctattgcaacctagaagcctaccacacagcgcaagaagctaagctagctaagaagacgacgtcgatcatggccgggcagatgttcaccgtccgcgacgtgctgtacatgtacaccgatgcccgcaccgcctacgaccgcttcgtcggcatcggcagcaacccggagcaggcgcggaacgcggtggcgctgctggtgtggctggaccagtgcaacgtcccggccatccagcacctgcccgggctgagccccaccgccgtcagcctcgtcgccgcggaggccaactcggtgctggactgcctccgcaggccggagcccgtggtgccggccatcccgctcatctccgcgctctgccaggacggcgacgtggacccgcgcttcttcgcgttccaccaggacctggtggtgcgcggcgtcgccgacatcctcgacggcgtcggctcgctcatcttcgatgaccacctcaacaagatgctgcgccgctaccagaccggcctggtcggcaacccaccggagctgatggcgacctacagctgcctccccgtggccgtgccggaggactgccgctccatgttcatcaccttctccaggggggcgcccattgaccgtgaggagatcttcgactacttcaggcagtgagtcttcaatccctatagctcatccagctcccatagcaaagcaagcaccatggatgcatgcattgacattggcaactacatatgtacacatgcaggaagtggggtgactgtgtggtgcgcgtcctgatggagaagactgcaggaggctcacagccgatgtacgggcggatcatcttccggagcgaagcgtttgtgcagctggtgctcaatggcgagcgccttgtcaaggtcaccatccgtcaccgccagatctggctccgcaagtacgttccaaggccggctgccaccgagaaccagaattaaaacatcgatcccgtccatcatcggtcattgccgtccatccatcaatcaagggcatgaataagctagctagtagcttccgtggtgccaacctcaatatttggccaatcttgcattttacacaaggctaatccttcactaaattacatctcagtcaagtctgacatacaccatgtattagcatacttttatcaatgcatggatttttgcatacataggggaacattctgacccatctcttttgtcatacacaagcatactttgttcacatatgtgttttatgctacattaggaaatccatctcaagatacatattgctaaatatgtgatccagattcgtatatatgtgtcatatcccgtactagtttgttttttataggacggagggagtaaatgatatgtctctagactggcgtagcgtatccatttgttttgctgcaagagcaatacagttgtttaggtattgggttctaagccgcacataggctggctcttgaactcctgttagaactttattggcaaatttcaggaggagagcagtgcgctgttggttctaaatctgaaatacccagacctccctgttgatcttgtgaaatggcagtatggtaagctacaattcaatgtcctccctaaatcttgatttcgccattccatagaaaggatcgtctaaggttgttgattgcctctatagactttttggccatttgcagcaagtcataaagtatgtcagaatggctgagagtgctgagtttagttaccattatcaatatatctccttctgaaaatagactcggtatccaacccaactaatctctaatcgatcaatccttgaaatgattggcatcaacatcatgtgtgttatcttggttgttgatggtggtaatcccaggtagttgcagggtaaagagctgagaagacattgtagaacttgagatataccaaggaagctagcctcttcctaggtcatataaattggaacaactgtactcttgtggtaatttacttttaatcccgagaagctggtgaaagactcaagtatctgttgtagaattaatcatggcttgctttgcatctctatcagtgtgttatcggcatattgtagagtgggtggagctccttctattcgtagtgggtggggaagtacgtcttctattctcataaggttattgaatcattttttttttaaaaaaacaactgccataagaatgaaaagtatagatggtgataacgagttaccttgacgactgaatgtgttgacccgttgtccccattcattaaaattattgtctttccagtacatatacatacaggcgctttcatgcattcacatccgtatgcgtatccatatccgtcggatttctaaagactcataccataacgtcgtttcgaatggattcgaagcggatattatctgatccgttttcacagttagattcagtagttgttcaagaacaattaggattagtcatccgaatcaaaaccaaatgttagaaattgttagtatcattattttcatctgttagtaatgtggttttctctagtctagtagtgtgtggagcatttaatggctttattttttaattttcatatgtatttacatacatgtaatgcagttttaacggctgccctgctagctagatctatatatagatatgtatgtgactgtgtatctatggatggaaaaaaatatgaacgaattaaccttctaaatttaagtcctgccatgacttgataaaggcaagtagtaattattaaatcaatagtagctagccaaatatacaaatgaattaactgatcacaggcaaagatagaataaagatatatttagcaacgatattgaatgaaatataatattaaccaccaaaatatacatatgataatatctcactgattcatttctacatcgctgcttgtttgggcacaactaataaagaggaaactcatcttaaagagaaagagaagggagaaaggcaaaaaacggaaagaaacgggatcaggccagaggagcaagaatcacacactagatgccgacgcatggcaaccatttgaaaccatcgatcaaacctgttcctccttattttggctaggccagagggttccatgcgaggcgggtagtgagaacacgtctgtttgctcaacgtactactccttgcaaccgctcgccggcgaccaccggctacaaatacaggcctcagctagccccattcagcactccttcatcctgaactatagctacttagcagcctaccacacagcacaagaagctagctatatatatctagctcttggagcttccggaaggcgacgctgatcatggccggccagatgttcaccgtccgcgacgtgctgtacatataccacgacggctacaactgcctcctggtggccgtgctggaggttccagaggggcgcctgacggaacggagggggggaggggtaaaaagaaatttttttattacccccatatatggtgcccaggtccagcaggccaccgtatgctcccaattcagttcggctggcccatctatatcccgtgtatgtacacaaacaattggagacgcaaccgcaggagccgcagctgctcggcgacgtttcagcttcgcatcgcagaagtccatccgtgactccgccgcactggtggcaccgcggcattgccatgtgccgactacaggtgctgcatgctggcatcatcggccggcggccgcggacttgatggaggacaacatcaacaccgacaacatggctgactgctctcatgttcctgttcctcctccaaatcaaaccaatgtaagcaggccctatttccctaatccatatcaaaccaatggaagatggatttttaagagattgtttggtactttatattgagagagagattgcaacgaaggtgacgacagatttgattatggacgatttcaatacagtgaagactcgtgccgtgaagtttaaatgaacatgtaagtatattgcctacttttgcaaactattcgcttttatgtattgctaatgcatgaaaaaaaaagagaaattgccaattttttgaactgtcaaaagccggctggcccccctttgattttctgtccagctccgccactggtgcctatccaccacgaggagatctttgactacttcagacagtgaatcttcaattctatagttcagctagcactattagaaaaaacattttcgcagatgttgggggattttttttttccaggtggatatgatcctcggagctaaatggccacctcggaaaatgtaaaccggggtagagctaacctttcgcctacgaagatcaatttttccagactgaccacttaagaggtctgcctgaaaaaaatataatttttgcaggcagaaccttatgtggtccgcctaaaaaatcatgccaccaaaaaatatctaagtttcatccttatcctctcctccaccactcatttcccttccactcctctctctctctctctctaatttgttcaccaccagcagcagaaatctgccgccggctcagctcctcgccgcctcagccattggctgcgatggctcccctcctcgccgcctccaccgctggacaacttgtaattaaaaaaagaatcacgcatgacatgagaaaattaatactctctccgggctgataatacttgtcgtttcagacaagggtgagatcaaactttagaatcttttattatgaaacatttttaaaatattcgtctttcaaatatggtgattacatgcatagattagtcttaaaatgtactttaaaaaatcatatatttgtacttttatacatattataatgaaaaataatggtcaaacttgttttttgaagaccgtgctcttgtccaaaatgaaaagtgttatcaacccggagggagtaactaaataggctttgctggaaatgctgttcttatgtgctctgtggaaattacttaatttgattgcccttatcatggatagattattctacaatagaaatatggaaaaaatcatagtgccacattaaaattttcgtatgctaccttcttattagagatagataactgagatttgaaggtagaagggaaaatgccattaaatccatatataggttcatgaatagtactggtcatgcaaacatacattatacccaggttatggcaaaaaacttcaggcatgaacatgttcatgttatggtccaaaatatagtaaaacacctgtcatacataagctctttcttggactatattcgttcatgtatttacatgctcaggccgtggccaaataaccagttgcagtagacatgccagattttgattaagagaaaaaagaagcagcaaggatacattcactgatcaaggcatatgtacattatttgaatacacacaacatgagctgcttctgaaacaggatgtgtgataagttccacagttaattatttccttacgcatagccacccgagtattttctgaaaccacataccactgaactctattcattacattaacattatgtatgatcataaagagcctttcccattctacaaccaacgtgaaactattcagcaatctcccctttcacatatgacatccctcagtcattcttcacaccttcaccgtacaccgacgatccctcgaatgcatggccctataggcacccatggttcatcataccttcatactttaatgtccattgggccaactatgttaaactagtcagactctcataccaatttagaattataaagggcttaccctagaaaaaaaaattgaaaatatacattgtttttgaagtttttgtgactatatacatgtttttagaagaattgtaaaaatatgcgcgtcccgcgcaatggaaacggtggactgactatttagcgcaacatcaaaacgcgggaccgatgactgacactatcccatagtacccatcgatcctgcaggccagttgcgcggcactgcgcgctcccatagagaggttgtgcgccactggccaaatacatgctgccatgcatgcatacgtcatgcaactgtccagcgtgagctgctgctggtcacgcgatgccggctgcgagatcgacgtgatctcgcacacccctagcgcggggtttatccggccaccagtgttagacttctcagtccttaatactattggatttagctatcattgtattgttgggcttgattgtgtggtcttggcctagccagcccaaac

SEQ ID NO: 82135 - DNA, 20500 bp, Oryza sativa
catggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctttaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggttgattcctggacgagggttcacacacaagtaagcgtttggaattttggatagaaattccgggcgtgacaagttggtatcagagcatctttgaccctaggttatgccaaatggttacccatagaagccctctgaaaaatattggaaaagtagaactgttctcctccctttctcttttaattaaaccaaactaatggcacatgcacttcataatctcttttaatggttctcattaaaaatttattccagtgttattagtactgtacatctactactgtactaatggctcatttaccagcaaaagttttacaatactgttttatttaatcttgctgcaataaaataaatttagcatgctgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtctaggagttgcgtacgatgtcctttgtcattggatttgggactgctcctttttatgcccagattcctcatgatcgtcatgaagagaagtgacgagtcaaagtcaccttgaacagtaatagtgaagatatcccctcagtgatgtttgaagctggaggaagaaactatatccatgcatgtcaggaggtggcaaggatcgccataggagagctccgtgatcgctacagtgatcaattggccgacactgagtatcgccaccatcctcgccaacctcagggaagtgaccgtggcagttaccttgagactgaaggaattgagaatgatgctaccacgaagcatttggtggagatgttgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctctatttgtccctcgctatcaactggcgccaaaggttcgtgtggtggagaaagaagttgctccagctcaagcggatcctccggtcatcatcataagtagtgatgaagaagaagaatccaagcgcaacaattctaagattgagtgggtagcaactcaagatgatgaagacgagccttcaatcgacctccgatgcttggaagaactagagtgactagttaagtcgttgtcttagatcgttgtgttagtttgcttgcttaaagtttgcttgtgtgtgtgggtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgtacctccacagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgtatcacatcagttgcatggccctgcctctgaatggtgggatcacttccgccttaacaggactactgctgaacctatcacttggcttgaattcaccgctgctttccggaagacgcatataccattgggagtagtgtctctcaagaagaaggagttcaggtcgcttactcagggatctcgctctgttacggagtatctgcacgaattcaatcgtcttgctcgttatgctccggaagatgtgcgcaatgatgaagagcgccaggagaagtttttgggaggacttaatgatgagctttcttacccactcatggttggagatcatcctgatttccagaaattagtggataaggctattcgtcaggaggacaagtacaatcgcatggagcagaagaaacgtcggattgctcaattcaagacacaacagggaaataatcagaagccacgtcttactttaggaccccagtctatgccacagggaggttcttcgtctgttgttcgtccgcaacgtcagttcttcaacaacaatgctggcaacaacatccgtaatcaagctccacgtcctgttgcagctccagcacagcaacaacctgctaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcctatctatgagttttgcgggaaatcatgagatggaagtagaagatcttagacgtcctttgatggttagtaccccaagcaatcaagcactctctttgcaacgtagcccctctgtcaaaatagaaattcaaggagtaccatttctggccaatcttatcttgttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccaaataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcaaatgtactgttatgtcttttggacttaccaatgcccctgctttcttcatgaacttgatgaataaggtgtttatggaatacctagacaagttcgtggtggtctttattgatgatattcttatatactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgtgtccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctatcggtttcttggaggatgagcaaggaactgtatggttgggtaagagaatctgtgtccccgacaacaaagatctaaaagatgcaattctgaaagaagctcatgatactttatactccattcaccctggtagtactaagatgtaccaggatctcagggaaagattttggtgggcaagtatgaagcgtgaaatcgcagaatatgtggcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgactctatttgggtgatagtcgacagacttaccaaagtggctcatttcattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcgggacggatatcctaagggaagcggaagaaaaggtaaaggtcattcaagaaagattgcgagtggctcagtctcgacataagagttatgccgacaatcgccgtagagatttgagttttgaagaaggagactatgtgtatcttcgtgtcacgcctcttcgaggggttcatcgttttcacaccaaaggaaaattggcaccgcgttttgtgggaccttataagattgccagtagaagaggagaggttgcttatcagttagaattacctcaatctttggcaggagtccataatgtgttccatgtgtcgcagttgaaaaagtgtttaagggtacctaccgaagaagctaatattgagcagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctaaaaattcaaattatataaattgttgtttaattggaatttctagaatttattttaaaaaaaagtcttgaaaataagatatagttctaattaataaaatccaatataaaaagtggccagataaaatttcattaaatactttgcttaattctataattcctagatttttctgggatttatttgagctaaggaagtattttaataaatggaattgcatttaagaaataatttaaattgaaaaaggttttaaaaagtcttcttttggctttgggccgaaagtcggcccaaaacctctcttctctctctcctcggcccagccggcccagtccgcagccgcccgcgcgcgcgtgcgcgttcggtcgctgacaggtgggtcccacctgtcaggcccgtcgtcttcctcgggccgaaaccctagcgcgccgccgccgagccgccgccgctgtttccttccaatccggccgtttctttccttctccggtcgaatcaaaagaggagaaacaatctccgggatctcctctaccttttctcctttggaatcatcggttaaatcgctttggaaagctttgggatcgagttcgattcggatcggttttctttctctccaagccgaggtttccttcgtcgttgccgtcgccgtgggccttcgccgccgcctccgagcccctttaaaaggacccccggagtcttctcttttcgccgccaccctcgccttcacctctcgtcgccggaagagctctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccggagatcaccggagcagcttcgccgtcgttgacccgaaggttcccgccgcttcctcctcgtcgccgtcgccgtccgttggtcttccaccgccgtttaggtcaccggtgagttcgccgtgttgtcctctacgtcttggtgccctccgtttgcgtcctggcgccgccgttcgccggcgagcgtgcgccgcccgagccgtctcctctgccgagccgccgccgctgtcggtgacgtcaccgctgacgtcatcagggtcgtccgccgtgaaccgccgtggacccgatcgatctcggccgtccatcttggatcggttagatctcggccgtccgttcgcgtgaaccgccgcccgtgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcctaaacacaatcctttgagcatgttgatcctatatttaaattctctatttatttcaactgtgcatttattttcgaatgtcaccgggtggtgtgaacctgttcctttgttatggcctgttcgcattgattactctattccttgataccttgggttattacaatttgactagttgagctttatttatattggttcaactagatattagatataattgcttagccctgcttagaaacattagtacacattcgggataactaatgacttactaatatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgtaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattataaaagatgctttaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattcgaacagaccacaaaggagtaggagcgatccttaagatgagagatagcgagattggcaggagatcagccaatggccgccctaagggccaaagccaccgaagaagaagtgagatgaaagctagcacggggaagatccacaactaatcggaaaggtgttgaactgaatttcgaagaaaaatggaccggcgaacggaagcgacgccaggcctcctcacgaatagcatcgccgggagagattccatcctcccggtggtgccggcgtcaccatggacgagatcaccggagatcgcccatagtcgcacaccgagaaaaccggagcctagcccagtcccctgaaaatgtagttccgacacaagttgaagacatggtgcatgacgatggttctgttgaggacaaaatcgacctagaggaaatgttacgtcatgcagaacccgaggtgctgatgggatcggctagagggttaaataactttgaagctttacaaaaggcagcaaaggaagttttgtacaatgagtcgaagggctctgacagtgagttcacaacactccggtcagttcttgaacttatgaggttaaaggtgaggcatggatggtctgataccagtttcgacagtctattagaacttttgcagaaaatgctcccgagacctaactcactaccatccagcacatatcaagcaaagaaactcatatgccccctttcacttggtgtggaaaagattcatgcgtgcgtaaatcactgcatactgtacaggaaagagtacacttctttagatgaatgtccaacatgcggtgcaagccggtacaagtcgaatagcaatactggcctaaaaccctctgaagcaactgagggacgacagagaaaaatcccgcagcttgtgatgtggtatcttcctgtcaaagaccgcattaaacggttatactcaaacccgcgagatgcggaactaatgcgctggcatgaagaagggcgcaagaaggatgggatgattcgacactcggcagatgctcgtaagtggataaactttgatgcttagtatagagagtttgctaaagacccacggaacattagattttccctgagtacagatggagttaatccttttagagacatgagcagctcacatagtacttggccagtgcttctcaccatgtataatcttcctacctggctttgtcaaaagcgaaaatacgtactactctgtatcctcatacagggaccccgacagcctgttattgatattgacgtatttcttgaaccattgttggaagagatggctgatttatggaaagagggattgaaagtgtgggacgagtacttaagggaatacttcacagtgaaggccatcatcttcgtgaccatcatcttcacagtttcaggtcaaattaaaggtaaaacaggatgtgtgatctgcttgaatggaacgtactataggtatctcccgggttccaacaagcttgtgtacatgcggcaccggcggttcttgaaagttcaagtgccttaatttggtttcggtgattaatgacaaatctatttatatgagactaacgtttttatgagcctttatttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatgtcatctctctatattgtttatatcgggttattatccatcaccaaagagagaaaagaatgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatataccacttcttatctcctacttttggataggttcatatatatgatttccatgttattgatatataagtgtgagactaatgtttactcgaatgttatcttatttagtctcatttacattgagaacatggagatcatgaaggtatatgttttatgttggtctacatcattactacatatgccttcactatatgtataggataaacccccattggtcattctctaattatgcatacacttgcatctcttgtatatttatttgtatgcatatatttagggggagcaaatcctatatatttattgtgcatgttctagatccatgttgttcacctattatttatatcgaatctttgcacttgagcttgcatacgagtatatgaaacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaggtcaagcttgttatgagaataaagtcttgacaaaggatggacaagacctcggcataaacatggttcaaccggatggtcacaagtgttgatctcggctcaagcttgaccccaagatggatggcgcaaggcaaaggtataatgtggctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtttgatgagttttctcaagtcctaaaccaagagagaagtgggcatgtccaataggagtgagtgacatcttgtgggtatgtccggtggatatcctttggagtgtgagccctttatccttgacttaagttgtgtttattgcatgtatttttcatgggttggatggccctttgaataagctttccatagagtccaagaacgccaaattccgagacccgagtcaagagatatcgccgttttactaacggtcagttaagctgaaaagtgacctgcggtctgaccgtgggccttaggccggtctgaccggtcctgttagccggtctgactggcgtgataaggccggtctgaccggccccactggtctgttgcattggtctggtttttggtggcgatacagagccgccagagtcgcaaccggtcagaccgagccgatggcggtctgaccgagcggtggacggtctgaccggctactacactgcggtcagaccggccaggttgagtgggctcaatgattgccctgtaacggctagttttctagccgttacaaagtagtccggtctgaccggccactctatggcggtctaaccggcagagcacagagttggggatttcgacataacggctagttttggtggttgggggtatatatacccactccccagcagcaagggtaaggttttggcactccattgcattatcttgaacccttgcaagagctttcacacccttgtgcacttagtttatctagtgaggtgttagagagtgagttaagccaatccaagtgcaatgcttcattgttatagctagtgtggcacttgatcatcctcggcaagcatcctagacttgttactcttggaggttgccgcctcctagacggcttgtggaggagttgccccgtgacctctccgaggagattgtggaggaggcccggcaccgtttgtgagtggtttggagttcgccaccttcggagtaaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttgtgctatttacattcatatagacatatttgagcccatatcacttaggtttgcaaaacttaacttagttgttagttaaccttgcacctcaccttgcctagcaacttaggttagttttgtttaagtgccattaagttttaaaaccgcctattcaccccccctctagtcggcctccttgatcctacagttcctacgcacaaatcacaagtaccgcaagatgaaggcggagttcgatggtactaaagagactgatcctgcaccaaaacctacatcgggagaaaaggtgtgtgcaatgacagagaaaattgtttgcgagtttggaaaaatgacaaagaaaccatcaaaggggacaaagcgcaagaaacccgagaagaatacgaaacaaggggatagtaagaagcaagatgatagttcaaagccagatgataaactccctcccccattcaagaagcattccatattttttaagtacctcccgtactggaaagatctggaggttcggcatgccatagacgtcatgcatctagagaagaatgtgtttgacaacatagttgtaacattgttggacatgccaaagaagactaaagatggtctgcaatcaagaatggacctagtcgagatgggaatcagggaagagttacaccctcaagaaggagaaaagaatggcaaagtttatcttccactagcctatttcacactgacacctgaggagaagaagtcattttgcaactcactccgtgatgtcagagtgcccataggtttctcatcaaacatcagtcgactagtttcaatgaaagatttgtcggtatctggttataattcacacgactgccatgtcttgctcaccgtgtttcttgcaattgcaataagggccataaaaccggagcatttaaaggttgctatcacaaggttgtgctactttttcaacgcagtgtcacagaaggtcattagtctcgaagagttaggaaatctccgtacattcgcacatgagacatagtgccaacttgagatgtgtttccctccgtcattttttgatatgatggagcacctcattgttcacatagtgccgcagatggttgcgcttggcccattgtacctccatcaaatgtggtcatatgagcgttacatggcagttctgaagggttacgtccgaaatcgtgcacatccagagggatcaatggttgagggttatagtactgaagaggttgtcgagtgctgtatcgattacctcaaagatggatatgcaattggagtacctatgccccgacatgagggcaggttgagtggtaggggaacaataggaaagaagagatttgtcacccatgatcacaaatcattccaagaagctcacttcagcgtgcttcatcagtttgctatcgttgagccgtacatcgatcaacatgtcgaactaatacgcgttaacaataagggtcgcaccaccgagtggataatgaaagaacacaagcgtctcttcatagattggttgcgagacctagacttacctgagggacaaactaccgatgaaataactatgaagcggttggcttttggtccatcaactacagtaaattcttggcagggatatgacattaatggatactcatttagcacaagagcccgagataataagacatgtacgcaaaacagcggtgtccgtgtggagacaattgatgaagccggggaaaaacaatcatacttcgggtttattgaagaaatatgggaaatcgactatgggcacacaatgcaattccccatatttaagtgccagtgggtaaaatacccgaacggagtcaatgttgataagttcggtcttactgttgttgacctggcgagtgtgggtcacaaggatgacccttgggtactcgccaatcgcgtggcacaagtgttttatgtgaaagacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccgtgaagccttacatgcgcatggacggtgtgggcaaaaatgttaaagggtaatgattgttgagtggcatgtaagcatctaagaagttagtagttatgtaatggtggtatgtaaggtgatgtgtgatcatatcgcaaattgacgaacaattgtacttatcattttggtggtatataattagtttgtactaatttttatgtgcaattaccatttgtagtgtaaaaaatttgttaaaaaaattaaattagtaatatttgaaaagtgtaattatttttatgtgcaattaccatttttaccatttgtagtgtaaaatatttgttaaaaaatttaaattagtaatatttttatgtgcaataaccatttatacatttgaaaagtaataatactaaggtttgtatattttgtaataatattaaggtttgtatattttggaataaatatattcaactatgtaccaattttcacaggcgggcggtccgcctgcgaaaattgttatacagagtagggtttacatcttcgcagtcggacggcccgcttgcgaagatcgttgccctatataagggcaagcccgaaaaaccaaaatttctaagtccaggcgggaaccttagaaattttggcgccgttaggctgccgaattttttcgctgccgcacgcctccgccgtccgtcgccgtcgcccgcctgcgaccttcactctccgaccatcgtcctccgccgccgctgaccgtcgtcgtccgcgcgctgtcaccgagaccgccgccccttgctgccgctccaccgcgcgtgagctccacaactctgccgccgccgccgccgacccatccaccgcgcgcgagctatacgccgcccgctccaccgccgccggcccctccaccgccaccgggccctccaccgcgccggccactccaccgcgcggcagccgctggcccctccaccaccgccggcccctccaccgcgccgtcggccgcccctccaccgccgccggccaccacctctctctctatctcgctcgcggccgaacggcttcatcggccgatcgtcgtccacgagcgaagacgtcctcggccgaacgacgtcttcggccggtcgtcgtccacggccgaacctcgtcgtcggcccttccttcgtcatccacgaccgaagctcatcgtcggctgttcgtcgaacacggacatgtgtgcatgtgggtgtttctttttatgtgtgtgcatgtgggtgtgagggggtatatatgtgtgtgcatatgggtgtgaatgggcatgaggggtgggtgatatgtgaatgaggggttatatgttgattgtgaatgtgaatttgggaatgtggatgatatgtgaatgaaattgggagggtatgttcaattttgcaggatatgtgaatttgtcaaattttttaaataacatgtgggagggtatgttaacattttttttaaaaaaaatgtggaggatatgtttgccttttcaattttttttaatcaacatgtcgatgaaatgtaactgtcaattagtgcactacttgataataacatatcaaattttgtacattgtatgtactaattaatttagcataatagtaagtagtaattagtttcgcaatttaaatttgtttgtattaattaatttagcataatagtaagtactaattaataatatttcacaatttaaaattgtttgtactaattaatttagtataatagttaaatttgggaatctcagagaatttaaatttgatcatacgacatattgttaatatacagtttatttttgtacaaagttgtttgtactaatttgagtaatttaaaatgtggacgataactcttttttttatattagaggtttgaaacgatggccgatagaactaaagggactgaagagaagggtttaggggagcaagagcagtcccttgctgttgtggttgctctggaaccaacggtcccaccggaaggtagttccgacagcgacgtagctgacgaagacgaggagtactcgtcgccaagcgatccttgtccaagcccaagcccaaagagaagaaaaaagggcaacggtgaagaaggcgacaaggactacattccccctaaagaaggggtaagtaaacttaatatgtaaaatgttcaccgtgataactattagcccgagctaattcgaaacttccatgtataccttctcgtaggaaacggcgccacggcgatcaaaacggcagccgaagaaaaaagttccgtcgaaagatgacgacgtaccagctaacacaaccggcacaaagaaaagcgaacggtcagcaaaagcgaagaaaaggaagggcgagagaagcgtgaatagaaaggatgaagggttccatgttgttacccatgtttcgcctaaaggagagccgctcgcccctaagacggcacgtgcgaaattcatttcacagtgtggcataatagtaagggaaaagatccccatcacggtcaaggactgtcattatgtatcgaatggggataaggaagtcctatggaaagagttgaagaaaatcttccagttcccggatggatcagaggcagcagtgaggaattgtgcactgcaaacaatggccaagtcttggtgtggttggaaaaccaccttgaacaagaaatttgtgaagacgggacgcacaccattttcgacgtatgccaacataaccccgaatcagtggaacgactttctgacgttgaagaactcctcggaagaaattcgaaggagccaaaagtatgcagagttggccaagaagaacaaatttcctcatcgcttaggctccgcgggatacgcaccaaaggtggagcagtggacaaaagaggaggaggaaatgaggaagaaggggcaaccggtaccaatggaggagtggacacagagatcaaggaactgggtaagaactagaactccgaagatcacggatgaaggaaaagtatcgtttgaaaatccggagctgcagagtgttgccgataaaatagaaaatttatccagttcacaaaaaaaagatctttcaagcctaaaagggagaaagatgtgctaagtacagcactgggtactcctgagcatgggggaagagttcgaggtatgttgagcaagatgagttggaaggaagggttcaaaaatgacccccacaagaagcgtgaagcgtacaaggataaacttagagacgaaggggctgcggagtttgaaaggcaaatgatggatttctgcgtcaagcacatgcttttgcctcaccccgaaaccaaagaacctgagccagattaccccttcaatgacctcaaggagaatacaccctgtagattgcacgttcccagattagaatgtcgaacaagctttgacgataaaggtatcacaaatgtccagcgtgatctttgccacttcatccaccatgagtgttgtcgtgtgaaaggacatttctttgacccagagggtgccctagcagcaagtgacgaattcaaggatcttcaggagtggaacactgctatgccataatgtaactagatgacgttatttgaagtgaaaatgtaaaaaagtattgtaatatatatattttggcaacacttttgagttatgcaatatatgtagatttctctgtaccaaatgcttgataatcttccaatatatgtatataataatctacctgcaagaatttctattaaataatttaaaagtaatttacgggcaaattattattaaatttcaatattttctacctatcttcgtaggcggaagtttttttttttgcaggcggccgattcctatttttgcagacggaccggactagccaatgtccacctgcgaaaattatcttcgcaggcggacggccgccccgcctgcgaagatcagcgatcttcacagtcgttggcttacaggcggacggtcgcctcgcctgcaaagacccttttcggctgcttgcgataacgcttttcctagtagtgtgcatttgccttttttattattatttttatatagtcgtgtgttttctattaatagagctgacagatctgtttcaacaaaacgcatcatgtataagaagtaaataacacacaatttttttagataataaataacacacaactaaactacacactagactttttcttaataaaacatgcataacttttaactttttgcctctacaccaatatttaagaatacacaggggtgaagctagcatcaaaacaagagaggtgcactaccattgaaaatctagaaaatttcagtataacactgtatattctagtattttcaagtgagaaattaaaaattgggggggtccatgtgcacccaagcacaatatagcttcgcccctgagaatacatgtttcactggtggagaaagcctttttactccctgttggtaacccccctatagtcccggttttccaactgggagtatcaatcgatgaataaagatagttatctttagtcccggttccaccaaccgggactaaagagatagtagcgcttttttttcttttgccagatttaatctctatattttctcccaaatctagtgccatgtatatccctaaatcaatccccaaatccctaattcaaagtaacatcccaaatcttaagttacttataaacataaatcaaatacatcacaaatcctaaaaaaaatacactcaaatcaa

SEQ ID NO: 82136 - DNA, 31889 bp, Oryza sativa
atctgtgaagtgtaggagaggataagggatagggattatatactacgtattaaattttagtctcggttggtaatactaactgggactaaagatcaatataatttttagtcccggttagtattatcaaccgggactataaagatgatctttactcccggttggtgtcaccaaccgggactaaagatcctcggccccctgacagactactgacacgggatgaaccgagagtaaagatgatttttagtcccggttgatgttaccaaccgggactaaagatcataaaatatcaagtgtggtggtgaagtagtgtataatataactccacttagctgggtttgagtccataattatgactaaacactggtggagaaaccatctttcgtcggtcagccgaattccacaatagtcccggatgcaataaaaaccggggctaaagatgatctttagtccctgttaaaaagggtaatgggcatatttgatctttagtcccggttcaaatgctgtcaggtcctgtcaggccccccgggatctttagtcccggttggtacaaccgggactaaagatcatacctttagtcccggttggtagatctcagggatctttagccccagttggtaacacaaaccgggactaaagtcccacccctatatatatgtcttcttcctcctccagctgcccgagcaagcttcaaaatttcttcacaaaattagacgagatgatccaggagaagttgacgggcagctaacgaagaagagaattcctgctaaggtgatgtggtatttccctataataccacggctaaggcgtttgttcaggaacaaggggaatgctagaatgatgggatggcacgctgaagagcgtcaacaggacgggatgctgagacaccccgccgatggttcgtagtggcgaaacatcgacagaaaatttaaagactttggaaaggatgcacgaaacatacggtttggtttgagtatggatggcatgaatccttttggagagatgagcagcggccatagcacttggcccgttacgatgtgtatctacaacctccccccatggctatgcatgaagaggaagtacataataatgccgattattattcaaggccccaagcaacctggtaatgacatcgatgtgtacctaataccactggtcgaagatcttaaactgttgtggaagaaggaaggtgtccccgtgtgggacgaggacaaacaggaggagtttaacctacgagcgctgttgttcgtaaccatcaacgattggcttgcacttagcaacctatccggacagtccaacaaggggtacaaggcttgcactcactgtatggatgaaacagaaagtacgtatcttaagcactgtaggaaggttgtatacatgggtcatcgtcgattcatactgttgaaggcgatgacccatgtatacatgaatcgacgatgacccatgtctacaatagaaacagaaagtacgtatcttaatctcatccatctcctgaaggcgcagcattacaagacgttcatactgttgccgtacaacacagagttagtttaattttactgtctttctataccaaatttcattctcgtacgaacatgctaagtgtttcatatgtaatgcatcccacgcacattgctgattcaactgggtgcttttactcttcgacctggaggcctgcaccgtcaacgtatatgactcaacggataaaaagagtctacgtttgacaaggttttcgaacttatagacaggtactgtcataagttcctatgttaattaagaatcttgttatagttaattgctactacaaatcatagctttaaactccatgtagggcttggtatcggctccgtcatttggtccgcggcaaatggagagaaagacttaggcggaagttcaaatttcctgtgagtacacatactctacatttatatttctccgattcaaatacatacaagtgtacattaattagatctctcgtcgtttgtcatttatttatagtgcgcaaagcaaaagcagggaactaacttgtgcggctactacgtgtgcgagtattgccactgccttgtagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggcggttcaagaacaactcatgggattcatcaatgaacaaatccttgatcccaagggtgaattctactacgacggaaatacaattcatatgtccttagcttctgagatagcgactactactacatcgaaatcgtagctagataggacatataatggattgtaattaatacatgactatgtttctatatgcatgtgtacacattttctataatgtaaatatatattttggtcatatatatatatatacatatgcatttgcataacatatatatgtataaatacatatatattatgcatgtacatatgtattgaaacatatataaatataatataatatatatatatatatatatgcatatatatgtattgaaacatatatatgcatggtttatatatatatatatatatatatataaaccatgcagcaacagggccatgcaaaaaaaaaaaaaggtcagctcgatctttagtcccggttggtgttaccaaccgggactaaagatcgagctttagtcccggttatttcacccgggactaaagatctatctttagtcccggattggtagtcccggtttggaaaccgggactaaagggggttacgaaccgggactacacacgctttctccaccaatgtcattgaaaaagaatggggtaaaatgtccgatcatataaggactacatactatttaaaatataggttgtttataaatgataaattgtgtaaacaattttactatataagtgttctcgtaatatcacagtgatattactgattttgatatttataggaaaaacctaagtagacaaagttgtaccttattgtccttgtccggtctctctatgatctaatcattttgaaattgtttataaataaacattgagcctaaaaactggggcatgtttttatcctcagaggttgggtgcggtggcaggaagcggaggctgaaaagcaaaactgtgtgtcccagcgaagactgtggccaagaatcgggttgggcttggcagccatggtgtaagggaaggatattttgtccccagttacccatggctgtgctagcatgagcttggttatgaacaacggagaaacgtgaggtgggggaagtcgggctcgacaccatggtaaagcgcatcactgtgattggggtaacaggtagagtttgggacatgtgtttagtaaggtggcggggctccgcttggcttgagccgtttggaatgtgataccattaggccttcttcggttaattctcaagagggaaggactgacggacgggattgacgggataaattccacatctcaataaaattgggaattattccccctccaaatccttctcaatccccttgcatgtgggattaactaaacaagaccttaagcactcggttagtgtctcgtgcagtattactcgatctagaataagaagggtagagcttcaggatatatttatttaaggataaatggtggatgatggcgagaagcagagaagaggcatggggtgctatttataggatgctatggagattgtcaacatgtcaaggcagtgaccgaatggaagggatgaactcaatctgagctcattcatggctacagcggtacgcgagctgggccgtggacacatgctggctcagccaatggcaacagacggctgaagcagtagagatggtgtcattgttgatgttggttgatgttggtatttcttagtgaggatttcctagtgatgaacaatatctacataagcttaatttaatcatatcgtaatacttcaggcactggcttgctcgctactaccagaacacgctctactctgtacccggatagggaggactgtgataatctcaagggctgtcaccacctctacaccaacctctaatgaactatgggatatgcagcaatcactagtaattaataacctagacaccatgtctatgcaattaattactactctagcgctagctaaacactaaagtactcactctctattaatgaacaatagtgaacaataatccagtatgttaatagaaactaactaagagataatcctcacaaagcaaatctcaattactcaataaagataatatcaattaaagcagaataattgacaaggtacaaaaggtaaagaggaaagtaccgacaacttcggaatccatccgactcttccttccttactttctccctattctattgtatataaaagatacaatagagcctcttataattcaacttaagctcggtgtgtcttgaaataaaacatgtgagctccttttatagccttcgtatgagggtttggtagttagaattgtcccaactaccccttcaccgtcattaggacgctatctggatcgtccacatggaaggagatggcgaatagcgccgatgttggtttggacgaaccacgtgagtttgattctcctccttctttatgtatatttcttctcaaccttagtagtttatcacatgcatccaaatatataccaacatttgtgcaatttgttagaaataaaccctgtcacgatgttggatattttaaattttcaggtttatacaggaattgacgatgttaatttggtatttaatagccgtcaaacagtgggcagcatgaataagcagccactcgtagcaagaagcaacacagtggcagcttgcatagccctatgggcgctagtgcgctgctaggcgtataggaggagcggccacagctgtccggcgcattgccttgcgctggcgctagcaaaggctagggagggtgagtatatgtggccaatggttgagccacccatgccagcccaggcacgtatcaactgttcatgatgcatgcacggcccggcccgtctggccgtgttgtgcttgtgctgccaccaaggctcgcatgctggcatgacatagcacggttgttctagcaggccgacatggtatggactgggcgtctgggccacatggatgatggtggtaggcaccaagaataaagaagagacggtgatgcttcttggtgtaggaatggagggcgagaagcttcttggcggcaaccggtgaacgtggaggttgtcatggtcatcaacgaggaataagaggatgcggaggcgtggagctggtaggaagcagcgaccaagcagtgcaaccgggatgcccattgttgagcatgcttcgagcaaccttgcaggcggcggcagtcgatgatacaggagtcgacagcagccgcagacgatgcgagagtcagcggcggggatgaacaatgcaggaggcggcagcaaacaaaaccctaatcatagccatctccatgatttcgtttaattgtttttcagcaatcgtccaagccttatacgagctaacatgcctttcttagcccacgtgcctaaaacaaggttgtgacggctccacactgcttggctccttactgtgcatagcctgggctccgactttggaacggctagcatgacactgccaatttgggcctcatcgtcatgggcccattccatgatgggccaggcctcgcctgttttggctagctataaggctgagtgatctggctaggctttgggtcaacttttttttttagaatttcacagtataaagcacactcacccctatgaacacacgcacgcaaaccctacccctatgagcatcttcgaagactgggccggcaaatcctagagattgacgaagtcaccataggcgcctcgctgttgacgggtacgtcgcctaccactgaaagcacaaatgccgttaaatcctggaaaatccgctcccatggagagtcgaacccaagacctaaggtgctacggaggctcttgtaaccactaggctacaggccctttcgcggctttgggtcaactttggataagagtggacatggatggagttgtactagggtttcatctagttcaggtgggctagaacctactactagaagattgatcgaaccattggcaggcatgaacagtgaagtttcacattatgtaaaacgtccaatgtaactccctcaacaataggtctataggtagaatttgtttcgcatccttcaagcacaagaacgggtatttcacacacctcaagtattaaaaccagtgcaaaattactccgtcaaatgtattactgacatggcatccacgtggcagctaattattaaagaatacattaaaaagatgtgggacccacctgtaagtgattctctctatcttcttcgtccaccctccccctctcttctctttccccaccagaatgctagtgcctagcaccaccacaagaacaccgatctctaccattgccaatgactccatcctcctggtccaccaccacggctagcggaacagaagaagtggcccagatgcagtgtatatcaacatgggtgcggctaccggatgagttggcgacaaagcatgtggaggagggggaggcaggcaccgccacaaccgctgctgaatagagattagctcatctggcgaggcaacccaggatacactcattagaagagattattttgatttggttggatttgttctgattggtttgctttggtcattgttgcaccgtcgatgatgaagctgagcaaggtgaccctcgcagcaaggtggggccagccggatctggtgaccgaacatgcatctggtgatggtatgagagagggcagcagtggaggaagaagatgaggagagagaaagtcacatgtgggccctatatttatttctaaaatttcctttatgattgggctaccacgtggaagccacaacagcgatagcgattaccttcatttattgtgtacttcacaaaaagtgaggtaggcggcaggtggtgataaccctgtacccatcctttgtatccatccacattcaagtatatcatagagccgtaggccggactcagcttgacaaactaggggagagccggtgcccaaatcaatattaacccatagaaatcctctgtagcttaagcctaccatttgttgttgtccttggttgaatcttattcctagatatacacacacgttcccaatgatttgatacctgtcacgcccagaaattctcgaaccagaatttctaagctgaatgtgcattaaatccctgtccaggaccagccagggtacacaaacgacaattgttgacctacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggggtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgtgggcacggctattcgaatagttttactctggccagaggtgtacaactgtacccacaagacacgattccacacatgtcggcatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccgtcacgcccaccctcgccaccggtgcctaggaaagggtcgagctatacttcagatcaagcagttacccactcccgcttgtggtaagcacggtaagtctcccagggtttcccgtgaaccgatccttaattgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctaatcattttgatacccaagttatcaatggcatagggtaaccaatatgtggctgagaaataggacccatcccacgttacattgtaaaagaatgcaacatttaatagaaatgcgggatatttgtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactacagaaacaggaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaagggggggggcggcgccgacaggcgggccccgcttgtcagcggctcaagagaggggagagagaggcgccggcaagcgggccccatgggtcagcggcacaaggtggccggtccaccgtggaccgggaccacgcgggtggtccaccgccggtccacgggaccgacggtccggatcggccgggaggccgatcggacggcacggcggcggctaggcacggctcggctcggcttcaaaaccggccggccggccatggcaaccggcggcgacgcgcacggtcgccggcgacggcaatcgacggcgtgggaagcgaccggaggacggggcgaaaagcggcggcagcggctgaaggcgacggcgcacgcgcgaaggacggcggcgcacacgggagagagggaaaaaaggggagcggaggggagcctctccggcgagcacggcgaccaaagcggaggatgaaaggcggcggtgacacggcgacgaggaggggcggacgggcggaggcgacacctataggaaaggaggagagggattaggggtggagaggacgaccgcaacgaccaaagtggccggccggagatggatgaaaaaggagagctcaccggcgagcgagggaaacggggtttcgggggtgattggcggcaaccaagcggcggccgaggagcggacggcacccgcgagcgcgacgacggcggcttcacggcgcggtagcggctttagcggcggtggcgcgcggccggagacggcggtaggcggcggcgtaaggggcgagcggcgcggcgacgataggaagcacgggagagcgcggcgaatgagggaaaacgaaagagggggctcgggagagtgcttttatgggcgagggaggggaggacgtggccgggaaccctcccgatttggccggcgacgtggggaggagagagagagaggggggtgggattcgaaatcgaatcccgccctctcgagcgcgcgcacgggccgggagatgtggggaaggtgggcggcgacgcgggcgcggagtggggcgtgaagagggacggagaaggcgagcggcgtggggaggtggggcgccggcggttggggctcggctccaaccggctagaggaggaagacgaccgacaggtgggccctacctgtcggcgcccgaaggagagagggagggagggaggacttcggggaggggagaaggaacgggccggcccaggaaaggggcgccgagcgcggggagagagatgggccgacggcccatctagagaaaaaggaaggaaaagaaaagaaaaagaggggaaggattttcctgggattaaaatattgcgcttgctcatttttaattggttaaaattatttccaatgctctgaaaattccactaaaaatcttgttaatgcattggagcatggggaactcaagaaaaattccaccacgccgaattcaattattaattgcatttattaattagggaattagctctaggttaattaagataatttcttcggacgatttatttagccaatttttaaagcaaggagagggggaaacttcagggcgtgacacacactcagctcatcatgccaaccccatattagatacttcggtggtgactcctcgaggttacggtatcaactatcggccgttgctattgccatgtgaactccactgtctttatcatagcccgccgccacatgcccagcttctctgaagtaagacgagcaacggaagagcacctgtagtgtcactgtggctatggtgacgattgagacaaatggtttgagtatttagatgaaggttttagattttctttttaattgattgaaagtttattatttatttagatgaaagttttatatattaattaaaagttctttgatttgattcttagagttttagatcttgaattgggatttcctccctctagcttgtctgtctctctcctttccttcttccccctctatctttccttttctttttattattatattggaataagttcatctaaggtcccttaacttgtcaacgaatctgattttcatccttcaatcacaaagccagatacaacgggtccctcaactatcaaaaccggtgtaaattaggtccctcggcggtttcgatagcagttttgactgacgtggcgcctacgtggctaatttgactcggtctcgatctgacgtggcactgacgtgacgcatacgtggcaattcaattcagaaaaataataaaccccgtgagacccacatgtcaatttcacacataaattaataaaaaatggcagggcccacgtgggccccacatgtcatttcacccctcttcttcctcctctctctccccatctcccatctcttcatctctctcccctttcctctctcgctttggcgctcgcgccgctctcctcgtccccaggcctctccgaccgcctcctcgccgcccgcgacgagctccacgagcggcaggagcacctcgccgctgcctcctcgtagcccgacctcgccgctcgacttcgtgctgcccgcgcctcacccgaccccctcgccgcctctgccgagctcaagcctctcttggtggatcccaagggatctgaatctagtccagacgaacccatcgccgtcatcggcgtctgggcacggttcatgagcaaaggcggctgcgccgtcgctggtccatcaccagcttctcgctgtccacgctgaccaactcgctcgtcgtcggcgtgcccatggcgcgcgccatgtacggcgagtgggcgcagcaacttgtcgttgtcagctctggccaaggattacagcaacacgcgcacttcaactagctggagcgaaaatctttgtggacaaacacagaagaatttctcgatgatgaacgccttatctagtttttctcattcacttggcacttaactcaggagattacatgacttctgtagcccagcagacacaccactaagaaaaaaacttcggccgcatcgtacgcgcacgcagcacgcgatccaattaattcggcagccactagctagccgcatgcacgaagctaactgccacacaaaaataatgctaacaattgtccagctctccgtcttccaggccatcgtctggttcacgctgctgctgttcgtgctcgagatcaggaaggccgccatcggaatgtacgtcgacggtgcgtcgtcctctgacgagtcgtcattgtcgtcgacgatgacgccggccagcaaaggacgtcgaggccagcgctggcgccgccgcatccacggtcatcgtcgtcaccgcggcgagcggcgccggcaagtcgtcgctgtggggcgctggtgaaagtagtggcgccgctccctcctctccggccgacgccgccgcgctccgctccctcctctcccgctggcggtcatcggggagaagggcggcggacggccggcatgttagggactctcaagaacaactcagatatatgcgaaattgtggcaactatgtggtatttcctctcagatccgacaggatcgagccgccgccgcctacgcctccagttgccaattcatcgttcatacaagtgttcatcgtttgatttaatacatccctctccctcacgtgacagctcacaggcgagctggtgtcttacgccacccattcagggcctaacactcttgggttgggcctacgctcccgaaccggccgatgaccattgcatgtggagatgtcgctttgagaagtatggacgtcctcctcctcttctgcattcagatccttcccgccaatggcaccaccctcaacagttgacagtggagagtccctgacaagccccaccccttgagaattggcttgcccccaagccaatgcagcaggaaatcgagcatgcaattcttcatagtcttcccaagtggcatcttctggaggggactcagaccactgcaccaaaacttgagagatagtagaattacccttcttagcaagccgcctgtccagaatgcgccaaggaacttgcaaggcagagatagacgatggcagatgagactgaacatgtcctgtaaagccagtagcagatttcaattgagacacatgaaaaactgggtgtatagaactggtgggaggtaactgcaatttataagcaacagttccaatctgtgctgtaatttgaaatggcccaaaatatttgaaagccaatttgtgattagctctgacagccacagaagtttgaacatagggctgtaatttgaggtacacccagtctccaatagcaaaagtacgaaaactccttttcttatcagcaaaatgcttcatctgctgctgtgctctgtgaagatgctgttgaacaagcttctgcatcaactgcctttcctttaaccaaacatgtaaatcaggaatggcacaatcttgtaaactgatgccaaaatgacaaggggaatgaccatagagcacttcaaagggagtagactggacagcagagtgatatgaggtattataccaatattctgcaagatgtaaccaagctgcccacttgctaggagctgaatgaacaaagcacctcagatagatctccagacattgattaaccctttctgtttggccgtctgattgaggatgataagcagagctaaaatgcaattttgtaccagatccttcaaacaaatgttgccataactgactggtaaatactctgtccctgtcagagattagtaccagtgggagcccatgcagcctgaagatatgcttcataaacaatttagcaactccaagagcagtgaaagggtgatttataaggaagaaaatgagcatatttggaaaacttgtccaccacaactaaaatacaagaagcatgatctgaaacaggcagaccttcaataaaatccaaagagaccacctgccaagcaccctcaggaacaggtaaaggctgaaggagaccaggatatttagctctatcaggtttagcctgtaaacatatctggcactgctgcacaaatagtttagtcatttttttcatactgggccaagcaaaaagttgctttagtttcctataagtaacagggaaaccagaatgccccccaattggattggaatgaacttcagttagtaatttcaattggagctgtctgttattcccaatccatatccttcctttatatttaagcaacccagcatgaagagagaaatgttttcttgcattgggctgtacagttaattcagtgagcaactgactggaataagaatcactggcataccctgtggtaacttcctggagccaggttggagtacaggctgaaatgtggcataattcttcctcatcatgctgaaatttcctagataaagcatcagctgccccattatgagacccccttctgtaacaaatcttataagatagacccaggagtttggtaaaagctttatgctgccatggtgtatgcaaacgttgatccgagagatgcattaaactatgatgatcagtgagaataataaagtcaccaagttgcaaataagatctccattgatcaactgccagtaaaactgccatgcactctttttcataagtggaaagacctttagttctgggacctaaagccttactgatataagcaactgggtgtccatcttgagagagaacagctccaatgccggaatcagaagcatcagtctcaactgtaaacaccttttgaaagtcaggtaatgccagaacaggagcagaaaccaaagcctgtttaaggttatggaaagcagcatcagtttcaggagtccaaatgaaaggaactccttttcgcaagagattagtcagaggcttactgataactccaaatcccttaacaaatttgcggtagtaaccagcaagacccagaaaacccctaagttttttcacagtagtgggcaccttccagttcactacctcctgaatcttaccttggtcagtatgaactccagctgcacttatagtgtgacccaagtatgtcagttgtttctgtgcaaaagaacacttggataacttgacataccactgatgcttggagaggagtgagagaacttgagcaatatggtccaagtgagatgagaaatcagggctatagataagaatatcatcaaaaaacacaagtgcaaacttcctaagcacgggactcaatgtctcattcattgccccttgaaaagtggcaggtgccccagtaagcccaaaggacataacggtatactcataatggccagtatgagtctgaaaagctgttttatactcttcaccaggagccatgcgaatttggtggtatccagctctaaggtcaagcttagtaaaccatttagcatgagcaagttcatcaagcaactcatctataacaggcataggataagtacctttgacagtgatagcattcagctttctgtaatcaatcaccaatctccaagtaccatctttctttttgactagaagggctggggaagaaaaggcactatgacttggttggataaccccagacttaagcatatctgaaatctgttgttcaatttcatccttgagagctggattaaatctgtaaggtctcaagttaacaggggctgctccagggacaagaggaatggtatgatcacaatatcttttaggaggtagtccattgggttcagcaaaaactgcctgaaatgaatcaataagttgctgtacagcagcaggaatgggttccttagtcacagggtcagaagaagtgagttgaaccaaatacatgagagatccttgtctgaccatacccagacattgttctgtggaaataggagagcaatgagaaacctgggatacaataccttgcaacctgacaggctgtccagaaatagtgatatccatccatttgtccacccagttaacctgcattggactgaattgttccagccaatccatgcccagaatgatatcataaccaccaaggttcaggagcctgaaattgttaataaagttatgtccctgcatccaccacctacaattggtaacttcatatgagcaagaaagagtttcgccatcagccaacttaacagataacttgcttctcaagggtttaactccagccaatttgagaccaatactttcctccataaaggaatgggtactaccagagtccacaagcataagtaattcagtaccctggacccatcctcttaatctgaatgagttaggagattctgtaccccagatagcctgctgagagatagccattaaatcactggtgtcctcacagtgcagaaactgttccccatcagacacctcaacagttttaacatcttgcaaggcatctagcaattcttggaccacatgtaattgcacagcagtactacacttatggtctctactccacctttcaccacaagtaaaacagagtcccttggatcgtctgtaagcctttagagcagagagcttatcatctcttgctcttgctgattcagtgcccctcctatcttcagattgtggtgataacaattgtttaggtggcaaggtggatggaagaaccccagcacccttgtgactattgcgaataggtattgaggtgtcaggttttttatactgagtagactgaacaccctccaaggcctcttcctgaagtaaggccacagcacaagctgagtccatatcctggggtctctgaactaggactacaactctgatatcacttctaagcccttccacaaatttagtgacaaaatagactggcaatagagaattatcataagcaaggagctgatgcattagactatcgaatttctcaacgtattcagcaactgaaccatcttgtctgatatggaaccattgtctaataagagcttgttgtctatccttagagaatctggaacacactaaatcacagagacccacccaagtaataccaccaagctgatttcggacagattgcaaccaaaatgcggcattaccacaaaaattgagagtagcaattttaacccaatgaatttgctggataccaaacacatcaaaatattgttcgcaattaaccttccacatctgtgggttgtcaccacaaaactgggggcatgtcatgggaggaatagtgctactcaaattgtaactagcaattccactgtcaagagaaggtgttctaggttcaaatccaaaaggagcacgggatagagaaaaattttcattcataccgaaagaaggggaagtcagatctgtgttgggttggttctgctcttccttgataattccagatcccccagtcttggcagtactagcatctggctccaacttggtgtgacgcatcagactgccctcgaggtgctcgaccttggtactcagcgactgcagcgaggcgcccagatcttctaccctcttctccaccgccggaatacgagattccaccgacttcttcagatccaggtactccgccctggttcggacctccgcttcctctctcttcctttcattctctgcaatagttttgaacaagagatcgaacttggcgtctaaatccattggtgtgtgactctggatcctaacccgcgctagcgctccgaattcagccaaccagattgagggagccgaagcttttgtggatcacacgccaccaaggtagcaggatcccacctctctcccggaaattttacggctaaaccaagaggattttgcagcgcgaatggctctgataccagattgttagggactctcaagaacaactcagatatatgcgaaattgtggcaactatgtggtatttcctctcagatccgacaggatcgagccgccgccgcctacgcctccagttgccaattcatcgttcatacaagtgttcatcgtttgatttaatacatccctctccctcacgtgacagctcacaggcgagctggtgtcttacgccacccattcagggcctaacactcttgggttgggcctacgctcccgaaccggccgatgaccattgcctgtggagatgtcgctttgagaagtctggacgtcctcctcctcttctgcattcagatccttcccgccaatggcaccaccctcaacagttgacagtggagagtccctgacacggcagccatcggggacaagggcgacgaccggtgggaaggagctaggcgagctccctagtcttaccggcgagcgcgtgcaagagcgagatggccggcggccactcttctccattttcgccccgccgtcgtcgcaagagagagaaaaagaggggagatggggagagaggaagcagaagaggaggggtgagttagactgacatgtggggcccgccattcttttattaatttgtgtgaaactgacatacgagtcttacggggtttattatttttccggatcaaattgccacgtaagcgtccacatcagtgtcagatcgagaccgagtcaaattagccacgtagatgctacatcagctaaaaccgccattgaaaccgccgagggacttaatctgcaccggttttgatagttgagggacccgttgtatccggttttgcggttgaaggacgtaaatcggattcgttgacaagttaagggaccttagatgaacttattcttatcatatttcctctggttttcctggccacagctatggcccatttccctgtctctgtggccggcccaactcgcgctgtgctcccaggcccccatgccacgctgtccgtacccctgcctgcgtgcgcaccgtcgtgagcgccatggctatacggtcctttccttcctcctcttcttcttcgtcgccggcggcccggcgccatctccgttctgccgccgcaccgtcgaacagaacaccacctcctcgaagacattctgcaatggagtacggcctacggcaacattggagccctccctctcaatcctttccaattatggacatataccgcctccaactccaaatcggactcggactcagcgttcgagttcgactcggattcggagtcggagtacgtcgccgctccttaaaagcacggcggcgctcaccagctagagaccatccaacgcatccattccgtcctcttcgattgctgctttcccgtcgcgaccatggctcccgccggcgactacggcgcctcggtgagcatgatgatcagctacggcggcgcgatcgtccaggccgacggcaaggccaaggcggcgtactacgccggcggagtccaccgcatcgtcaaggtcggcatgtccgagcggctgcccggcctccgcgcgcggctcgcggcgctcgccggctgcgccgacgtgttcatccgctacgcgctccccggggagggcctcggcgtcatccgcgacgtggcggacgacggcgacctgtggggcctcgtgtcgctgctcttctactacaaggaggtgcccgtgtcgtccaagcccggccgcatcagggtcttcctgttcgccgccgatcacgacgcgccgccgcaccgaaccgcgtcggcgccgtcgttaccggtgctggtatctggaagtgcctctgctgctcctcccgttacactggggttgccacgcagcgcgtcttcaccgtcgctggcgacgtcgggctcgggcaccgccgtgaggatgaaggtgagctacggcggggagatcatccagcagcagcgcggcggatcagcggcggcgtcgtgctactacgccgggggagttcaccggatcgtcagggtcggcctgtcggagcgcctcgccggcctccgcgcgaggctggcggcgctcgccggcttctccgactccgacgacgtccgcatccagtacgcgctcccgggagaggagggcctccacctccacgacgtggcgagcgacggcgacctgtggagcctcgtgtcgctgctcttcttccacgaggcggtgatggcctccagcaagcccaagcaaggccgcatccgcgtgttcctcttcgccgcccacgacgccccggcgacgtcgtcgacgtcgcccaccgcggcgccgctcaggaggagcgcgtcgtcgccgttcttgccgacattggtggaggaagacgaggacgacgacgacaacgacggcaacacggacacggcggctgcaactcagacgagcactagccgtgtcaccgccaccgtgggcatgcggcggagcgcctcgtcgccggcgctggcgacgacgtcatcgagctcggacgcggcgactgcctcgacgtccggtggtgcaacatccggttcatcaggagacagcgacacaccggcgatgacatcttccacggcagcggcggcggcggtgcagttcggtccggtggtgcttgtgccggtgatggtggtgttcccggtgatccccgtgtacgcgattggcgtggtagattatcgtagtgtgctccttgtagcgtagtgaaacgccttgtttcctactgccaatctgagctatgtacttgtctacttgattttgtacaattcattcaaggttattattgtaaaccacattaccaatgtactcatcgtgtgttcactgttcaacggtattatatttcattcacagaacagattgcaacctaatcgccattagcatcgaaataaagcttatgtattgtagtgataaatgaatatatagcacagaaaacgtgaagtaaagcgtagctcaagttcgttgtgatggaccgggttcatccgggtcaaatcctggaccagtttcagcccacccaaatttaaattctagactttaaaatcgataaatatgctaattatatttttaatgatatgtatgtcaatagtgatggcttcatgaatgcaagatataccagtgaaccagtccagtttttcagaaatgctcagaggtagcttgttgcacatgttgtgaccacatgcgtttgaaaaaatagcacagaaaacattcgcagaatattagcaccatgcaattacaacgcaaaatgttgtaaagaatacgtagggctacacattggtgcgaggagccaacaaaatgctttttgccgcactggacttttttcaacgctttggcacgaacagattacagattgtgtccgggcctgctagttgcagcagaagaggtatcaacttcccagtgaaacttcacacagttctctagcttagctacacaaatgaagcaaacaaaggaattgctgcatggtagacagatacgacataaaatcgaactgaattggcgagaatcgaagagatgtccccattgacatatacagatgtaatccagctttttagacctacattttactaccgagttccttcggcttcgcagctttccctgactccatatcctgcaatgcagttagaagggggaaaaataagtcaaatggagagcccaaatataccagttgtctaaagaaaaatatagcaacacttgattatgctaaataacagtgaaccaaaggattgcaaagccaaatatttaattacaagacaagaatgtctcctagaccagacaaactgcatgggtaaataaactcagcgacattccacttcggcattgatgtcagattgtcaggtcaagtctgtctggtgtgctcagtgtccacagttcaataatgcacgaattactttctttgtgactgtcacaggctcacagcacatagatcagaatgcagagcggctctggtcatacagtagtgttgtaggcaatcactgaaggtagataggccactgaaaattaagaacaagccatgtctgcatccaacacgaagcacatgcctaaatgttggcagtttggcacctacaataacaaaactataaaagttcaaagtgataaagaattaaagagcgtggcatgtctattttcttaggttgagggaagtatagactaggcaattaactttaagcctaaagagatactaacatatcctataatagcaaaattcattttccagatgttaggaactggggttgatccaaagctcctaaggtagtaatggtgctccatgggagggcgaggatggtgcatccaccgaaccatgacagtgaacagctgaacaagagagagagagagagagagagagagagagtttggcgataattctacttatccttcttattgatggagttctgccttctaaaatcgattaataaccttgctaacaaacagaaaatcttaggagctaaatcttatctagcttaacattgaaattaatccaaagctaatcctgattgaacgaaaagacaaggatgacttctggcgcacctagcacctggcatagggaattcccaaaataagaccagatctttccacaaagttttttcctaatttggatccccaccacacaatagtgaatttttcttttgttcaaaagaaaacacatatctgtagatatatgttctaataagaagtctggtaagaaatgataggacctgcgtgctttggcttgataaaaataacagacgatatgtctgcaactgcatgttcacacaaccttgtacgaagttacaggctatatgactggtgtcaataaatacttctatattatgttaagcattttttacaataatcagatctcttttgtccatgttagcaagaaaatttgatatgtacaatggcatgtattgccacgccaaataaattttataccagcttcacaaagaagtccaatttgataattggtatggaaagaccttttctttgcggggatggataaaaagactctgatctacatttagctcatcatatccagatttttaaatgtaaaattcgtgctcatgttagcttttcaaattttgatttcagaaaggtattttggaagcctggttctttcaatgatggaatccatcaatgtcatctgagactttttattggaacacactaattggtacatcatagaaacattatgaccaacactagcaaaagagtgtgttaccatatcacagtgaagactaattgtgaaaaaatagaattagtatggtttgctgctatataaatacacaataaataccaatacttaggcaatgacagagtacaggaattttgaagaatctaatattgcaaacagttcaattcctaaaagcacgaggtacctgtccctctgcattctaaatagggacttaactcttctacatatcccaacatgtatgctttaaatagaagaaattgaccatccgtaattaagatatatagtctaatccccataaacaaggtgataaaatgtaattatgtgtaggtgacaaatcccaagatacatgtggagattgtcaaaggaatgaaagtgtgcaaacaaccaatgcaaattactacctttcttattaacaaaggcagtcaacaatatctacaggggggaggacatagatgaatctaaagcaacatttcaacttaaatctaaatcagtttcaccatacaaacatatttaagaaccaatttagcaagaactaataataatcagccaatcaggtactagtaagtaacacatccagtggcaaacaagttgtgcttccagtactgaccaagtgaccatacattacttaatccagcccatgcatggtagaccaccaagaaaagaatattaggtagatcaaaaggggaaaagatgatgtgcaatgcaatacatgtgtcagaaaacaatacggggaatagggagatgcatgatattttagtgcagtacatgggtcagaaacaatacagggaaagaaaaatcacaattgactagcaccaccaccatccaaaaactacattctccacagaagctttgggcttgattaccaaccataatactacccacccactactaccagcatcctgtaatgttgtaacccttaagtagcactaaatcgccgcacttaggattacaaacggtgacagctacaggcctaccaccaccgacaattataaaccacacggaatcacgaatgggctacaagattccactccagtacaggatcagagacagctgcatcccaactcccaacgctgagccacaggacagatggatctttgctaaactcacgctcaaatcaccacaatttcgctatccgtgcaaagcattgatgcagtttacaccatcaaattgaaagtaacaagactgaaagaacaaaaaaattttgcagaaggggtagagtggaggcgagaacctttccgttgctctcatagtactcgttgagagcccactggtacttggattgatccagcccgaaccagttcgagatgtactcgtccaagctggcgtgcgctgcagcgataaatgctcaccaaatcaatttcaaaacccacgaatcgaattcgaatttcgaaaccacacaatgaggcggccatcggagagaaaatcaaatctctcgcgcccgggggggattcaatcaatcacccaccttcttgcacgcgcgcgaccgtgtcccagaacaaggcgagcatggatccatcgggcctcgcctccgccttctcgaactgcggcggcggcacctgcaccggcggcggcgtcggcgggggcctaggggccgagagcttcgcggaaggcagtggcacctgcaccggcggcggaggccgaggggcggcggcggaggagagcttcgcggcgggcagcggcggtgagaccgtcttcaccggcggcggggtggccagctgcggggaggccgccggcgcctcctccttgaccggcggctgctcggcccgcggcggagagggaggcggcgtcgaatcctcggccgcgcggggggatccgctgggggtggtgaactccgaccgcggggagtccggcgacccctccgcctccgcctccgccggcgacggcggcgtgatgaagaccgtgaggttgcccgccttgcctatcaccggcggcggcggcggggtcgacgccatcaccggccgcgcggggaggaggtagggttcccgggggggatggggaggcggcggagctcgtgtgggggagtgaggaggaggagaaggctgcgagtgggagacgccattgcgggcgacaagggggagaagcttttgttccgcgctttttcgtgattttttttctcctttttcaaatctctttttcaacttttcagcggcgtatttctagctcaaaatagtactcgctccatcctagtagtattttaagtgtagttgtaagggtttatgtgacgttcattttatttaaaaactttataaaaaaattaaaaaataaatcacgtatagagtattatttatattttatcatctatagcaataaaaatattaattataaaaaaattaataaaacaggtaatcaagtgttgagggagtaatacagtagaaaaaggtttgtgaaaaggtatagctgcaccgagcttttcgtgcacccggtgaaggggttgacttgtgggcccacaggtcagtgggggaaggggtagtgaaccaggtgtaggtacatgccagaaggatttcacgagagagggagggaaagggcctcccgttgtcctcggatccctttagaaaaggcagtacgcttttactgttttgcccctgaatgaggggcttaattctgcttgttcacactctaacgcctgttgactttggctaagagcctgtttattttcttgactctaaactactccctacatcctaaaatataagtgatttggttgaattggacatattataatactataaatctgaataaaactatttataatagtaggatatgtctcatctaacagaaatctcttatatattaggacggaggatgtacaaatttcttgttttctgttagagcttggaacaattctaacatatagaaccgaaaatgttttctgtgaaagggcatgtagcctagtgattacagtaagcttagtagaaccctaagattctgagtttaaatctccataggagcgaatttcatattgggttatttgatagctaagttatgtatttaataggctaagttcctaattaaaaaaaggttgcatatatccggttggatatagaggccaggtaaaaaatacccttctctaaaaaaaatatagaaccgaaaaagtagcatatatccggttggatatagaggccgagtaaaaatacccttctctaaaaaaatatatagaaccgaaaaagtagagtaatataaatgttgcacataagaggtttgagtggatagaaaatttcatatgttttcttcctttgacttgtgggaaagaaaatttcctttggtttttttatacctacatttctataaaccgaatgacactcatataaattaatccttaagaatctaaatcctttggttttcctcctaaatgaataggcttttttacgcttttcaaaatgttaaacaacacatttttttgaaaaaaaaatatataaaaagtttctaagtccatcgagttttttaatagttaatactttaattgattagtacactaatttttttttcttgtttcgtgtgcgaatgaaaatatccttcgaatgcagcctaaggctgagttccaactgaaaactgaaactttctcgttttctctttctcgttttctcttagtaagtatttttaggaagatttttaaagttaaataaatttatttttgaaatactcaattaatcacgtgctaatttctaatataggtcttgttcactttgtagccattttcaacatttccaaaatttggaattggtaacattaataactttaggtaagattggctaaatatgatgttgtcaaaatctctagctatgaccaatatttggtaataaactaatattgttatatgtttgtcaattttaagaaataatggtatggttcagaataacatgaatctaaacatgcccctagtttcgtatgccattgagttgctctgccaaaagcccaaaatgctatgtcgaacgcagcctaagcaataccttttttttaaagaaagcctaacaatacttcatctttcttaaataactgacactaggaccgtctcactttaactacaaaatttcttttaagtaactactctctccgtttcatattataaatcttttttatttttcttcctagttaaacttttttaagtgtgaccgagattatagaaaaatttagcaacatctacaaaaccaaattagttttataataactagtatctaatatattctgatagtatgtttgttttgtgttgaaaatattgctgtatttttctataaatttgatcaaagtttgactagaaaaaagtcaaaatgatttgtattatgaaacagaggtagtatattttattatattgtgacgagtgaaagtttcatggttatattagcagcactacacagttcaatagtataatatattttcaagtatttataaattctttaagaaaaaagaaaaagatcaaagttgaatagtggtagtgacaattattaaaacgaagtgagtattttatttttgttttaaagctatactaaattactacctctcttcttaaataattgacaccggcactatttgctttcatatttcacttttttttttaaaaaaaagatatgaacacttaaaaatatgtagcgtcacaaataaccacacaactttcattcatcaaaattcaatcattcaaaagtaatttacagtctaataagtaacacggtaaatagtaatcattgtcaaattgttgcactatcttattttcattccagttggcacgagaaaaaaaacttgtaaaaagtgtgtgtgtgtgtgtgtgtgtattcaggttcgtctgttaggatgttctattccactatccaaatttctatgtggtgaatttacttataaccgttagtcattagagttacagctttggtaggtacaccactccaggaaatacctgacaaatgaatttgttccgacttatatctggggaatccttctactcgtgatttgatggtttaccacgcaacggttgggatgaaacgttgaaaggttttaccactaaatttcgagcctcgtcagtatcatggtttttaacaaatttctattgcttttccggccgaattttgaccaaatttactgtataatatttgaatttgtccgaaagcatttgaaattcctatcgaagccttgtcgaaacatcgaaaaaccgtgaaaaccgatcgcctttcgttggctttatgaaccctgcatgttggtacttcacatacaatactcctgtcatggtatgaaatctgcttccgtgcttgctgtgcacgaatattacatggatggttgaaagcagtgtttcttgttatccaactggcttcgcagcaatcgcattttctagacagtaacaactgtacactacaatattctaaacaatactgccgaacattttgtatctcgtcagtaaggtcaccgaatactctgcatatagcaccgaaagcttctgcgtccatgagtctcattaccaaaaactcctagtacacgcatcaatcactttcctgagaagagagtatccgcttcagagcacggggtaggctcagcacaatctccgcaaacgctgaatcggagagcgagaatacagatcaagataagttcagcacaaaatatcacctgctataacgattggggaaaagtaatatgcggaataggatgtaccttctggcaaactcaaggtcttcagcgcatcctcggcgtagggaaggcggaacggtactagttgagcagatgctgagcgactagctctgcgctcagttactgatattccccgcgaagagcgaagtggccaagccaggaccctggcctgacttggcagggtgaacaatagatctgagtatcggatactgactgtaaccttgctgctcaaggggaaaaaggggggaaattttcagtgtctggaagaggtataacgtgcagcctataaagcaaatggactggacatttggacaatgaagtcaaaatactccaaataatacaggcaactacgttgcatgcttacgttcagttatacattagtacgaacaagctaaaagaaaattagcaaagtataaattatccttaccactcaaaatcctccattacaaattctatcaaattgtaagagagactgtggaacagttctccaatttggttcccatatagttccttgataagccgaaccttgaaaatgaaataataaaaatattagaattgacaatttactgttaaagttatgtaatgtaaataactgagtagaccagcagagcacacttttttttgtcaaaataaataaataaatgcataatttttgttcaaagatggttcccagctggatgtccaaaaaatagtttgcattaatttgtacataagaattaaattcacatatctgtaaattacgtacggaagaagataaagagaagttcccacataagtagaatgaatgcaactagatagaagtaggataatttccaattttacgtgttcttcagtaaggcctagtttagttcccaactatttcttcaaacttccaacttttccatcacatcaaaactttcctacacatacaaactttcaacttttccgtcacatcgttccaatttcaatcaaacttccaattttggcgtgaactaagcacagcctaaactagctgcaatggtgcaaaggtccaaaaagctgctaaagctataccttagattttgcctatctaattttctggtaataaaagcatgttaaacattaaaagcagaacaagaaatattaaggttcactttgcaacatgtcctgtgttatgcatatttacaaactgaacaaatataaacatgaaccaagtaatctttcaagttgtcaattcagcaaaacgaacattcagaaaccacatttagttatgcttcacagagaaagatgaactgggcccacttttaaacatcagtatttttttaactccaactatgttattttagcacaatgcacaaggtcatctgcttttagcatttcatagtggaagatatgggaagtaataatatatctatatatctgacctgctccctcctgtcaacataagactgcaaaatctcttcaagatgatcaataaatttctgtaagaaaaagctccatgtaagtacaaagacgtgcaaataattggcatataaaaagcaagttcagttagaaaacatacaatagcattagatgatagaaattcactttctacttctcgtattggcagaaagaaaggtaaggtgtgctcaatcacagtcatcttttcaaggaatgacttgctttccaaaacacaatgataaatttcacaaggttctcctgcaaaataacatgtttatttagaacagcaaataatgtggttagagatatgacatatgctttatgtaccagttttccgtataactatatcagagtttccaaaatgccaaaacaaagagattaaaacagtttgatgcaaagtaaatgtgctctccagccttgtaaaacactaaatctgcatataacatggtacagttaaaaaaataaaaataaaaactgagaatgaaaaatgagttaccagcaaaataagtctcatactgtataccaattctcgcaccatccaaacaatagataacctatcaaagggaagaaatttagttttgatgtggcaggataaaaatcaaattaagaaaaatagaacagaataggtgtattgctgaaaaatagcatggcaagccttcattcatgtcatgaagataaatttcatctgaggaaacattaacataatgtggacctagtacctacataaattactttttattgattcctaaggactgcacggcaatacacgatctggtaaaaggcacctcaaatggtgtgtgattgctagaacttgtggtgatcacaagtgcggatgttttacctactctaagtgcagaacccggaatgaaaaatcatcacaaacacactcagcccagacgacattaatctaccactactaatctaactttacatagaaagcatttggaggaccaaatggtgaagtaacgcaacacaaagggcaatatagcatgaacaaatcactactctgagaataatgctacctgttttaccttgttttttactctatatgtagtccttgactggaattgaggatctgctggaacatttgcttggttagccatggccttcctatcagcctccatatggacctggtctacgagacaagcaaattcatacaaaactcaaaatgcaccaaacagataatacgtctcttgtcacaagagagatgagtacattaaggtgctctgattaagtaccttttcacggatggttgccagcaaaccatcgttccactgctcatcatctattgggatctctacaaaatgaaaaaacattgatgtagaaagtttaacaaaaaaagatggtttaaagcaggaggataaaaagatggcataagaggataaacaatggtttgaagcaggaggataaaagctaattaaaatgatgatactagtatgataagactaactgtgtgccatgatggttgtaaaaagaagtttgagaatataacagcatttccgggatccacaagaaaaaaaaaaaaagaaaagacctgtacactagcaataactaaagctcatatatttgattttttgttgtctcgagaaaattgataaataaggcattagtttgcaaagcaggtatacggagtgtgaaactatcaaatggggaaaaaaagcccaactaatgtaatcttcaatcagaagacgagcataaatatatcaccatgctgtgttatactgtgcatatagttatgacttgtagtattggcctatgaaagccatgtgaccaaactaaactatatatatatggggccatttggtctgtaatagtgctgtgccatgccaaaattttgtcacaaccaaaataagacataaccaaaactttgttagcacatgtgattggattgcaatcgtgagacaatttgatttgaagccatctagacatcaaaattctctttggcttgactatagttcgaggccatatgatacctaatgttttgcaatgtcccaacatagcaaaggtttatcttgtctcatagattttgtcagaaggaacatgatggtttaaatgggacacaaagtttgacaaccaaaccaataatgcattaattgcaaccaatcactcaaattacatgagcatgcagcagcagcagcagcagccctgggaattcctaggcagagccgctgaggatttgaccaaccaacaaaatacaagaacctgtgtctagaatcacttgaacattgccgagttttgaagaggtaccagattctggaagcaaactttagtggccaaatgttaagggcactacaaattttggaaggactaacataggtatagaaccaaacaggatttatgccctcaagaaaaat

SEQ ID NO: 82137 - DNA, 23788 bp, Oryza sativa
cctcgctttcacgcaaaaaatctggattggagttaatagccctaaggcatcttcaccttataacagctgctcctcagatattattctcgacgccacagtgtttttaggctactacagtgccacgagctgctacaactgctggtgggattgcttgctgctgtggactaggcctaagtcacaaaagttcttggatcgatggatccaggaactgaaacgtggaacgggggacgccattttccaaaatcatggaatgagaggggtatacctcttccaattttatggaactataggtgggacatgttcctaggttttttggaaggataatccaaaactctacggaactatagatggaacatgtttctaggttgttcggaatgataatccagaacggtataccctactagaggaatatgttcctatatttgttggaacaatagcatggaacgtggaaccctagtcaagaatattgttccaatcattttttttaacaagtaacttaactcaagtttatagcaaagtgtaatagaagttctcagaataaattattacaatgaaaaagtatataaaccaatatgctctagcagtggatgaaaggagaaagatcacaaattgagcttcatatatataaaattatagatgtgggtggttgctggcggcaagcatcatgatccacaacatcaccatgaaggtcttttctgcggtagcactcatatgatctttccatgttcatgtaaacacataacaatatatatgaacattattaccaaggtatgaaaaacaaataaataaacaatcagttaacttatgatttctgtgcatttccaaccacttagattgtggagtcttcgggatctatatccaacttggcgttaggccctcctttatagctttgagtatatcttgatagaagaggtaagtttgagtggattgacacaagcttatccgcgtttgtggcatttagattgtttctctttgcactatggatgtactgataagtggcccaaatcctctcagcggatgaaccactaataggttgcaagagaaccattttggcaacctctgtcaattctgatgtctcggatccatagctgctctaccactcaactagttccatcgtttctgcatccacctacacagattctagtgcaaaaaatcccttcttcataataaagtcattgagttgctcgcgaaggactttttcctcatctttattatctactattctctcaaatgcttttagcacacctgtcatggcctcaacatcttgattcggtgctctccttattgtgccaccgggagcaggtttttgaagataatcttgatcataaaaccttgggcaaacagcataagccaaacagtgaagttgaacactcatctttttccaacgttcaatgactatgttctctacctctggaagaaacttttgtatggattgtcatctttcattatgatatcctttatctctccaaccatacaatccattctctatagatctcacccatttttggacgttccccatcattgaaccttaatacttcatatatgtgctctgtgatagtaaaaatattctcaactttaacccaaaagtcctcaccactgatttcttgaacaatggcccttgcttggtgccgcagatcattggtgcaacctttccatcgattggtaactacggtggtggcaagtgcctctttacatttagtgagcctcagaagcaaaaggtagtgagaagcaaaatgagttttcaatcttccgctgggctgctagctaactttgctctttttttttctttttccctcttttctttctcttttctcttttaactctaattatttgtggggcgttacatacatccatactcaaagattcgacgtccccgccaaactcattctatacctaggcttcaaatttaaccaggaacttcccctattagtagcacgtatatacatacaattttcggtgcacatacgtcatgtcatacgaccacttagggatcatcctgtatgcctgcgtacatgttcaaatatacgtatagctgcaagggtcggctctaataccatctgtgacacccagggcgcgaaaacggtattgagtccatctcatccagttggaccacacctacaatatcaactctcttgcgttttcgtccccgctttcacgcaaaaaatctggattggagttaatagccctcaggcatctccaccttataagctgctgctccttagctattatactcggcgctatagtgttttcaggctgctacaatgtcacgagctgctactactgctgggctgcttgctgctgtgggctggactactagctagctttgctctcttttctttttatctctttcctttttgttttctctttttcccctaattatttgtggggtgttagcccctcacctcattggctaattttttgggtgggagaaaccctttgaaatccaaaaaaaaaacatcaagccacaacccaggacaaacatcaaggctgtggcataggtcgccaccaacctggcccaactagttcatagtatgtctatttcccttatctacccgggttgttgcttgtgcatagaaagaaatacaacattcagacaaaaaagaaagaaaaaaagaaacacctcgctaatatctcctatcactggcatgccacttgctaagttcaccatcaagcttgtggtcgccggatcgagtggcatcacctaatgaacaaatgaagaatggcagtcatgaggggaattcgtcagcaacgagtagggaggtgacggttggcagagatgcagccaatggtgtggcaggagggaagcgttggcccagtgcatcgatccatgttcccttgtccctccccagcgttgccgccatctcttggtgttggcgccaatgcggtcgtgggtttgtgccgctagcactagcggcctagcccgcttctaggttccaaccgtcccacttcaacaaatcgtggccgccctttgctaggactcttcctcgcttcctcatcgtcggcccatcgccctaggctccagcaccactcgtagaagcaccacggtagcaccagctgccggagtccatcgctactcatccacatccccacatgaccaactccaacatcatcatgacgctagcttcctggttgcttcgccaagcgtcatggtcgccatctcaccatctgcatcacttggctcgcgggctaaatgagttggctcgagacaggagatgagccatgccaggtttttagctcattaagaaaatgagctgagctgaaccagctcgttatcctaatgagctagctcaaaccgagctagctcaatatccagccctacccggcccacagtgcaccacaaggcaccattctctttaactgcccacaatacttgatttgaatcaggaaagacagaaatgaagacaacataattgcggtgcgtccacaacacccaagaaacaagtttgacaacattttaagagattgaacaccaccaaccagagaaactcccaacatcgagaggtggagcaagaaaaccgagttgaaggtattgaaggatgccatatgccttagaaatttgatgccttatattatgttcacctaagtttctcactagcatataagtggctttgaggatatgctatcaccaaatactatgagagtccatctgtctaaccaaccatgtggccaatgactaatatccataattgatgagaaaaaaatactttctttctaggaaaaaatccaaatactcccttaaactttggatggaagtccgtctagcaccctaaactttaaaaccggatatatctaaccccctaaactttgtaaaatcattcatttttttcttgacataaattactgccaggtattagcccaacaatatagcttttataaaaattggaaaatatttacatcttacaaggagaagcaggaacccacaaaataattacatagtttgtaaccaatcaaaaactaattgcttgagaggctccttcattctacacatatgtagaagaagttctttcctgaactgaactttccatccatgaaaagtcagaggaacattctgaaaaatcatgccatttctttgtttccaaatgtaccaggcagctataaagaagatctccagaaagcccttcataccaaagcgatttcttgctagaacaaccatctggaagaaatttaaattgagaaaccaatggaaacccaaaagctgccaacatcggaggctataaggacaagcaaagaagatgtgcagttttgtttctcttaaatccccatagcaaagaacacatgtgagatcatcattctccttagcacagtgcctgcgatccaacatgtcccttgtattaaatctatctaaagagaggagccaagcaaacactttgattttgatcacacactttgtcttccagatccaaacaagcagccttgagggttgtaggcatgagtaattcattttgtataatctttgagctgaatacttatcaatattccaaatataactccaatgatcaccaaacccctcatttaaatgaacactgtcaagatcagatttcaacactaaaaattccccataagcttcagtattaaaaggaagcatgaaagcatcttctaaaggccttgagcaagccatgccaacatattcctctttgttataagctgccaaaaaaagattaggaaacttatatcatttaagttccccattccacaggtccctccaaaagagcacataggttcctgtttgcactgtgcactgaacaatccctctgaaaacatcagcaagatagacaatatctttccaccaaaatgaacctttgttggcaattgagtggggaggctttgaggtgtaataagatttccatatgagatccacccaaggaagatcaacatttctgtagaacttgtctaagtgtttcaacaaaagagcaatgttctgtgttcttagatttatcacccctaggccacccttgtcctttggcctacacactagctcccaggaagctagagattttctggtggaagttgggtcatttcctctccacaaacaatcctttcttgttgtatcaatggccttaatgatagttaaaggcaatttaagagaacacatatagcatgtggggactgcaaaaagaacatagttgataggtgtcagcctaccaccctggggtaagaatgctgagctagctgttagccttctctccactctgtccactaaaggagcaaagtcaatcttcatgacaacaagggggcctctcaagggtagtaagatcaacacgtggaactctaagattaccacccaagtgaacaatgtggccttgtcggaggaaacggtgagggttggggttgacattagccatctccggcggtgaagaagagctctgtagattggaaacttgaggaagaacagctttggtaggtgaagagataatgggagaaactcttgcagtagtattaggaacctttttagctctccaaacaaaattactccgattatacagattattcggaatagataaatcttctttcttttgggcctttaaagggcatggcagaaacgagccaagtgactaagaagacagcaagcctgatagcacaaaggcccaggacagttagctttcaaatggcccacccccaaacaccggccacaattcaaatcagaatttaaacccagcgcggaattaccccctaaggtggttttggatggtggtttttcatattttaaaaccttaaacgaacaactttaaataactaatataacatatttgcatatcatcagttgtaagtcatcaatctatacatatcaccgtactattattatgttggtacttgtttgtaagtgagagctaacaactggtaaaaagaaagatttaagtggagattttaatatatatgtccaatgtgtatgtcaagtgatcaaactcatccaatttgtatacgaatgagataaaaaccactatagagggtaatatgaacggttttgcaaagtttatgggggttggatgtccggttttaaagtttagggtgctaggcggacatctatctaaagtttagggggatatttagactttttccttctttctatatgtagagtatgttttcttcttgtggggatcttgcattgctaaaatagaaacatctttttcactcttttcttgtttttctaaagagtaaattgcacattaggtaacctattttttacatcttctgcagattaagctaggattcaacctagacttttatcttacttagctttgccaatggtttcactttggtctatgtccctctcctcatggctatgctgctcctcttcattctatcttctccatagaaccaattggccaaacacgatggccacggaagattttttctttgtagaggccgaatctcgaatgcacgagacactgccacactagtgatcaatcctcgacccagccatcgccgtcagcctgcccacacgacacaagggtcgtagcattgctcgtcaccacatggatatcatgtttggactcgaagccactcgttttgctagattgcacttcatacgagacgccgtcatgctcgagcagctctaggatgcagataaaggtgagattgggcttcctatcgaagatcctatatcatttctagcctttcctccccttcagattgactgatcgagccactcaagttggggatgatcattgtcatctgctgttcatcccctatgagcataatactttcttcttttactagctccttccaaatctagccgaaggtgaacagtgtttgaacgtaagtgccattccgagtggcacggccacacgagccgtgcttgagctgggcggcaatggctcatctcaacaatgaagaaaaatgggagaggagagatgaagaagaaatctggtttaatgtgagatcaaagagaaaagattgatacacgctaatacaaatatggaaaacttgtaaaaaggagtggtccatagtgcatttcactctttttctaaatttgcagatgactctaaccaaagaagatgagaacttgaagagttattgctgcgggctaaattattattttctttatgtaccctcctgtgtcaaatggtcgatgggggatgctgattacatgctactatgtgttgccaaatttattttcttgcaatgacagcttgtcatcatattattagtattatctgcatcacctgttagtttacttgcttggtcaaaagctggaagtgcttcagcattatcaaatttagaccgcatgcctttccatgtgagctaagcgactatataatattttgaaaagtaaattgcggtaatggaaatagtttgacaaattggagcgatctagagcctcctactgcaacaacttgactcaaggcgtactttgttcaaataggtcggtcgtaacacattttttttgtttttacattagcaagccacactactatgttatcgatttttgtggactaggccccctataggttgtagacagaccataaatgtcccgcatgcaaaaattgctccccattgtattggttcaaggctacctgcgaaaatgcattattgcaggcagccacttaaagaggcctgcctgcaaaaatagatttattttcacaggcagacctctttagcgactacatgcaataatgcaatttcgcaggcgagtctcttaaatacccgattcaagtctaatttccccctccctatcaacatcttcaatttttttcaagccaccttctctgtctcaccttctcgcatcctcatccttatcttctcacctccggctggcggtgatgggctttttcaggaatggcgccggcggcgactacggcaagagtgacgacgacacactcacaatggtggagggaggcggtggcggtcaatccgtcaccgctgtcctcaggagggacggatccgacgccctagggaaaggaattagtgacgacaactgcaggcggcgagggtggtgccgtccttggccccatgaggggcgcgatgacggacagcggatccagcgccgccgccctcgggaggggcggatccgcctccccggccccagtcctcgttgactactacggcgacaacgtcgacagtagcggactatggtgagcaccacgatggcggtggtgccggccacggcaacgttagggtttcaatcggcggcatgctagggtttcggcggatttggtgttttggaatttttatttttttcgctgaaatttttttcgcgtgcggtcggtattggtgaccgcatgcaaaaatgcggttgtgctgaccacacgggtagactccaggatgcggaccgtctagccgcttgtgaaaatcgattctgactgcctgcgaaaatcgattttgtagtagtgccatatgtcttaagatcatgtcactaggctgctaagagcccatatgactttgaaaaaagaaaaatttttgtttgcctcgcatcaataatcaaaagggagctaagaaagtaagaaaatatgaacctcaatttgaaaaagaattcaattgcaaaatgatcgaaagaattcttgatagaaagttgctagacaaaatatcagacatgagaaaagcagttttagcataagaacacaaggtttgtactaattaacaaacaaatcaacagaaccaaggaaataccttagataatagaaaccatgcaacttctgaaacttaagtttatatgaagatgcaaatggcgctggcagcgatagtccgagctaacatacatatacacatacaggggcggatccaggccttggacagctatggctcaaaccctaggcctgagatccattcatataaatttcagaaaagtgtatgaatttgtagagaatttgggtaagaaaatagagttgaaccctataggtgtggctccattcatataaacttctagcaggctccaccactgtatacatagttacatacatacaagagaatttctcgaaacaaacttgaattggtttaatcaaaactttcctggtttcatgtccgaccttagaaaaggaatgccaagaataaccagtaggatcctgacatgtgtgacgaactcgccaccagtgctgagatgcttggcatggaactgagccccacagtttggtccaaggtagcacagcatctcaatccacaccatggagatgagctcccaacgctgagctccgttgcttatcttgagaaggtgatcggtgatcacacggccacgactaaagcatggctcagtcaccccgggtgactgccgcacataccgcaagagtgtcttctcatcatggacggtggaagctcgaatgatgcgcttcagcaggcggcgtgccttaccaagccgaaaatgcccattggtgccactcatcacgtcacgcttcacgacgaggtacattacatatctcgacagctccatgctcggaaccctgcacggggagcgatcatccttgtcggcgaaccagcacatctccgtcgcgatgtgccaaacaatgacggtcattggaaaatacaagacggtatcgatgatgccatcggttagtatcccttgagcaatgtcatcttggattctcccctcctgcagccaccactgcaaccacatgccactgtacttgctggaatcccagtcccagtagtcacttacactacgggtggtggcaacctcagtcaatttgtccaatacgagctttttcagttcaggagagaccgtcttactcatgtcgatgtcaggcatgatacccgtcttcctcactacccatccgcatattatgctgccacgttcttcttggatgcatgcgtcgatcaggttatactgcggtatcttctccgaccagaggggtttgctccatggattaacaaatctgacaaggctgaaaacacagccaaacaagccacctgtttggtgtaactgcaaccaatatgatgagatgagcttgaagatggaggatatgtccagggtgacagcaccaactagcagtacataggacaccattgcatcttctcttctgtagttgaatggcccctttagatcggtccctacaaacaaccttagggctaccgaggttgagcaaaacgtaatcagccgggcgattacgctgtagacaaggccaaggcggaactgaagcgccccatacttagtgtacatgtagtcatagatcagtgagagttggatctcaaccagcttataagccatctccacctgtgtgtcgggatctgaactacgaagcttctcgacggttctctcaatgatagtgtcttctttagacgaccataccaggaaaggggtcatgtcagtcagaaaacctaggcatatccgaaggccctcgccggcagccatcaccaggccctggtaagcttcatcagcttctcttattcttccatcacggacatctagatcctgcacttccttccccgggaaaatattatgcagctctcggaaataggacttggcatcgatgataacatcatcttgtacatccatcacatgatctgccacagaatcacctcctggctccatcgccctgctagctgccatgagaaccaatattctctcgacatacttgattgttccagagatgaacatcagcaccaatggcgccaagagctgcttgtccgggtgccatgacttgaccatgatgtagatcgctagggccacttgggtgacgagaccgaggaggtgacgcttccacagcattgcatcctcaatggagaaggcagagatcgtctcctggctaccaaggtgcagcagcaggagaggcgtccagaggagcacgagctgatgatggtgtggatcgccaacgtagagcgccagacgccctagtgtgaaggtcgcaatgtagtcggctgacaagtaggccagccagagaagaaagcttagaacacgggaggtgttagccttgcgagtgcttgagaacaagtggaggaagacttgcaagctgaagctcgctagtaccaggcactggatctcccactcgttccagagttgcagggcacgtgccagtgagctgatcaaagggccaaagatctacattagtttctttgtttagaaactgtacaactgcattaatagaaattccaaatattttcgtgcaattttttttgtctctctaagtatctttatgtccattgaagtatggatcagtctttttatgttccaatctattcaagcagttgttgacaactccaaaaatattctagggcataaggtgtgacacctacccatcatactccctccgtctcaaattatagagcgccttttttttaagaaaaatcaaactcggtagcttttgactaataatcatactagctatatgtatacttagtattatgcatgttatatcactagattcatattttgaagtactttcatatgatgctataatttcatatttgttgggatcatagaatgaaataaaatactagtcaaagtatgttattgaagaccgtgtaaaaaaatatagtccttataatttgggacagagggagtaacacttgtttagtttagttagattttgatcttaaagacttatgcccgttcaaatcttctgaatatgaagattaaaagcgggcacgcaaaagagaaagtcattaacgtgtgattaattgagttttatttattagaaacgtgaaaaatggatatatttgatactttaaaggaactttcatataaaacgttttcattttgtggtttgaaaagcatactaacgaaaaccgaggtaaaatctttatctttacgagaaaaaaagtgctcctcactagtatattttctaatttctaattttacgttcacaataatatatgtctttatagatggagggagtaacaatgtactagtactaagaaagatggaatatcacctcatgccgctcatgactgcaaccagagcgctgctacaacttgtcagccgctattgcggtctctgcgagaggaacgaccaggaggagctagccggtaggaccagtagaatgttgctgtctttgcttctcagctgtagttatcaggacgtacatttaattcacaattcacctgcgaatttttttttaaaaaaaaatcgactaacctccaacgtcgtccatggtcgaaattatgcaaagactccgaggcagattacagcaagaatggaggattagggaattggagaatgcgagattatacccagaggaatgggattagctaggatgaaagattagtgccaattgatggatcttccgattacatataccagtgctactgcgtagtagcatcttccttccctcctgctcacgccttaacaacctccgatccttttgtccggctcacgccatactacaaagctaatcaaaaaggtcattctggatcagagaactctattactgccaccaaagtacgccataagtacactcaagcttgattctctggaaaatcagttccttctgacagactgtcaccaggtactgtgcttatactcttgggctgcaggaccgtgatcgatcaatatcttgtcaacgaatgcctggtactctctccatcccaaaataaaccaacatcctaatcctaatataaaccaacatcgtacggcatgtgacacatcctagtatggtgaatctggtactaggatgtgtcacatccagtacgaccgtacgagaggttggtttattttgagacggagagagtagatatgcaacattcgtcctgataagggcatgttcaacggttgagcttgatttgagctcttaattagtacgcatcatcaaacagctatccacaaatatgttaacaactcaaaacacacacttatctattccctaattaactttttttactactatgcaggactatatggccatcatcttttcgcttatgtttatacttatcgactaaaatttgaattttcaaccttaaatgtagagctgattttaaggttttttcatcgaagtttatttttcagcctttgcttttagatcattaaggacacgtatataaaagttttattcacaaattacttttcgtttgtaaatatgtcgtttcgcttattccacgaataagccaaacgatggctctgtgtatgttttctctcgcatttcgtgccaagagtcaatgttttggcatacgatcgactcttgtctcttccctccctctatttggagaagtagagggattagttaaatataaaaaggcgaagaacagtgagccatgctccattcagtcatatttctttgttaatctacagaatcaggaaaatcgaatacagtttgcaggtatgaggtttgcatatctgtttcaacatcctccaaactctaaatagatcaaccatgagaagttaaacatagcactacacagagagagagagagagagactcctagatgatacagaatacaaattaatttccataactcgaaaaattatctatagatataactaaaattttgcagtgaaaattttctactgccagagtaatcattcgtaccttctaagacgtatcagacaggaggaaagcagctttagcataaggaacacaagatttgaacttacaacaaacaacaaatcaacagaaccaagtaaatactttagataatagaaaatcaggcattttctgaaacttaggtttatgcaaagatacatacgactggaacaaacagcccaagctaacataaatacatagtgacacacatacaaaggggttttctcgaaacaaagctgcaggcgcaatcattagtttctttctcagaatttccctggtttcatgtcagacctgagaaaaggaatgccaagaacaaccagtaggatcctgacatgcgtgacaaactcaccaccagtgctcaaatgcttggcatggaactgagccccgcaattgggtccaagatagcacaacatctcgatccacagcatggagattagctcccagcgcagagctctgttgcttattttgagaaggtgctcagagattgcccggccacgaccgaagcatggttcggtcacctggccggttgcctgtcgtgcatacttcaggagccccctctcatcactgataccccgtccttcaaggatgcgcttcacctggcggcgtgccttgccaagctcaaagtgtccattgctgccactcatcacatcccgttttgcaacgaggtacatgacataccttgacagctccatgctcggggccctgcatggggaatagtcatcctcgtcggcgaaccagcacatctccgtcgcgatgtgccaaacaatgactgtcattggaaaatacaagtcagtgtcggttatgccatcagttagtattccttgagctatgtcagcttggattctcccctcctgcagccaccactgcaaccacatgccacggtacttgctgaaatcccagtcccagtaatcacttacactccgggtgcttgctacctcgaacagtttgtccagtaccaatttcttcagttcaggagagactgtattactcatattgatgtcagacacaatgcctgtcctcctcatcacccaaccgcatattatgccaccacgttcttcttggatgcatgcatcaatcaagttatactgcgctatcttctctgaccacagtggtttgctccctgcatgaacacacttggcaagactgaaagaacagccaaacaagccacctctccggtgtaactgcagccaatatgacgagataagcatgaagatggaggatatgtccagtgtgattgcaccggctagcagaacgtaggacaccatgacatcttctctgctgtagttgaatggccccttgagattggcacccacaaacaagcctagggctgccaaagttgagaaaaatgtaatgagccgctcgattccgctgctgacaaggccaaggcggaactgaagtgccccatacttggtgtataagtaatcatagataagtgagagctggatctccaccagtttataagccatctgcacttgtgtttcaggatttgaagtacggagcttcttaatggcactatcaattatagtgtctgtgttagaccataccaggaaaggggtcatgtctgtcagaaaatcaaggcataaccggaagcccttgccagcagccatcaccagaccctcatagccatcgtcatctgttcttcttcctccattgtgaccttcaatgtccagcacattcttcccagggaaaatactatgcaactcatcaaaataggatttagcgtctaagataacatcgtcttgtacccccagcacatgatctgccatggaatcgctccctggcgacattgagctgctggcagtcataagtgcccatgttctctccgcatacttgattgttccagaaatgaacataagcaccaagggccccaaaagttgcttgtccggacgccatgactttgctacgatataaattgccagggccacctgggagacgaggccaaggaggtgacgcttccacagcattgcatcctcaatggagaaggccgaaattgtctcttggctaccaagatgcagcagcaggagcggtgtccagaagagcacaagctgatggcgtggatcatcaacgtggagcgtcaggcgacccagcgtgaatgttgcaacgtagtcggctaacaagtatgccagccaaagcagcgagcttaataaccgggaggtgttacccttgcgaatgctagagaagaagtgaaggaacacttgcaagctaaagctcgcaagcacaaggcactggatctcccactcattccagaactgctgggcattcgccactaaactggatcaaaggaccaaaaatcccatgttagttgtcaatcaaactactccctcatttcctaaatgtttgatgccgttgacttttttaaacatgtttgatcgtttgtcttattcaaaaaaatttgtgaaatgtgtaaaactatatgtataaataaaaatatttaacaataaatcaaatgataggaaaaaaattaataattacttaaattttttgaataagatgaatggtcaaatattttttaaaaagtcaacggtgtcaaacattttgggatggagggagtagttatcaagccatgcaactacctggagaataattccaaaaacgttttatgaaaaatttgaatgcatttttacagtttgaacttcatatcagtttttagatgttcctgttgagattcccccctccccccaccccccaaaaaaaaaaaatccctgctaagattgaaccataaaatcttccctcttagagattactgagtttcctcacacaaactgtttcaacaaacacaccaaaacataagcttttaacacccacatattcgtgtgtgatatttatgcgatacaatgccttctacacaagagtccatacaagtctattgatagcaggggtaacgggttaacacttattaacactatcggtatcgtaaaaaatttcggcggtcacccgaaatttcaaaattctacagaagtttcgaacaaaatttacaaacgcattttggaatcggaagaaatttctgcagcagtcctgcgacttcattgagcagcaaagggggaaggtacctggaatcctacagccggatcgggaagagccgcagccgcgagaggggttggcgagtcgcgagcgccgccgcggccatacgccgggaggagtgggctgccgctgccgccgtgcagtgcagggaagctcgggcgaaccatcgaggggatttttttttttttagaactcctttcgaggggattgaccgattgaaatgggatgttaggaagaacagagtttttctccttttttttattaagaccaatttgaccgaaattttcacctggatgtgactgactaccaggcccactgatatatgcaaagataaaaattctctgattaactttatattctaattatccctcgatggctcgaaggctatttaaaatatatgattggaacaaatgtagaaatttggcaaatcatatgagaggaacaaatgtagaattttgacataaatgtgacaaaatttagggttaggaatttgatgagagataaaggcttgtatgagttttttttaatcaggttgaacgtcatatttggttcccttcaaaactcatatggattaaggtattcctttgtattccacctttattaaaaaaaacatttaaaaaagaaatctggtaggactaaaatctaaaaattctgaccccaaagtatgaaacaggtgatgattttgtaggtggttttggtcacttggactacagtgagaataataacacgacaatgaatttggcttgtcctttggttggaggaattgtgtcctattatagggaaaaaaatatagtcatttaaaacaaaagattgattcttacaaattccattgtctataggttttttggaagagaataaacatgaggttactacgtttttccttgtatatcattcatatgataatttataacttacctattttttaagttcttaatagaaatctattaacttattaaaggaatagaaaaatgagcctccacgttcgttctcacggcttagaaattcccacattaatcggagaaaaagaaaaacatagtccatatagaaatacaatttaaaaatagtggaaattcggaagtaaaaaaataagaaatattggaagaggagactagagtccatatagaaatacaatttagaaatagttgaaattcggaattaaaaataagcaatattggaagaggagactggagtccatatagaaatacaatttataaataactgaaattcggaattaaaaaataaagaatattaaaagaagatcatagagtccatatagaaatacaattaataaataatagaaattcagaattaaaaataaggaatattagaagtagagtatagagtccatataaaaatacaattaagaaataatagaaatttggattaaaaataaggaatattaaaagtagagtatagagtccatataggaatttaaaactaactaaaatttgaattaaacataataaaattaaaagtagagtttagagtccgtataaaaatataatttacaaataactaaaattcagaatttaaacaaaacgtgagaagaacagtctaaagtcaatataggaatacaatttagaagtaactgaaatttgaaattaaaacttaaaaatattaaaagatgagtttagagtccacatagaaatacaattagaagtaatacaaatttcaaaattagaaataaataatattagaagaagagactagagtctatatggaaatacaatttacagataacgaaaattcagaattaaaaatatattgaaagatgactctagagttcatataagaatataatttacaaataactaaaagttgatattaaaaataattaataactaacacaaatataaaatacaatatgaatattacacattagtagttcgtaaaattagtacaaaatttaaaattatattatcattttaatataattgaataatacattaaggaaacatatatgctattgtacgagagaaaatataatgatgctagccgcgcaatctgcgcggaccaccgtgctagtttaatgaacatgatattccactcatacgttttttatttgtttcagtattttcacattttctaaaaagaacaagtaagatgctctcggaaccaaagcacatcaatgtcaacatgtaattccgggttcattgattagagagaaacaaagatgctagattggtttcagtaaaatacatcaacgagttgctcccgcaagcaataccactctatgtgttatttgaaccaatttctgcaaattaggaggtagaatacttgattatgattaaggggattaagtagaacaatctgatattggtggtgtttaaatcccctgaagatgaagatgaagataaacataaatattaagtgtttcacgtaaaacgaggtggtaataacgggtgattaattgattttaaattattacaaacttgaaaaatggattaatcttataatttagaataattttcatatagaaagtttccgcacgaaacgcaccgtttagcagttcgaaaagcgtgccacttctatccaaaagtttatccagttttggttggagaaaagaacaaggcaaacccagattagaaaacatttttttttcaaggaacatctcattttagctggtccctaataaaacacatgttaaagagttaaagtaatagagattttcctatccaaaattaatctcgatatgtaatatgagggggagctatccgatctttttcaaaatatcatatggtaaaatgttttagctgaccgcaagtgcaatattaagttatatatagtgaaacaaaacaatcagcctctgagacattcaaaaattttgtgaaacacggtaattcacatgttgaaacatattgctttcacgtatgaaaaattaagttatcactgtttgaaacatatgttttctttatcagaatataatcatgtgatatcttgttgtaaagatttgattattaggaattcaacggtgtaatcgaatcattgatcggataagtagtttaggagaaaatttattttaaagatcactaaatacataaatacatacatgtatgcatccatggaatacagagagagccactagaatggcatgagagagtagatgcatgaacatctgatactttgtcggatggcatgagagagtagatgcatgaacatctgatactttgtcggttactagtgaaacattaaacaaaaaattcagttattaaaatattttttaaaacacacataaaacatatcgctaccatgtctaaaacgttgcattttaacggtttgaaacatatgttttttctttctttggaatataataacttgatatcttgttgcaaagatttaattataataaatataatgatgtgatcggagcatagattgaaaaattagtttagaagaaaaatattttgaaaattattatatgcatgcatggatgggtatccacatgcataggtggagtggataggaagctacaaaggctgttaatccggagttttggcccgtgcgtggacggcagatgcaaagtattttctgtaatatgagtcaattaggaatggtgagataactaattcttcttgaccaagagctgttcgatgaaattaattagctaataatttgctgggtcaatatattcttcttcatccaaaaggaaataattttaggcatatgacagattatgaccgtgagagctagcaattgcaatttatgtaagaaaacatattttccatatcccattttgtatggatataatatatcagtaatatggataaatcatatatgtggcaggcatctagtacactacgaaagctgcaaaagatctgtttgaagagcttttagcccgctagtggcctgcagattccgctagaatctcaaactctctcaaacagatccatctattgtccataaaaaggtaacgatggtcacagcaatgcatcatctacttccattgtaaattttgcgagctactctttgaacttcttaatattaaaaaagatcaaaactaaatgaatagcaataaaaaatagatttaaatacattttcgtttatccgtagcaaagcacagccatttagcaactatgctaagaatatatagtcatgtaatcaagaaaataaactaaaagacaaaagctaagaaatatagctttttctgtttctcaaattttggctaatagtcagctgcttctccaaatcttgcttcataaatagaactaaaaccacattaaaaataagaaataatgctacaagaccaaaccaaacccaaccaaagcaacattaaggcagggtgctagatacaacctaccaacgaaagctacattgcagggtgctacatacaagctgcagaaggatggttacttaccccatggctgatggctcaatggccgcaaactacagaatctttccgtttctctggtaggggagagaggttagaggaggagctccatggccgccagccgggggatctgggatcgctgtgtgtaagggtaagtcgtcgtgcaagtcgcgatgcctgtcttcatgtgcatttaattaacctcaaaccccacgggccagggggaaaaaacaaagacgtcaaggcctcatcagtcatcagtcgcgattaatatgttttcaaggacaaaagcatttttgcaagtggccaaaagcaatttttgtaagcggaggagaggaccgccaacaaaccaacgaccgtgaaaatcatccatttttgcaggcggggcaatggcccgcctgcgaaaatccaataaaaaaaatcgccttgctgccactgccctcccgcggcctccctccggccggatctgggaggggagtggaggggaggggagccgcccacgtcgttgccgccgccgacgccctcccctgtccaccctccgaccggatctgggagaggaggtacttgtcacgcccagaaattcccgaatggaatcccaagcagaatgtgcattaaaatccccgtccaggaccagccggggtacacaaacgacaatgttgacatacagatccacgtcttacaaacatcataaagtcttacataaatgcagcggaaaacaaagaaactgaagctaagccttgactaagctgcagcgggaacaccaccccacaggcatcctcgacggcacggacgaagcctactcctcagagaaaccttcatctgacccgaactcgaactctggaggttgggaaaagtagagcaaggctgagtactacccactgtactcagcaagtcatactggaatggagggtatgatgcatggattcaacaagggatagctaaacaggttcatttgcataaatactggcatttataaacaagaatttgaatgcgaaaacagttgtaataatttagcagtattaatcatccactgttcaacgctacaccacgttgcaacaggcccaaccatccacctatgctatacaaattaaaggattatactaaggtgagactaatcacggtgaatctggttgaccgcccataaccgcgagcacggctattcgaatagttttactctgaccagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccggagcggtggtattaaaccaacattatcacctatagtctaggttttaaatgagattccccaatgtgtgctagttgaactaagcatggctaagcaaaccctagtcctaactctaatcaggttataacccaagctaacaaaggagcatgatatccaaaagcatggctataacaataggtaaccatcccatagtaatattataaaacaatgcaatatttgaaaggaaacaatagagcatttgcaatataggatcaacatgttcaagtgacaagcatgacttgccttgctctgctgctggagggacctcggcgactatctcgaagtacaccggagcgtcggcgggatcggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaatgaattattgcgcaatatcaaccagggctgacgtcagcgcggggcggcgcggcgccgacatgcggggcccaccggtcagcgacacgggggagagagaggaggggcggccacgccacgtggcggccgatccgacggcccggatcgccctcgggccgatcggacggacggcggcggcggcagccctcgggctcgggtcggcgtcaaaaccgaccggccgacccggggctagcgacggcggcgcgcgcgcgtcgcggcgccggcgacggcatccggcggtggaggcgacgcggaggcggcggcagcggacggcggcaacgacccaaagcgacggcgagcgcgggcggcggccacgcacgggaaacggggaaggagaggagaggagatgcctcaccgagggtggccggcgcgcgggaagacgatggcggacggcgacggcgaaccacgggagaacggcggcggctagcggacgagctccggcgtgccctaaggacgaaaaagagagggattagagagagggagatagaccacggcgaccggaatccatggccgaggcggcggcaaaggcggcgctcacccgtgcgcgtggggagagggctccggcgacgaacctcgacggaggaggggcggacgaggtggatctcggccgcgcgaagctaacggcggcgacggcgcgggacggcggcgagcctagcggcggctagcggcggccggagtagcaaaagcggcggcggcgggtggttgcacggcgcggaggcgatggagagctcgggagagtgcggcgaaatggggaaaaagagagagaggagaacggcgatgcttaaaaagggggagagggagccggacgtggccgggagcggcgggattcgccggccgacgtgggggagtggggaggagagagaggc

SEQ ID NO: 82138 - DNA, 51923 bp, Oryza sativa
  unsure (1)..(51923): unsure at all n locations
agattcagaactgattttcccacttcattatcaaagtaaccatgaaatgctacacggtaacacctctgttcatctgcataataagtctccacatctgtgccgcttgagcaaactttcaagaaaccttccttcctggcttgtccaattccccactcacgcaacacatcatgaacttttattttctttatccacccaatgtttttacttctttcttcaatttggatcatacatctctgtgccagctcttctacatatctgtaggcaacttcttcttgtgtatatcctcttatatttgggacaaatccctcagcaatccacatctttttaagaacatgaactgtgatagggtagtcctcgggaaaggatgcagtataaaggaagcaagctttaaggttatttgacatattgtgataacttagagctaatatacgtccaacatcgccctcctttttcatgatttcccagtctacactagcaaccattttctcccatgtatgaatattgtggtttcgtgaaaggaagcaacctaaaaccactagagcaagtggcaagccattgcatttcttggagagttttttccccaccacctcaagttctgtgaattgcacatcatgtggaaatgccttcttctggaaaagttcccagctcttgtcttcgtctaataggtcaggggtatgaatttgcactttagttttaggatgttgtccaacttccatatcacgggtagtcagaattattctacttccatttcctttgtcaggaaatactgatttgatcttgtcccaggtatctgttgtccagatgtcatccaaaacaataaggtagcgctcttccttcagaaaatcaaaaataagttttgaaacctctgtctcaccatagaaatttaaatgcatgctctttcgctcgcttatcttcccagtgccccttatctgtcgcacgagatctcttaatacttcaagggcagaatattttggagaaatggatacccaaccatatttgtgaaaataaccttcagttatgactgaactataagctagttttgcaagtgtggacttcccagcccctgcctgaccaacaatcgatataacagttagattcatgttattttggtcaagcaagtaactcttaatttgtgcaatttcatgatcgaatccaactatatccattccttgatccaaacccggcggcacaagcctttgtgcatagaaatcctcatcctccctaaaaatgggctgtgcttccgttgaagtgctagaattaactgcgttgtatctgttgtaccgctcaaaaatctcactaatttcctttcttataacttgtatgtttttgccaacctcacggaggtcaatggaatcaccaaagatgtgagtatattttgatacagaagtctttctcctcctaaaaatgaaatgagcattgtcaataacctcttccacccggtatgccacgtcttgaatattactggccagatttttcatcatgctgtttccttccaaacatttggcatccacaacatttaagaagcattgcatctggctcagttctgctttcatggatgatacttgtcgaggaacatcacttaaaaaggtagcttcttggatgacaaggtcaccaagcctctgcaaaactgaggaaactactgatgctgtcatgcttagttagctgaatgaatccaccatgaatttagatggagaaagttgcatagccagtaaatatcatcctgttctgtccttattgtttaatagtacttgatgagatccccttatgttattgacatccattaatgagagggcaatagatatcttccctagggcaaagtcaaataacaatctcagttaaatctatggagagaattttagaaagaagttgctgctctgctcaatggagataaataactttccagcagaattttttttttcttcgaatgtgggcatggaaaatcatgaaggagacaaacagcgtggcgaagagtggtggtacaaagtaagagaaaaagcttacggaatacagatatggtcaagcagaaaaggaacacagaaaatatccccttcagtattattgacgaaattatactatacacccttcatcaatagttgaatcttgctggattacttcttttctcgttcagaccaggtcgttaacaaccattattaccctctagattcaagaaaatttagagcataatcctaccaagaaaatagttgctgaaacttaaacatcgaaacagcacatcattggtagagtgaagaaactgaatctttaaaatagagagcagaaattaccatatccatggttgagcgagaggggattgcggctgggggaagagacattggaccgatttggagagaggaactgaaaagccccaaattgacttcgttctggagctgggctacagtcgtcgactttcaagcatcagtacaggaaggataaaaagtgccgaacatggagacagataagcagtagtggtggggctacgaacatattccttttccttctggacgctaccactcatatgttccaaaattacaaatttgtcctttgtatttgttgcaattttcatgtaagaaatccaacgaggctctgtttttttttattggccttgtttggatcctcagagctattaaatagccctgtagaatcttactatttaggagtattaaacgtagattaccgacaaaaccgattccataaccctaggctattttgcaagacaaatctaatgatgtatattaatccatgattagcgactgattactgtagcatcactgtagcaaatcatggattaatatacctcgttagattcgtctcgtaaaatagcctatgggttttgtcattaatctacgtttaatacttctaaatagcaagattccggagggctatttaatagccctccggatccaaacagagccattgatcatgtcgacggaactctaacttctcaatttaacttactttacactttctatcactttctattttcttggtgtcctaagaaaaccctacatctttctgggtatatcataatacaagtggattttctttttccttttttggcaacgctacccctgtaaactcagcatagccatgctgcatttgtgcatgttggtatatacaccatcatccatgtcagagtactgtattgcaaaacacatctattatctatctattataatactacaagtccattaaatttcctacaaacacttctaagctgccacttggcgctctaataaattagagaaatcaaagaaattctaaggaaaaagcatatattctaacactttgcatgctaccaacaatcgtgaaatattatagaacaatttaatatgttgattatgctaccatacatttattccatcctaaaatataaacatatttagaaaagtgctaagtcaaacattttaactttaattatttatagtgaaaataaataaaagatcaatcatataaaaatgatattaaatacaatgtcactcttctatctagaacaatttattttttataaatataaatattattagtcaaagtagtatcctaaagaccgttccaaaataaaacaaacgtatatttttaggacagaatgtggagtgatctataaacatacgtatctaacaaatagatttaaaaataagcaaagacgctaaagaataattttgaaaaagtgtaatacattcggtttttaatggatggcgtcgttgaattttgtacgcacatttgaccatttagttatatttaaaaggtaataataattatttattttgtttttttagaataattatttattttgtcgtggcttagtttatcattaaaaaacatgcctgcacgaatgcgcaggctactttcttgattataatggggaaacaagttaactaatccaacccaccgactaggatccaccaagcactacagacaacttacgttaagtatggattgatgatttggcaaggcccctttttttttttgctctggttcataaaagctgagagtttgaatttgaaccttagaaaattgtgacttagcaaatttatctttctgtcattggctccctacttaatcatctctcagttttgacttaaaattactgttgctgttgcaatttgttttcagtatgacgtaaatattatgattcattttgaaaatgatgagaatagcatgagtttgtttgtgctagaaaacttttcgtctatatcaaatttctcttgttttcgttgccttatactacgtatgccctggcaatctggtatcatgcattgatctaccaagccagcagcctgccagtgccaggttcgtatgaggaccctaagtaaagccctatgccccaatgggtgttttgaaaaagaacactattgttttgttcgttggtgcatttgatctatttcgtttcgctgatccaatgctttgccaaatattaccttgacattcttaacttgttatggaaacatttatgacaactcagaaacttcttacaatttcaaacattacgatcctttgtactcaactaatttaacttttgcatgctttcagtaggtcgtgttaagaactgtaagaagctcttgtaagaatctgatatcattttgttaatgaaatgggagaggaatccctctctttctcgaaaaaaaaataaatttttcactagcagattttcgcgataatagttatacattagttttgacggaattagcaacatgttggcgaagacgatctatgattctcgaatactgtgatgaagtccctagttaaacggataggtgtattattttgtcttgcaaagctgtaagaagttatcatcactttctacaaagtctatttgtattttcttgtgtgtcaggcgcaaaataaatttactagttctctcaacgattatcccagtattgcctctctagcatggtattgttgtagcattacctatgaaaaatgtagtacagcatcagtagggtcattgttcaccggcgttagaaagttaccaattcagcgcctattggattgaattctgggcttctaacttggctacaatggatcgattttctatgcaccaatagtgccaattcagaaccatgggttatgtttatacctggccaaaatgttgttggcgttcttctaaagtatgaaaggtataatccccaacagagcttatatatatatgtcatgacagatggtgctctgcaatgggtaatcattggatagaccatttgtcatccaatgatccaaacaccgatgttcggtgggggtgaggatcgtctaccataacgtcactaccatcatagtaactagtatgcgggttccaacttcctattgctccacacgtcagtgcctgtaatggtagtgctattatagcagaggatgtgaacccagtgcaaagatattattaaagtttaattttgttatctcgtccttctttagcatcgcaggaaatgtggctacttgaagaaatttgtcttcgaagaaataattgggctgtttggttctgaaattctgaaccactcatggtatgaagaatcaagaaaattcacatgatattcctggttttcttgtaggatgtgtagatagatgtagatactatctaccttcaacttgtgaatttattgttgttttcatcaaacacataggtgatttttgtttgctagagcacaaacaagactaatattttattgaacaaatagaactccctctagtcacaaatatgtccttttattttattttttttgaacttttgaaactttgactatgacaatgttataattttttttatttggattgaggtaaaaaaaacagacatcacaaagagaaaacaactaaacttttgttgaaaatttctatgttctttctcaaacacgaagcatcatttgtggcttataaaatccacttacaagatttatttgagagttctgtttgcagcactgttgcactttcctccccttccgctctcaaaccttatctgcaccaggtaaaaccgtagccaaaaccatctccattttcaccaggcgtccagtggatctctcaaaatccaccatgggtgaagcagccatggacaagatcccacataatggggtactcagtactcccaagtgcttgagtgtcgactggtagcttaagactgatccagctggtagcatgtggtcaatctgaccaggagcctcatggtcagacctgaggaggctgactctaaatctaactactcgctccatttgaggttataagatgttttaactactatttaagtttgactaagtttatatacaaatataataatatttatattatcaaattagtttcattaaatcaataattaaatatattttcataataaatttattttaggtcaaaaatattattattttttcttcaatttagtcaaacttgaagcagtttaactttgaccaaagtcaaaacatcttataacctgaaacagaggtagtatttatcaacctgcattgagtagcaaaagagaagaactaagtatagctgattagtttgtaattaactaactcctaacgaactaattatgtcatcatgccaccttttttatagcaggacaagccctccaattcattaacgaagtaatgcattcaaaaggtcctgagtaaaacaaaaactaaacagacaaattgttctgctagaaccatgcatcaacatcagttcagtacgctagctacatatacttcgataagagcatggaacaaatgcaattaacacacacttctatattgatccaactaaaatttgtgtgcttccaagaccttcaagaccgcctgtaaccattcctgcacacatgattaaccaccaccatccacgctgtcaagtgtcaaaagcttcttgttctcctttcttcaaaatagaccataaacctaaccagtaaggcaataacagacatttaatatcaccttgcagatggactgataacttaattatttcagaaacacaaacagatctataccgtccccgcaaaaaaaaaaaaaaaaaagatctataccgaatcttcaacagtgcagaaaattgctgaagaaccagttcaaactagatcattccaacaaggctgtgtttagttcagcgcaaagtttggattttgattgaaattggagatgatgtgactgaaaagttgtgtgtgtataacaggttgatgtgatggaaaatgactgaagtttggatccaaactttggatctaaacacagcccaagtgagatgctattccagggataatgggtaagttaaaaggccatgtcactatgttagagtgctacatagcgaacaattgcttcattactaccacaaaattgaacaataacagccttgtatgtgttgtccaaactgagaaactaccagtcatgcaagtatgcaactaccaaaaaaaattcatctcccaacagatttcctatccctactgaagatgaagtctgatgtctgagagttcaaactaacagtcatgcaacaattgttctccattctgataccaagaattttataaaattgtattaaataacaatcattcgaaaaataaaaaatatcaagttaaatgggcttaaattagtgatcagaaagcgttcaaacactttattcacaaaggatacacggcaatgtactaaacaagaaaaatgtagcccaatgtacagggaaaagagaactgatcatggtggcttcaccgtagtgctagtcactgcaaaaatcaactgttgaaaattgactttccctgaatatatatactagtaggtattctagtgtcacataatttacagtgcactaggcaatttgtgttcatgggtgcattacccttgaattaataaaatgtgtgtagtaaacacggtaagaaaaaagattgcaaagcaacattttaactttgtgcgtctatttaaagaacgtttaactttgtgtagaattctactagactactaatccgaatttgtacaactttgataccacgatacggaaagtagcaaagctcagcactagaaacaaacattgttaacacaaaaacatcaaaattaaagcaactagatcgagaattacagcaagattaaatgggagaacatgttctaccttggacattgacaattactgtcttgttgatcaatcagcaagagccggcaatggcggatgcagcgccatcctgtagggaagtgccggcccagagtagaacctcctgtgaggcagatcgatgaacatcatggtctcgaggcttagcgcgaacacccatccagagccgtagtgcttgaggaagacgaagccctcgccggcgtccatgatcctcgtcgggtagccatcggcgtccgcgaagaacagcggcgcgccgtgggcgcgcactattagtgtgaacacaaatgtgatctttcagctaaaccaaagtcagcaagaaagatttttttttagggcaatcgctacagcgatcgccccttcaagaacatccccgatcggggggattaccgccttaaccctagtgccggttccccctatgtgcagtggctataaatagagatcaatacctaagagttaaaccctaagaaaaatttctctagctacccgatcaagcaagccactgaaacacagggaagaaccgagacacaatcctctctgtgcttccaaacgagaggaaaagaaagaagaacaaacaacagagaaatgggaactccgggagatcaaggtatgattcaatcccattccaatttgtagttccattttgtgccaaaccgatccaaagaatatccaacaatggtatcagagcaccgggttggcctcaaattggaactcaataagtgttcatgttcaaattgttctttatgttcaagcccaaacccctctgtcaagttgagttaagcccaaatcatgcaatcccaaagcataagaagtagaattaggccttctagggtttcggcttgaagaaattagaagaaggggaagcaaaagttcatggaaatctcagacaaatccccaagaaccgaaaccctagctacagtaaagacctcaaaatttccccaaatcatgaaaccctaaccctaaaatcatggagaaaaggagtgcggcgggcttacctaagggcatggtggccggcggcgacctccgtgtcgccaccgacgcaataagaggcgagcgcgcgcccgaggacttggtccccgagcggcctcgcgacccgccgtgccggcccggctcctcctcctcgccgacgccgcctcgctgaggtagccgtcgccgccccgtctcgccgtcgccgccgcggatcttcctcgcgcgtgcgactggcgggtgcattagggcaccgtcgagcaacgctcgacagggatgcgcgccagctatggcggcacgcagccccgacgagcaaggctcggcggcgccatcactactcccgccgtgcgccgtttcgccgtcgtcgtcgtctcgctcacagtcgccgcgggtgtgagagaaagaggggaggagaaaatgggggctagggtttcgcggggggcagtcgcgcgccggttttgtcccgcgcgggagcgatctcggccgtccgatcagatggacggctcagatcggctcgctcccgacgcgggatgacgaggccacgcgggaggcggcaaacgccagcccaggcccaggtttttgggcctggagcccaggcgggaggcggctcggccgtaacaggccaggctgaatgcggcctgcctcagggaagaaggcccagataaaaaaaaattgttatgggctgcatagtaacgggctgcatagtaatgggcctaattaaaaagattgggctgagataatattacaattaaattttccttttttgatgaattatgattatgattatgatatttgtgtttaaacattgaagatatttattatgttttagttaatgataataagaataataagtgattttgttatgtgataaaattctctttcatttatttatttattttatgatcatattatatttattagttaaaattattattgttattgttgttttatgcattatgaagtttatttccgctacaaataaatattacaattaagtgtgacaaataattgtcattctggccaaagctgattgacttttatttgatcacaaaattttattaattcaattcaaatctggccaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaagatacttatttagctgttgattctctcttatgcagcatcttatgcctcacaaatttccggaataatgggaaatattgaacaacttaatggaagtaattatgcttcatggaaagaaaagctggaaattactctagctatgttggatattgattatgccctccataatgatcctccagttgaacctagaccggaaaatgagaattatgagaccctaaaaaggatatatgatgaagtaaaggcaaaatgggatatttcaaaccgtaaatgccttatgattatcaaaagctccattattgacgcaataagagtagcagttccagatactcagacagctagagaatatcttgctaaaattgaggagcagtttaaaggctcttctaaggtttatgccaccactcttattaaaagattggttaatgaaagatatgatttttctggaaatctgagggaacatattatgaaaaaatgtcatatggcttctaagcttaaatcaatggaaatggaaatctctgaaggttttcttgtccatttcattatgtcatctctgcctcaggagttttctccatttacaatcaattataatgcaatgaagatcaagtggggcattgatgaattaatagccatgtgtgtacaagaagaggaaaggcttaaggcagaaagagttgatcatgcaaatctatttaaacactctgagaagaaaaagtataagaaatttaagaaggagtatttgaagcctaagcctattcagtttaaagaaaaagggcaatcttcgagtcaatcccagcagaataaatctggaggaaatccctatacagaagaaaaggaaaaagaaaaggatgggtgctacttttgtggaaagagtggacaccgccaaaaagactgtattgggtttatgagatggctcagtaagaaaggtactgatgttatttcttttgttgatgaatccctgaatattgattatgccaccaattcttggtggattgactcaggagcgacaattcatgttgcaaattccttgcagggattcgctatgaggaggaccctaagaagaggggaaagaagaattagagttgctaatggagttgaaactgaagttgaggctattggagacttcactctcacacttcatactggcttcaaacttcagctacatgatgttctttatgtaccctctatgaaaagaaacttagtttcagtttcacgtttagataacggtggttactattgtacttttggaaacaatagatgtataattatgcatgataataaagaggttggtctcgccgttggacgggaacaactttatcaaatctctgtgtgcgatgccacctataatgtggactcctcctcaaatgcaaatatcagtaccaaacgaaaacataacgataataagactttttcgaaattatggcactatcgtttgggccatatttcgagggggagaattgagcgtctcattaaagaaaacatcctttatcctttggacttctcagatgcagatgttgttcactgcattgattgcatcaaaggaaaatattccaagcaaatcaagaaaggtgcaaatcgaagtatgggagttttggaaatcatccacacagacatctgtggtccatttaatgaaaagtcagtggatggattcgattcattcataacattcaccaacgattactctcgttatggatatatctatccaatcaaagaaagatctgaggcattagacaaatttaaaattttcaaagtagaagttgagaatcaacatgatcgaaagatcaaaattgtaaggtctgaccgtggtggtgaatactacggtagacatactacttatggtcaaattcctggaccttttgcgaggttcttacaggaaagtggcattaaggcctagtactcagcaccgggcgaaccccagcaaaatggagtagctgaaaggcgtaatcgcactcttatggatatggtacgaagtatgttaagtcactccactctgccggtaaagttatggatggaagctcttaaaacagctacacacattcttaacagggttcccagtaaatcagtccctaagacaccttttgaattatggactgggaagaaaccaaccctaaattattttcttgtgtggggttgtcctgctgaagcacgagttttcaatccaaatatgggaaaattagacctcaaaacaatcagttgtcattttatcggttatcctgataagtcaaaggcatatagattctactgcccaaattagtttacaaagttcattgagacaagacacgctgtgttcttggaaaatgacataatcaaggggagtatgacacccagagaagttgttctggaagagaagcggaattatgttccaatgcctataattgaagaacccgttttctcaacacatactcatgttgcaccttcaatagaaagaaataatgatgcaacacctgctgaagctcctgcaactacttctagtagtgtatcaaatggtgagaataatgaggatgctcagcagccccagattgtgatagatgagcaaaataacgagcccgtcagaagatcacaacgagttagaaagtcagcgattccaagtgactatgtcatttacatgaatgaagaggtgaatgaacctatgattgaagaggtgaatgagcctatactagataatgatcccatctcatttaaagaagcaatgaagagtgaacattcgtctgaatggctaaaagctatgaaagacgaaatgaaatccatgagtacaaataaggtctgggacttagtagaaattcccaaaggagccaaaacagttggctgcaaatgggtctataagactaaacgtgaccccaagggaaatatcgaaaggttcaaagcagggcttgtagcaaaaggatttacacaaagagaagggattgattataatgaaacattttctccagtgtctactaaggattcattcagaattattatggcactagttgctcattatgatttggaattacaccaaatggatgttaagacggcattcctgaacggtgatctgtatgaagatgtatacatggcacaaccagaaggttttgttatgaaaagaaaagaacatatgggatgtcatctaaagaaatcaatttatggactaaagcaagcatcaaggcagtggtatctaaagtttgaccaaatcataagacaatttggttttaaagcaaataaaaaggatgactgtgtatacgctaagtttaaagagagtaagttcatcttcctaatattatatgttgatgacatactcttagccagtaatgacagaaatatgctactggaaacaaagaaattctggcctctaagtttgaaatgaaagatctcggtgaagccacttatgtgttgggtatagagatttaccgagacagatcaaatggtgttttggggttatctcagaaagcatatatagaaaaggtactgaagaagtataatatgcataattgttcagcctcgcctgctcctataatgaagggtgataagtatggaaagttccaatgtcctaagaatgagtatgaagctgcgcagatgaagtcgataccatatgcttcagctatcagaagcataatgtatgcacaagtgtgcactcgccctgatttagcttttgttaccgggatgcttggcagatatcaatctaatccaggtctagaacactggaaattagctaagaagaccttgcgttatctacaaggcactaaagacctcatgctcacatatagaaagtctgaaaaccttgaagttgttggttattcggactctgatcttgcagggtgtgttgatgataagaaatccacatcaggttatatattcacccttgcaaagggagctgtatcgtggaaaagctccaaacaaagagttactgcatcgtcgacaatgcaggctgagtatgtggcatgttatgaagctactggacaggcaatatggctgaaaaactttatcccgggattaagagtggtcgacagcatatcaaaaccactcaaattatactgcgataacaaaccagcagtatactatacgagtagcaacaaatcaagtgcttctgccaagtacattgatatcaagtaccatgttgtgaaagaaatgatccaggatcagacaataagcgttgagtatatgaacactaagttgatgttagcggatccacttacaaaaggcctaccacccattgtatttaaagaacatgttgccggcatgggtttggtagaaaagcctttgatcctggaataaataggaacctatatggcactgactccccataaaactaaggcggactcattttgaaattaaataggaaccatagtcacttggttcagtggtgcttaattgactactgtaatctagtgtcttgatgtactgttttattgaaaagtgagtccataagtttgtataagcctaatgtaataagttcaaagagctcgtaagattaaagaagtttgttttaaagtataatagtatgctatagtcactggattctgtgatgttttatattggtcactgtaatcttttgtcttggtatactattttattgagaaataaacttataagtttagcctcacgatcaagggggagaatgttagtgtgaacacaaatgtgatctatcggctaaaccaaagtcggcaagaaagatttttttagggcaatcgctacagtgatcgccccttcaagaacatccccgatcggggggattaccgccttaaccctagtgccggttccccctatgtgcagtggctataaatagagatcaatacctaagagttaaaccctaagaaaaatttctctagctacccgatcaagcaagccactgaaacacagggaagaaccgagacacaatcctctctgtgcttccaaacgagaggaaaagaaagaagaacaaacaacagagaaatgggaactccgggagatcaaggtatgattcaatcccattccaatttgtagttccattttgtgccaaaccgatccaaagaatatccaacacgcaccagatccagccgcgactcctgcacctaccggcctctactgctcctgctcttgtcaagatgccagaagtcgagcgccgccgccgcgaacgccacgacgcggagctcgccgtcgtcggatctcatgacgcacatgttcccgcggtagcgcgtccacatggcgcgcggcagtttgatgttggagaactgcttggtgcgggcgtcgagcgccaggaggtatgggttgtcgtcgtcgtcgtcgtcgtcgtcgttgatcagccagtagacgctcccgttggtgtgcatgtcgtcgctgaatgcgccgagcatgggcatgatggcggtgccggcgtcggagtaggggtgcacggtccacgcgccggagcgcgacgagaagacgcagaggcgcggcccaggcatgaagtaggtgacgacgatgatctcgaagcagaggacgccgccggcaccgccgtcgttgtcgtcgtcgatgcgcagcgcggcgccgaggtacgcgctctccgcgtcgagctggtagaagcgggcgtcgcgcacgaggacggagcggccggacacggggttggcgacgacgaagttgcgcgggatgctcatgcggtcgttgaaggtggagcagaggaggaggaggccgtcgcgggtgtcggcgagcgcccagcggtcgacgtcggggagggaggcgagggagaagtggccgcagcggctgatggcgccttcgaattccctcggcacggggtggaaggtcgggaggaaggcggggtcgaccacctcgccgacgagctcgccaccgaccttcctcgagacggcgaagccgttgttgcagacgaagaagccgaggagcgggggcgcgtggcgatggagccggcggaacaagcggaggaaggtcggggacgacgcgacacggcgccagcggcggcagacggtggcggcgcgcgcgagggcggccgcggaggggaggcggagaaggatcacggcgaggaggcggtcgtcgagctccgccgtggcgtccatggcgggaggcgaccgcgctttcctcttcccgttcccggccattttctactcaaacgcaatgcgcggttgggttttgggatttgggatttgggaagatggcgatggtttcgggcggcgagatgggagggagagattgatcgtgggggatatgcacgatttcccgttacgaggatatgcacgatctccttttcacagggttggggttggtgccttttttttttttaaattacacagtacaacacaaatactcacaacgcacgcgcactcacccctatgaacacacatacgtaaaccctacccctatgagcatcttcgaagactgggccgataaattctggagagattgacgaagtcaccataggcgcctcgctgtcgacgggtacgtcgcctaccactgaaagcacaggggttggtgtcattttgaaaatgtactcaccctcaaaaattgggatttaaaatacagaaactaaaaataaaaacctttaaaaactttgcgaaaacatgctgaacctccaaacaatattcaactataaaactgggttatttggagttttacctaatgcttaattacagtttaattgagaggcattgattgtgaattgtatattatcgtttaaagaaatattttgcaattcaaaagcaaatctgtcttcacactctaaggctgtgtttagatccaaagtttggatccaaatttcagtccttttccatcacatcaacctgtcatatacacacaacttttcagtcacatcatctctaatttcaaccaaaatccaaactttgcgctgaactaaacacagcctaagagcagtacaataacacactataaaccagctataaacatattttaagaagataaaagaggaaagagaagagcagcgggctagagatttgtagctagctgtagcacaaactccaagacgcagtgtgtatgataggtgagaccacgtattaatagtgtagtatataactattatatgaattaactattaaattgactatatatgatttttggagctagtagttgactatgctattaaacttgctctaaccattttccttcctagcgtgactttttcctttcaggactaccaatatatcattcggaactttttttgttgatttttttttcaggcagagctgataatactctccctagacaatattattgatgttttagatttcatactaaatcaccaactaattttatagagaaaattctttgtatgcccttaaaattttagccgatcccttatatctcttgatgtttttgttttatcttgtaactaaaggaacaagtcatatttttttaaaaaaagaatatataaagaacaatccctattaattttgtcaaaagaaaggggcaccatctctcggactaattgagctgattaattaaatgtttcattatgcctattaattttaagatcaggacaagccctccattaattaaagaaaagaattcaagcatttaaaaggccctgagtaaaatctaaatatatgaaagcaacaagctttctgaaaggaggatgagccatatcatctacaatgtatggaccgttggatgaactggtaaatgaaaatacacagttggatcatcatgctcatctatgacagtggaaacacattggaccaatccggatgcttccagactaaagacctcaaaaagcagagaactcatgtggttagtctatttaacactaccgttaaaaaaagtctttttaacactatatatatgtttgcttaattaatgtcctgactaaataaaggaaaaaatatgatgtcttaccgtaaatttgtattgaatttatatgcaagtttatatctataatgtatactacttttgattgcttggtattggagcaacacacaacaactaagtagcatacactatgtaccattttattttaaaacagtccctacaaacgcacaccttacacttaggagcacttagtgttattattgtctccgttctaaaatataggtgttttaacattcaaaatttatcataaactatagctatttctacatctactctctcatcttaaccaacatagtcatatcctatttaatttcttcgtctactttgtaatgtcaatcaattacaacattcctccatttacatctcttgctactgcgtcattcccgaaataagtatttctacgacaaattttatatacaaatataaagcatttctaggacactaatatttcaatgcatatctaacatttttagccaatcaggtgttcggaaagagccaatcggagtagttcaaaatttgatagtaagtaaccgaaagagatcattcctccttaatcttactctttactaaacaaactagaaatacttatatataggaattaatggagtatatttgagaacaaagattagggtacttacgaaaccggtaccttcaattaatatcaggatcaatatctcaatgtctaattatataggtaggttatactaacgctcaaagtcacgcaaagcgcgactaagcatttttttttctgctagcaccattcatcaagagttcagtgcactaccagtctaccacactacttgacccaacgaaggattgtgtgcttcaagactgcttccagccatttccaatcacattcttagtcaacaccatccatgctgtcgagtatcaaaggcttcttgttctcctctcttctgaaaagtagacaataaacctacaaaataacagacaataaaaatcactggaaaacacaagagatcgaatcttgaagagtccagcaaattgctgaataaccaattaaaagctaaatcattccagcaggtgatgtgctatcgcagagatactcggtatgttaccatttcaacgaatcacaatgctccatatgtagtgaacaaatatttcattacaaccacaaaattgacactacgcgacagtgatgaaactgttaagtatagtagtatgtcaagggtattagagtactttcccctctcttgtgttccccctctcttgtgtacatatatgtcatttagggccaaatcaatacaagattgaaatcccctaatctctctcttaccttgagatggtatcagagccttactgctaatcctacccaccaagttcccatcggcggcacgccggcggcggtcgccgccggcgagccattgtctcgtactaccgtcgtcttcgtcaagttgttggtagcatcgttgttcgtcgtcccgtcctcaagcctgtcaagcagcagtcaggagcatcgtccttcctcatccacacgcatcagtgcacgccgccggcggcaaccccgtccaagctgtcagccatgtcgtccccgctgcggctcgtcgtcaatcgcgaagccgtcctcaccagccgtcgtcctcgctgcccgtcgcagcgctcgtcaacggcatctgtcactgccgctcgtcgcggcgtgcatctcctcaccagctccacacctcgctgcctgtcgtaaccccttgcgtggcgccggtcctctccgccaatcaggccctgtcacccgtttgtagcagagcaagcagctgccgctgccggcagatccttcagtcttggctattgcctgtaaactgcacaagtccatatgctgcacacaaggtgctcgacaaaatgcttcaaagagttgctcccagcttgtggtcatgcttttgcctttccaatttggtgctttactgaaagtattcgtggtctctcattaccatctcctgtccatcttcatcagctacttctctctgctaccaaattggatagaattaatcagttaatatgcaattccttggcagccacaattatgtcttttgctagcatatcaatgtcctctacaaattgatttcctttgtttcctatgatcctatctagtttatccattaaagccttgctgcatatctattagtatcattgtgtcatttactagttgccattcaatccatccaagtccattgcatattcttcaatccgtccaattgatctccagcttcatatcagctctccgtcggaattggtctatcacttcaccagctccacatcggagctggtctgtcatatcaccatctccccatcggagttgacatcatcatcactcaatgaaggactgaagaacaatttgtgaaggtcctttatcagatctatgaaggtccgaagaacagtttgtgaagggccttccatcatcgtcaacgtctctgaatcaatgaagagccgaagaacgagtcgtgaaggcttcaaggtaccgagggccgaagaacagtttgtgaaggctccgaggtccacttcattgaagaggagatggatctttttcttcttcatcgtcatcatccaagaattggcacactttgacgacatcatcaagactttggagataggctaatatttagtttgtgtcctagtgtttagtttacccttcaaatgcaatgttattgcatacacattgcatttgagtgggggtgttaagtgtagtagtatgtcaagggtattagagtactttcccctctcttgtgttcccctctcttgtgtacatatatgtcatttagggccaaatcaatacaagattgaaatcccctaattctctcttaccttgagagaaactttgtccaaacagaagggacgcacaaaagattcttgaatataataaaccctgattatcaatcatgacaaccttgtatttccaacaaaacctgtgatatatattattaacattatcataatccccagcataattttagacaatttctgaaagtaaatatttggtctcagccacttggctagtgaacaaataatctaatattcaaccatccctactgaagatgaagtctgagagttaaaagggaactgaaaaatgttttcaaggcggatagttcaaagtaccagacagccaagagtagttcaccaaaattatgataccaacagctcttgaaattatgctaaaaccagttatcaaaaactaaaaaagaaaagttgaataggcttaactagtgttcataaaacgttaaacacttaattattacaaaaggatactctgttactaaacaagcaaataggagcccgttgaacagataaaagagaactgatcatggcgtcaatgtaaaatcaagtgttgtgaattaacttttcctgcatatatatggtatctgcattaggcattttttgttcgtgggtgcatgactaaaaaattaactatgcagaaaatacagaaagaaaagaaattgaaatgcaacagatctttcccagtcccagatagaagagtaccaaccaaagaagcgaaagcatttacgatgtacaacgatccctgttaagcatccaaggttgaatggttaaagcgcccaactcataattggtaaatttgcgagcaaatgggattagagaactcagtagtcctagctgtaaacgatggatactaggtgttgtgcgactcaacccgtgcagtgctgtagctaacacattaagtatcccgctttcttcaagatttggcccgaactgttcggcagattcccatgcgttacgtgtgccaataagagtttcccgacactaaccataaaatagaaatacactactccaacaaatacaactacggaactagataatcctttctaaatgttctataaacttggatattagggagtggtaatttcatcgctcgaatttttctttttattttattaatagtcttagattttgcattttttatgagcctcgttttgagggagattgaaatgcaatatttcaacgttgtgtatctatttaacagaaacttttaactttgtgtaaaactttgtgggaaaataaatcagaatttgtataatcttactaccacagtacgaaatacagaaaaactaagcaatgtaagtaacagcgttaacacaaaaatacctacagaatttcagcaaggttaaattacatgaaaggttcttctaccttgacattggtgaatgatgattgctgtctagttgatcaacccgcaagaggccggcaatggcggcttcagcaccagcctgtagggaagagccggcccaaagtagtacctcctgtgaggcagcctgaacaacaccatggcctgaacgtcgagagcaaacacccattcagagccatagtgtttgaggaagacgaagccctcgccggcgtccatgatcctcgcgacgtcgtcatcggcgtccacacagagctccatcacaccgtcgacgtgcgccagctccacccgcgactcccgcacccaccgccccctgctgctcctgctcttgtcgaggtgccagaattcgagccgcgccgctgcggccgcgaacgccacgacgcggagctcgccgtcgtcagacctgatgacgcgcatgttcccgtcgtagcgcgtccgcatgctgcttagcagtttgatgatggagaactgtttggtgcgggcgtcgagcgccaggaggtacgcgccgccgtcgccgccgtcgtcgatcagccagtagacgctcccgttggcgtgcatgtcgccgctgaaggcgctgagcattggcaacatggggatgtaggcgtgcacggtccactggccggagcgcgacgagaagacgtacagacgcggctcccacatgttgtagcaggtcacgaggatgatctcgaactcgaagctgcagacgacgccgccgccgtcgctgtcgtcggtgcgcagagcggcgccgagatacgcgctgttggtgaccggggcgacgtgcaagaggacagagcggccggacacggggtcgcagatggcgaagttgtccgggatgtccatgcggtcggcgaacttggtgcagaggaggaggaggccatcgtgggtgtccgcaagcgcccagtgctcgtcgtaagggagggagtcgagggagaagtcgatgcagcggttaacggcgccgaggaatcccctcggcgtgagcctcgggaggaaggttgggtcgaccacctcgccgacgagctcgctgtcggcaatcgacctcgagacggcgaacccattgttgcagacgaagaagccgaggagagggggcgggtggtggagctggcggaagaggcggaggaatgtcggcgacgacgcgacacggcgccagcggcggcagacggtcgcggcgcgcgcgagggcggccggggacgggaggcggagcaggatgtgggcgaggaggcggtagtccagcgccgccgccgtggcgtccgcggcgggaggcgcccgcgctttcctcttcccgcccatctcttcgctgcgcgcggcgcggttcggtttggaaggtggcgatggtttcggcctttcgggggaaaggtgaagcgggcgacgtgaatacgtgatgggattggggagtggatgaggacgtgtggcgtactggcgtgacacgtatgaacgtggcgggagaaaaggggtagcgacggttgtttcgcgccacttctcttgtggagttggcgccattttcgaatcttttatatgagtttggtttaaaatcagttttaaggtaaaaaaaaacttttaagactaatataatataactacaaattagattgtactatgaattgcgtgtaactaataaaaacatttgtggcccaatggtaacatgcacctcctctagtcctttgaaacgaggtctatgttggaatacctactaaccagtacaagcttgcgtgtttttccacctgcatagcacaaatcttatggaaatgcttcggattagacgtttggcataacatgaaaaatcaaatagacaaactactatatatctccgtgtgcactttacacatccatacatgctataatgatcttcaaaataactttttctcttgaactacttatccaatctatgatatgatcacaccattatatttgttataattaaatctttactataagatatcacatcgatatattctgatgaaagaaaaatatatgatgaaagaaaaatatatgtttcaatccgttaaaatttaatgtttcagatgtggtagcaatatgtttcaacgcgtgttttcattatgtttcattaaaaaaattaaatattttaataactgaaatttttatttcaccatgtataactcaatgtttcaccaatgaccgaaaaaatatgggatgcttatgtccctactctcttctaacattctagtggctttcttcccacactatgcatgcatgcatgtatttagtgatcttaaaaatatcttctcttctaaactactcatccgatgaacgatttgatcacaccgttgaatttgttataattaaatctttacaaaaatatatcacatgattatattctgataaaagaaaaacatatgtttcaaacaatgaaaacttaatgtttcatacgtgatagcaataagtttcaccgtgtgttcttattgtgtttcacaaaatttctctatgtttcagaggttgatttttttttcaccatgtataacttaatgttgcaccaacggtcaactgaaacatttgaccgtccatttttttctgtaacatcggacgtccgatttgtagctctctcccaaagcttaaagcacaatggaaccataaaaggccccataagcccccaagcaaaccacgggaattgctaaggacattcacagtacggttcgctcattagagtagccctagccctagatgccacataagcactacacatttaggccatataccccaacacccatgttgtgtttgcaaccccatgttcccaacccttctccctcgttttacgcgcgtacacttttcaagctactaaatggtacgttttttacaaaaagtttctatacgaaagttgcttaaaaaaatcaaattaatctatttttttaaaaaaatagctaatacttaattaatcacgcgctaatggaccgttccgttttccgtgcgggagggattagttcctacccgttgaatctgaacaaagcctagtgaaggtcacacctagttaatttttttcggacccacatgttagcccctcccactctctctctcaacccccttccttttctcacctaaacgaataaatgggttgtgattatttatccatcaacacatatgtacaaattaacgcacgttcatcttttctattatcaagaaaaaacataaaaagcaatggttatacacggtcacggtcagtcggtcccgtagttaaactatgcctacacagaccgcatacgaacaaagtcgatcaatagctagcaagctacggaagataggtaataagatgcctgatccatctcatatccaacgaagttcgtccatgacctacagtcgatgtcatcagccaccttctcaagctccttggttgcaatgttgagcacataagcaccaggagtgctgctccctttggcgtcgattgtgaagaagagcaagccactcctctcgcaaaaccacctcaggttcatggcgtcagagcgatgcactctcaactcatgcaacctgacgcgccatgtacagacgctcacctgttcgcgcgtacaaccgccattgctgccgaaagcaaggtggtagcagcttgacactccggcggagccgtcgaaataccttgaggtgacgatgaagctcagcttgccgtccgggctgatgccgagcagatggtcgtgcggcggcgcctttggaacggccggcggcatcggcatctcttcgggctccggcgtgtcggcgcgcacggcgaatgccgtgtgcgccaggggccagtaggccacgccgccatggacgacgctctgcctgaggttgtggagcgtgtagctgctcatcttgggacctgatgatcgtctagcctccgcgctccagcggccggtgtccgacgagtaggagcggagcgcggtgtacgttcgccggttgtagacgacgacgacgcggaagaaggttggcgacgacggcggcgggtcgtcgaggtcgtcggcggtgagcaaggcgcacgcgtacgctcccggcttgtcgtcgccatggagaggcgggagcgtggcgacgtcccccgtcatggggttccagacacagagcttgagcccgtcggcgtgcccctcgcgccggagctcgaggacgacgcggccgttgcgggacgtgaccgggcgggagtactcgccgtcctccacgaacgggctcaaggatgggccgaggagacgagcgccggcagccgtcgggacaaagcggcaagtctgccctgccgccgcggagcgcttccgcttgccggcggccgcctcctggtagaagaagccgagggccaagcgtggtaaaaccggctgcggcagcggcagcgaacggcagaggaggacggccgcgtcggttatgacacggctccaccgccggcacgtggcggcgcagcggactaggtcggcggcgtcagggaagcgggtgaagacgttggcgagcacgctgtccggaacgtccgagaacgcgccgccgttgccgtctctgtcgtcgttcctggcgcgtctgttcgtccggcctcgccgtcgccgtcgcgacagccagcctttgtggtacggcgcgagacgggcggcggccgcgccgcgtggtgcgcctcggcgtcgcggcggcatccaggctgcgatgggttggtgcgcgattggatggacgcggtgatgctttggcgccgcgttatttatggccgcggaacgcgcgcctcccgttggcaactcggaagtcggagaagacctccgattccgacgatgtctcgtctgacggctatgccatatgttctcaataaataccaaccgtcagatcatcggagcgccgacgcatcgccatccatctgatcattaatccctaaatcctgtttgattgtgaaccttttcctccgacgttaaaaacgaagcagttattagcacatagtcccttcggttctattttaactgatttgttaaattttgttgtcgatttttttttagatttggggataattttgtgaataacttggatgattttgtgatgggcttgtgaattatggatgatttgttgcgcatgattttgtggatgatttgtacatgattagagagcatacctgcatgtaggatgtaactacacagctagtacaaaccagctaccactccatctataagacgcatcatccacctatagttcaaatacaattttctcttaaactactcatccgatatacgatccgattacactgttgtgttagtaacaattaaatatttacaacaagatatcacatgattatattttgatgaaaaatcacaaattacttttatgatatgtctaaattacttttagatttcactaagttacttcttagatatataaaagtaaattcagtaaaacctaaaagtaatttacatatattatagaagtaacttagaacaaaacgaaggtaactttagcatgtcatttgaagtaaatccgttgtaaagataaaaacatgactctatctagaaattaaattaatcagcacaaattatgaaattaactaaaaaaataataaaagtaatcatctcagagcattatgaatgtataggaagtattttaatcaaatctaaaaataacttatatatatatatatatatatatatatatatgggactccatggtgcccgggctccaaggtataaaacacacaaattctctcaaatttttaaaaattttcaaattgtgagtatatacctaggtataagaatttgattcatacaaatacctaacaacaaaacaactcaaactcaactttatttcacaattcattattgcatacctaacgaattatatgtttggatgttatatacctagaaccaaaatctaacaaaaaaaaagttcaaactcagttcaaacttgtttgaacttgttagtaaagaagttaatgttcatatctaaacatttaaaaaaatttcatactcattcaaattaggtatatactcaatttgaatcttggagcccatactctatgtagcaccaattaatttacatatatatatatatatatatatatatatatatatatatatatatatatatatatatatatatataaatgattctatgcacctgggtgtacgtactcctgctcccatccaccgttgatcaacaaccagccacgatcaacaacatgcttaccggatccacccactaaacccgtttttgttatagtcgtgaaaaaatatttttcataatacttaattatgccggactaataggacctaaacagaacatataaatccctggttccattccatccggtgacggcaacagctttactctctccaccgtattcggatcgagagctactattgtcgattgaccacggcagcggcattcatcgatcggcgatttgctgcggcacggcctttgtccacgcggcggcggcgaccgccacactcgccagccgaaggagcagcgaggcaactgcaccacggcgcaccgctagctatgactcctggccaccggtgttgatacgatgaagaacgacggttgatcgggcgggatgcaggatcagccatctgggtttctccgacgagcctggtgaatactaaaatccatacacggcaacagacttgcataaggtaaaccatgccgttcttaatccttattcatcctgtagttatctttccattttactattgattactattgcagatcgaggactaactttgtatatgtcgttagatccgtatgtgcatgtagccatttcccctccttcaattcgatgatcagtaggcctgatgcatgtttctattcaatttttattcctctggtaatcctaatgatatatatgaagcccctaactaactttgctccatacagatgcgtgacatataccaaggatcgatggtggccaacgcccgacagtatatgaattgccgatttgccagtattaattaaaattctgtccaaagcagcttgtgcagttcgagaattgggtatattgtagattcatttatttctttttcagaatggctaaatgtatcatgtgaatccatatactgcctggattgcaaattctattgtgaacataatatgattcaatttattctaaatcgggtattgtaaaacaactattttgttctttaaaatctcctcccagtcttagttctgatctgtatgcggaatataagtactactaaaacacatcatgctactgtgcaataagtatgtagtatcacagcatacaatttctgaaataattaaatcagtacatgcttctaaaatcacaccatacaatttctgaaagacatcagtacatgcttctaaaatcacagcatataatttgtgaaagatgccggatccaagcagagatctacgtatatacaggattcttaaagaaagcagtatatactactccaacctgggatgaagtatataccatatcctaaaaaaacagttcataccactgctacctaaaaataagtatatactactactaacaaaaaataagtatatactactactaaaaaaaagtatatactgctacaacaaaacaaaaggtatgtactgctgatcactgcaaagagtatatatactgcttcctaaaaaacagtatatactgttgccaactaaaaaacagtacatacttccacgtaaaagacagcatatgcatcccgctaagggaaaaacgtactgcgtgttgattggagtgtcgttgatgattctaaaatttgaaaccaccgaaaaactgggcatgcacgctacaaataaaaaaaaacttatttttcagcacaaatcattttgaactacgctaatggattatccaatagagaagatggagtacatactcctgggagtatatatgataatctgttcaatgaaaaaagacattaattaaagttactttatttttgttataagttacttctataatatatgtaaattacttttaggctttactgaatttacttttgtatgtctaagaagtaacttagtgaaatctaaaagtaatttagacatatcataaaagtaatttgtgatttttcatcaaaatataatcatgtgagattttgatgtaaagatttaattgttacgaatataacggtgtaatcggatcgtagattgaatgaatagtttaagagaaaattgtatttgaagtatatgtagatggtgtctcttatagatagagtggtagctagtttagaccactagctgtgtagtcacgtccatttagtaagtttatttttaaaatatttaatttattactataattaaataaataatctattactctgtatttaatactccctccatataccggccgggagcccgggagtgctgagtgctgggtcggggcggacacgagagttgcttcaagatccgtgcatctacacgtggcgtaatctcgttagccccagaaggaaggcgaaagctaagacccctcccttccattcttcccaaaccctagccgccacttctctctccccgcctccgccctctcccaattcctcctccggcggcggcggcggcgttgggacgcgcgagcccatcaccatggcgggcgggaagatccagaagaagcggcacggcggaggagcaggcggcggcggcggcggcgggggcgggggcgcgcggctgcagggagggatcccgttcgagaagtccaaggggcagcacatcctgcggaacccggcgctggtggactccatcgtcgagaaggccggcctcaagcccaccgacaccgtcctcgagatcggccccggcacgggtaacctcaccaagcgcctcctccaggccggcgtcaaggccgtcgtcgccgtcgagctcgacccccgcatggttcttgagctcaaccgccgcttccagggcgaccctctcgcctcacgcctcaaggtaaaattctcatggtctcctctcttcattttattttttctctccagttttgtgtgattgatggaacgattggattatgttaactttgcaaggactagtgctacttcctgttaataataatacggatgcttaggcatcttgaatttgcttgtagtctggttcggtgacagcgattcaggggattcggtggtgggttgcactgtaatttagagtaaattacaacattgggctacctacttttaccaatgttgcaacttggaccagggtggaaacaatattttcacattggactgcttgtcctatgcaaatggtttcactttggaccatgtccatcgatctgttccggttgatctgcccctcttcgttctttcttctccatagagccaaaggcaccagtcaccggtgattccttctacatagagccgaaggcatgagcggtcagcaaggtccaatttactcctcgctagcaggctctctagatgcaaatccatgctagagtcgcagcatttctcataaccacagctgtcgtatatatgtcaccttgctcttattcccatccaattcgtaatgctggagtcatggatgagcaccgttgcttcgtaggatagtactcttcctgtataagaataatgcttttttgtttctacatccttccagtttccagatcctttctcagggtgagagcagtgctcaaactcgacctctggccggtcgacacaggggctgaccaagcttgaatacaaatgaggatcaggatagaactcaagcaacctagagagatttcatggtgttgaacagaagcatcttcatctcaacatggaagaaagggagaggagagatggagaaaaaaactagtccaattcgaaacttttgtttagttacctgtccaaattgaaaagattgagccctagtccaagctgcaacatgggtaaaagtacgtggcccaatgcacaattcactcgtttgtattattcagattgaaaaagattgaatttctgaggatgctggggaattcagagtggtgtaatgtttgtgcttagagtgtagatctattagtgaagtttcctctgctgagtttctttacgcattgtaccttacagtatttggttcttgtttttggtaacgggttagagttttaggatttggattgttaaaatgctgcatggtatttgcttcagtgtgagaggatgccttttcaatgatctgaattggtaagtgctggaagagtaggtgtgtcccatgtgttgtggggctgcctgtattttgcatgcttcattgatgttctgtttatatggatacttttcaagattctaggaaatataatgtgccaagactgagtatacagtcgtctcaaaaagcaggcccccatagacattgttagcagctccccctcatgtacaacttggggccaaagttcccatagcctaggaaattttgacagaaaaaatgtaggctcttgtggtgtgtatctggttgaattgattgcagtgggaatcttgaagatctctagattggcaaagaatttggttaagaataaactgaatgtgctggcagtagggttagttttgagggtgtaaaagggatttcttttcatattttttttgggtgttgttttttcgtgtggttgggggaaggggatcataaaaatgtcagtcattaggcggtgggatgggaaattcacaatcagcaccaccactactttcttttaaaggagtaaaggaataacatgaatagaaaacaaagaaaccttggtcaagcatctactgtagaactgtacaactagacgatggaattgtctatgctccaacactgcaaagtggcagtactgttgttgtgtttgtacaatacatttaaagaactaagcaagtgtttggttcttttactgtttatataatggtattgtttggacagaccaacaatggtagtgccctttttcaatctgtattctgtcatggcattgggccaacaggtcagcccaagggtaacccaggaccggtcgagagaacgctatcctcacctcgtacacagtaccatagctcagccggttatcagttctagtctgttggatagttgtataggattaaactgggtccttccctccgtctatataaggatgtactgtattgtcatttagattaagaaatgaagaagaattaatctaatccctcccaatgttcttctccacaaagtctaaatgccatccttagcagcggatgcctcccagccatcctcctggctacattccctgtgtagacataccatttcttgttaagaggaaaggtaatagaactaaacaaaatacctaagaataatcagcaaacattgatacatttactcctttaaaagagagtagtgctggtggtggttgtgaatctgccaactcacatgttctacagtgcatttttatgaatgtccgttctattcttcaatatagaaacggtccctttcatatgatcttctcttatttcactatagaataattccaatttcataccaaaaggttcaagatgaccatattgccatgtatatatgtaagtgtatgagctgattttgttagtagagtctgcaaacactatcaaatgctccttgtaactgtgaaaaaaatgaaagacaagtttgatggaaaagtaacaaccattttgttttggacaatatcaaaatatgcatgatcgcatgatatctgtagttaagacttaagtcatgaccatttagctagtaataatcatcaaagtagtgatcttacttttttaggatggtttagttttggatgttttaataaataattatccatagtaagatgataaagcttgaaccttggaaatcaaatgtgaggctaacatgcacaatgtttctgttgatgcatctcctgtcatggtccaaatccatgatgggtaaacactgccggaggatagttgggcggccatggcagcttgcgaccaagaaggcacttaggttgggggtgaagaacattgagggagggattaaattaattctgattcactgcctaacgaaaatagataaactcccatccttttatagattgtacgacttgatccctgagtaagactaaatgtaatctttgtccctgactctaactgatgctacagtaatacgagggcactgttcacccctttcccaccaggtatttagttgcccatgggcgttggcttcttagcctgatactgatgacatctttgacctgtcagaaactcagcctaatgaaaaatagatacactcgcatccttgtatagattgtatgacttaatccctgagtaagactaaatgtaaaatcttgtccctaactcttaactgatgctacagtactgcgaggtttacccctttcccgctgcccatggacgtgggtttcttagcccgatactggtgacatctttgacctgtcagaaactcagcacgttagcctttgtatcacataccactgtttaatgactgatgctattttccaataaaaaaaatcatgttatcatcaccacaaataaaaattttcaacagtgatatgcgtatacgcacttcatccaacatgaatggacaaagaacaatcacagaaggggtgggatggaatttgccgaatgccgtattacggtggggtcattttattttacatgatatatggagcacaatactctctcttccagtgcaatggagtttgcatgtgccttagtacattgcggtatttatcttccagtgtaagtagtttgtatcataaatgagggagtgttggtgtgatatgaagactggactttgttgacacttgaggctatggtggctatacattaatgacagtatttgattgcagcaatgactataatcagttaggcttaacagttttggaaggcaaatgtagcaagaaaacaacagtggggcatatccagtccatttaactgtatttgtcactacatttttgtttcccctattctttgcaatttcactaatacaaaaaataatttcctaacaagatgtcatttcctggtcaatcattctgtaggttatccaaggagatgtccttaaatgtgatcttccatactttgatatctgtgtggcaaacatcccatatcaaatttcatctcccctcacattcaagcttctgtcacaccgcccaatctttaggtgtgcggtgattatgtttcaacgtgaatttgccatgagacttgtagcacagcctggagatagtctctactgccgtctctctgtgaatgtgcagctcttgtcacgtgtgtcacatctcctgaaggttggacggaacaacttcaggcctccacccaaggttgattcatcggttgttcgtatcgagcccagaaagcccctacctcctgtcagcttcaaagagtgggatggacttgtgaggctttgtttcaaccggaagaacaagacattgggtgccatctttaagcagaagcgtgtccttgaattgttagagaagaactacaagacaatgcagtctctacagctcacctcagatgcagaaaaaggtgaggagaagatgtcaccagatgatgttgcattgctatcaagtatggtcgatgacatgaacatggaaagcagctacgagaatgatgatgatgatgagatggaaatggatgatgccgatatggtagtagagagccgtgcatgtttcaaagaaaagattatggggatattacagcaaggagattttgcagagaagagagcatcgaagctcagccaggttgacttcttgtacctcctgtcgctcttcaacaaagctggtatacatttttcctgaagaaacccgttatggtctagctagaaaagagtattttctttctttcttagtacgtcttgaaaggtgtgaaggcactgcgagaattttgttctaactatatatatttttatttctagtatggaaagtaatttaattcaatgttgcctacctctatctctgtaatgttttgtttagcttttcatggttgattttgaaatgttgtggatgttaaaactgaatgattgtttgctttggccacacattgcaaaccccaaatctgcaaactgtgtagtatgattttccacgattttatttctgttgatccacaaacaaagaaattgccattctttgcggttagtatttttaactactgttatcatttctactgcttgcttccaagttggatgtttggctctccttgagaaccttttgcattggatgcgtcccagctgcaagtagtccctcttaacttatttcttttgaagaaagacctctttaacttatttctctttgaacttagtcttttacccagcgggctcacatattagtgactcaaagttagaaataaataagttagaggaccctctcttccttgtagcagaggtttgttgcagacgaggttgaatggaacaggagaacaacggagacgaagagatgcaacgcacgcaccagctactagactcgcttccggtgctttactagacttgcttgtagcattgtacattttgtgtgtgttatttttatctaaaaaaaaatctcacttatatatacaagtttaagtaccattttgaacatgggaatctgaaactgtttggaatgaaggaattttcaagaaatttacctgcagaatttatatcatttgtcagttaaattcctacaaaatttggaggaaattattggttcgagctcgtgaaaaaaaaatgtgacctttgcaagaatcagctcaattcctatgagtacaagaaactgccccgttccaagatggaataggcatacagattactaccgcttgtactgtcatcaaccacctgctgactacattagggcatatgcaatggtgtctaataacgggctctcttcgttgttatgcaagtaaatttggtgacatttcgttgttatgcaagtaaatttagtgacgtggaagaaagagagggaaggaatgagaaacatcgttgctacgcatgacaacggctcagattcaactctcatttattaacggaaagtttgttgcatgagggtatagaaaaggaaagaagtataataaaaaaatatttagtgtattaatggtttaaaaatcttattttctctactattataggaggatagtctctattgacattaattaatatagagagcccatattagactctagctttgtacatgccattacaatctaaaaattaaatccgttgttatttcggggtggcgccgtggatgccctgtgtcatttccgttatgtcgtcccaagctgcacacacctgctcacatgggcgaatcagttttctttcatatataggaagcacaaaaattgtagggcatataaatccgaagcggatttgaagaggataaagcggtttccaaaacggcacagcgcatcggctggagtctgtatcggccgatatggagtcggattcggattcggttagccaatacagacaggttttgagttcatgtcgaggttggattaaggattcaaaatagagtccgaagaagacaattgtatttattaattaagataagagtcaatttttcctttttatattttagaaatctatgttagagtccacaataggccggtgtgtttattttgtaaaatttgagtcatatcctatatagacaagttttgtaccatgggcataaatatatgatgggatcttgtaagaaaaaccacaacaattcaataactctcagcgtatcgccacctatttcgttttcaactttttcgatgagttcttgcttcgagttggggcattggctttgatcttctggcgagaggtatggcttgtcatagaggtttgcatcggcgatttaatatgttgttttagacgtcttaatctaacgtttgcaattgctagttatcatatatcttagttaatctaatttgatgacgatttactcctatcggccaggccttttctagggttttgccggtattgactaaatcgttttgtcagtttagattagccaaggtatccaccaccttgaaaatcagtcaaaagttttattgtttagaatttatgtttctttccatactgagtgttgcattaattgagtttgatcttctaagtcgtgtttaaagttattaaaactaacctgcttcttgattgccaatagatagaattggggtttcaaccgatcttacctgatataactattttgctttgtttaatatctttaatcctgcttttcatgttatatccgccccttatataagtatatcaccttatttaaatatatcaatgttgtatttaatcttggccaaatcatcatattgggggatgggtgcttgtttggtatatttacttagatcaatattcttgcataaggttgtatcggagcaatagccgatatgttagctttcttaacctaaatattgtatcattggttatgatataaacacatgtaatctttaattcatctgatctaagttatgagcaatccatactgtcttgattaggttcgacctatactgtttgtttatattttagagaaagattgaattatggattacatgattgattgcatctacaaccgatgtaacatgttttaggcttgcttactttatttatcctatacacaaccaattcgaccagattgcatcggctaggtcattgcgaaatgttattggccctccaaccgatcggttatcatattctaacgtgattttattgtttattcttgttggttgcaggatcaaaccaactgtcacaccctgaacccaagagcaagatttggacctgcactggaactaagcagaactctcaggtcgccgtgttttctcatcaacaactttgagacgacgacaatagttagtaatggataaatcgctttgatagaagttgtagaactcgacattgaggttgagggtgccagtttcgcggttgctgatgaactgatgttcgaggctacgccatatgagtcgagccgtggttatgtgcatcatgacgaactccagcaagtcggtggagatcgtgccgtacaaccaagagaggacaacacaatccatgcgcattcagccagagcgatctgaccagtagatgtcggtgaggacatggtcggcgagggcgtacttgctgagggtgacgaggagaagcctgcgccacttggtgtagttcccagagttgatgtccaggttgatgggcacaacggccttgatgttcaggacacggctgttggcggctataccaattttacgtcaccaatatctgcagaaatctgaaaatataaaacatccaacatagtggtagggtttaattttaacaattttcacgagtgttggtgtatatttgtatgcaggtggcaaactaccaaagttgatatgaaatacacataaaagaggaggagaatttcacctattgagtctttgttgatgtgaaaaacacacactggcctggaagatctgcttaacttcagtgcaggtccaaaatcttgcttttagattcatgagcgtgccagttaatttgatcctgcaatcaacaagaaagaaagacaaaagaaaccgtggttaaattcataaacgatagccaatcggccagccgccgatgacatatcatttattctcgagccgatgtcatatgtgaattgatcggcagttattgatattaatgctatataatccttctgtcgacgtatatttaaaccaagtgattgggtgtaacgtcccgcctctcacaggccgagcccgcttatatctggcagctttcataggtcatagactgcctcacagaccaacacaagtcttttctgcacactttgtcctcactcatgaggactcgggaagaatcggtcacccatccctaaattgcttcaggccaagcacgcttaaccttggagttctttagagatcggcttccggaaaagaagttgcaacttgttgatatgagtattctattaatcctattaagccctagtccgagatgtcacattgggatagatcggtcgccatgccgagacaatataaatcacttagattgaatatacattaacataaagattataaacgcttatagcatagccgatcagatagatctagcatgtatcggccagtactccgataccactctatgttaatatattaaaacagatagaatatatcaaacagaagcctaatatactttattgcgataagatcttaatataaagggcagacttagcatatcaattaagcatataaaacataaagctaaattaggtaagatcggctgagaccccgatactatctctctcgatgatcataaaacaagccagatatcacaattataaatattacttaatagatcgaacctaaccgatgcagcattaagcataaagataagtatgagatctaggcaggatgatgaaaacctacaagagatggtagatacacgatgcaatctagattaataacaaaatataactctaccgattgcttcctaacaataagaaccagccgataacaagttatatatagtataactaacagaaattgcaacatgtatatcataacttgacgaattacgtaaacagggtgaaagtatcataaagatggaagcattaaccccgagaacgcaagccgccataacaagttttacctctagttgaagatcgaatctatgcagctcaacccgaaagcaagaactcgtcgaaataaacgaaagtaaaagggtggcgatgtgctgagattgtattgaacgattgttaattgattacatgggttcgggtcatatttatacctgagatacaaaatatgtccttgccggaaaacctcatgaaatatcctaacaaactctaagataccataagtctttgcggcagacttttgcccaaacatatctataaggaaattacatgaaatatcctaattaatagatacagttgccttatccgagagctttatctccatcgtggaaatcctcatgaagcactttgaacgattttggaaacagctttgaaaccatcttcatcggaatcggctgcatcacctccatcggctgtatcggctgtcttttgtccgatccatctcagctgatgcatactccagctgatgccttcgcaggcgatgcatactctgctctttgaatcgatatttttatcgaatctgcctcgatcccaatgtcgaacctggttcacatcttaccaaatttggtcgtcaacagtcttaggcccacaaactctttgaaataccagaaaatgggcccaaccatcatgccactgggctgaggatccattaaatgtggtccaaatggtaggactgggccagggaggcctgcctggggaggcctaccgggggtcgaccgaccccggcctagctccgctggcctaggcccaagccaatgatggttgtaactgacgttccaatggcggttatactggaattaatggcctcaaccgtcattctcaagctataaaaggacttctcatccttcattccaacacacaccaagttgagctaaattacaatatgctctattgtatcttttattgtatcttttaccctatacttagaatagggagagagtgaaggaggatatccatgatcgataaaatagtcacgcactactagaaaaagcatttttcccgacatggggtctttttttcgcaagcggacatgacccttggagttaaatgaccgcctacaaaaatataaatcggggtgaagttcgctcggaccacttaagcggcgattttcgtaggcggtccacctaagcggagcctgcgaaaatctattttcgcaggcgcaccttatgtggtccgcctgcaaaaatcgtacctacccaaaaaaataaaaaaactttaatacttatctactcctccaacccctccccacaactcatttccccacacttatcttctcaactctctctctctccctccactggcttctcagctccccctcccctcccctccctccctccaccggcgatagcggcggcgtcggcgcgcggactcggcggcggctcctcggcatcccgtcccagatccgactgcagggaggccgggggaggtcgacggcggtggcggngacgtggttcccggcctcccctcccagatccggctggagggaggccgggggagggcagcagcggcggcggtgacgtggacggctcccctccggcgacggctccccggctgtcacaccccgaagttttcctccctagccaaattttaattttataaatgaccctaagaaaatgttggtgaaatcaggagaaaaccctaagaaaataatgcaattaataatcggatttgacatgtggaatttttcttgagttctacatgtcgaaattcattaacaggatttttagtggaattttcagagctctagaaataattttaaccaattaaaatggagcaagtgcaattttaattccagggaaattcctttttctttttctttttctttttcccctctttttcctcctttttgcgaaatgggccgtcggcccatttcctttttctcccccccctcctccttgctgggccggccgcaggccgaggcccagcccaatagccggccgcccgcctccctcctctcggggtcgccgacaggtggggcccacctgtcggtcccgtctccctcctcccgccgatctcgctcgcgccgccgcgccgaaaccgccgccgcgccctcgtctccgcctctcccgggccacgtcggccacgtccgcgcgtgcgccgagtcgtccgcgcctttccccctctccctcccgttcgcgcccgcgcccgagatggccgggattcgaaaatcgaatcccgcctctctctcctccccactcccccacgtcggccggcgaatcccgccgctcccggccacgtccggctccctctccccctttttaagcatcgccgttctcctctctctctttttccccatttcgccgcactctcccgagctctccatcgcctccgcgccgtgcaaccacccgccgccgccgcttttgctactccggccgccgctagccgccgctaggctcgccgccgtcccgcgccgtcgccgccgttagcttcgcgcggccgagatccacctcgtccgcccctcctccgtcgaggttcgtcgccggagccctctccccacgcgcacgggtgagcgccgcctttgccgccgccttcggccatggattccggtcgccgtggtctatctccctctctctaatccctctctttttcgtccttagggcacgccggagctcgtccgctagccgccgccgttctcccgtggttcgccgtcgccgtccgccatcgtcttcccgcgcgccggccaccctcggtgaggcatctcctctcctctccctccccgtttccccgtgcgtcgccgccgcccgcgctcgccgtcgctttgggtcgttgccgccgtccgctgccgccgcctccgcgtcgcctccaccgccggatgccgtcgccggcgccgcgacgcgcgcgcgccgccgtcgctagccccgggtcggccggtcggttttgacgccgacccgagcccgagggctgccgccgccgccgtccgtccgatcggcccgagggcgatccgggccgtcggatcggccgccacgtggcgtcgccgcccctcctctctctcccccgtgtcgctgaccggtgggccccgcatgtcggcgccgcgccgccccgcgctgacgtcagccctggttgatattgcgcaataattcatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatcccgccgacgctccggtgtacttcgagatagtcgccgaggtccctccagcagcagagcaaggcaagtcatgcttgtcacttgaacatgttgatcctatattgcaaatgctctattgtttcctttcaaatattgcattgttttataatattactatgggatggttacctattgttatagccatgcttttggatatcatgctcctttgttagcttgggttataacctgattagagttaggactagggtttgcttagccatgcttagttcaactagcacacattggggaatctcatttaaaacctagactataggtgataatgttggtttaataccaccgctccggtgttggttaaataaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctggtcagagtaaaactattcgaatagccgtgctcgcggttatgggcggtcaaccagattcaccgtgattagtctcaccttagtataatcctttaatttgtatagcataggtggatggttgggcctgttgcaacgtggtgtagcgttgaacagtggatgattaatactgctaaattattacaactgttttcgcattcaaattcttgtttataaatgccagtatttatgcaaatgaacctgtttagctatcccttgttgaatccatgcatcataccctccattccagtatgacttgctgagtacagtgggtagtactcagccttgctctacttttcccaacctccagagttcgagttcgggtcagatgaaggtttctctgaggagtaggcttcgtccgtgccgtcgaggatgcctgtggggtggtgttcccgctgcagcttagtcaaggcttagcttcagtttctttgttttccgctgcatttatgtaagactttatgatgtttgtaagacgtggatctgtatgtcaacattgtcgtttgtgtacccggctggtcctggacggggattttaatgcacattctgcttgggattccattcgggaatttctgggcgtgacaagttggtatcagagccgactttgaccgtaggacaagccaaatggaaaaacctaagagccctctgaatccttttcattgcatatgctctttgcaattggatttgttccgggaaaattgggatctgttcttgtggttcaagggaaaaatcttggtcgctcgtttaagtgagatttttcaaaacgagtcagtctagggttttagtaaaattattgggatttattcgtcagtcagttgaggtttgaggggtgaaatgcattaggtcctagctcaggaacttgggttgccaggtatttatgctttgttcgttattattattatgtatctaatttctcattatttcatcgtcatgtgagtctgtcttatttattcgctctcatgtaaaatgatctatgcataaaattttgctcttatttgatttcccttatttgagtcttttattgctttatttaaatttggatttgagcatgcattgatcctactcctttgtcttctctagatggccggtcacccacccaaccaccgcggagaaggcatgatcgatttcgtggcagagttggcacgcatgacattggtggtgggctaccccgacgcgccggagtacacgaccatcccaccgctcagtggcgagcttcctcaccgtgtccgcttggaggtccatggttacgtggggacttgcctcgctaacatggcggtcgaggcgtcaggaggcacagcagatcatgcctgtcaggaggcagcctacctgatgatggccagactacgggagcgccacaactacatcttccacgacacggcgtaccgctaccaccccagtcgagcccacggtgatggcgtcagctccttccgtccgacagctggcgagaacgacaccaccttcggtcacatgtgcgcggtgatgaggggtctggacaggatgcactcggatctgcacaaggcgactaaggccttgaatgatgggaagctcatgaggatcgtcgctttgaaggacgagatagcgcgtctgaagaaggagaacgctcagcttaagggtctcccagcgccaggaggagtccggatccgcactacgccccgcaagactacgaaggcacccgtgcgcatccagctcgcgcccaggaacccacctccagcagcagctcccgcagcacctccagttccgcccgcagctcctgcagctccagttcctgcagctccagctccagctcccgcgttcgttctctccttcgccccagcgtcagccgtcagaggtccagccagtggcatcgggggttggttgcctgctacccccagtggcagccgcgatcgcagctccagtggctcgcagacgggcagcagcgagacgtacctgccaggctccaggagtcgttcagagggacctggtgatgaacaggaggacgctttcgactccaccgaccgcaggagccgttccgagcattaggctcgtttccccttagttcagcgactgtctagtttctgcttgttagtttgtgtgtttaggttgcttgtttggggtcagtcgacggtcgatgtcatgtgcctatgatatgactgtcttaataaggatatttgcttgctcttttaagtgtttttaattcagatcagaacaattacagttttaattcctttgtaataaagtttagttcctgagtatctgtttttcttcttttccccgtctgctcttccctccagatggtcaacaccaggactggcaaccgcacgacaggcgagggcagcaacggtgaagaacgcgttgatggtatgcaccccaacggcgatcccggcaacggtccgccaccacttcccgagaatccgacacttgcccaagttatggcgcatcagactcagatgatggcagccatgatgcagcagatgcagcaacagcaccagcagatgcaccagaggatgatgcagtacgctgaacagcagcaccagcagtttggtccccctccccctcagtccaagttgcctgagttcctacgagtcaggccacccaccttctctagcaccaccaaccctatggaggcaaacgactggctccatgcaatagagaagaagctgaatctcctgcagtgcaatgatcaggagaaggtcgctttcgccacacaccagcttcagggtcctgcgtcagcttggtgggacaaccacatggccacccgcccaccgggtacggaagtcacctgggcagagttctgccgtagcttcaggaaggcacaggtgccagatggggtcgtggcacaaaagaagagggaatttcgcgcactccatcagggcaacaggacggtgacagagtacctccacgagttcaatcgcctcgcgcgatatgcaccagaggatgtccgcaccgacgccgagaagcaggagaagttcatggcgggcctggatgacgaactgaccaaccaactgatatctggggactacgccgactttgagaggctagtcgacaaggcaattcgtcaagaggaccaacgcaacaagatggacaggaagaggaaggccgctcagttcagggcacatcagggaagtcaccagaggccgcgtttcactcccggacagcagggtggacctaccaccatgatcgtccgtcagcaccgcccgttcaaccctagcaacttccaccagggcaccagtggcagtcagaaccaccatggaggtcagcccaaccgcggtgcagctccacgcccaccaatggccccggcacagtcaggccagcccacgcaagccaagaaggagactggagcaaaaccagggtcctgcttcaactgtggcgagcttggtcacttcgcggacaaatgcccgaagcccaggcgtgccgggccaaggtttatccaggctcgtgtcaaccacgcatctgcggaggaggcacaagcagcaccagaggtcgtactgggtacgtttcctgttaactcaatccctgcaacagtactttttgattctggtgcaacgcattcgttcatctcaaagaaatttgtcgggatgcatgggttaataagagaagaacttagcacaccgatgcgggttcataccccagggaatagctccacttcggttcaattcagcccttctataacaatagaaatccaaagatcaccatttctagccaacctcatccttctcgactccaaaggcctagatgtcatcctcgggatggattggctgactaagtttaagggagtcatcgattgtgcgaatcgcacagtcaccttaaccaacgagaagggagaaaccgtggtgtacaaatccctagtctcgccaaggaaaggggtctcgttgaatcagattgagacagaaatcccagtggacaccgtagagaagaactcgagaaaattggatgatatacccatagtctgcgagtatccggaagtgttccccgaagacctcactaccatgccacccaagagagagattgaattccggattgacttggcaccgggaaccgctccaatctataagagaccgtacagaatggcggccaacgaattagcggaggtcaagaagcaagttgatgaacagctgcagaaagggtacatacgaccaagcacttcgccttggggcgctccggtcatttttgtggagaaaaaagataagacgaagaggatgtgcgtcgattatcgcgcacttaacgaggtcacaatcaagaataaatatcctttgccgcggatcgacgatttatttgatcaactgaaaggggctaaagtgttttctaagatagacctgcgctcaggctaccaccagttgagaatccgggaagaggatatcccgaagacggccttcaccacgcggtacgggctatatgagtgcacggttatgtccttcggacttaccaacgcacccgcattcttcatgaatctgatgaacaaagtgttcatggaatttctggacaagtttgttgtggtgttcatcgacgacattttgatctattcaaagtccgaggaagaacatgaacaacatctccgtctggtactcgagaagttgaaggagcaccaactatacgccaagttcagcaagtgtgacttctggttgacggaagttaaatttctgggtcatgtcattacagcccagggtgtggcagtcgacccatcgaacgtggagtcagttaccaagtggaccccaccgaagaccgtgtcgcagattcgaagttttctaggattggccggttattaccgccgattcatcgaaaacttctccagaatcgcccgacccatgactcagttgcttaagaaagatgagaagtttaaatggacagctgagtgcgataagagttttgaggagctcaagaagaaattagtatccgcaccggttttgattctgcccgaccagatgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggacctaaaccttcgacaacgaagatggttggagctaatcaaagactatgacatgagtattcactaccacccgggtaaagccaatgtggtggcagacgctttaagccggaaaagttactgcactgccctatgcaccgagggcatgtgtgaggaattgcggcaggagtttgaacatctcaacataggaattgttgaacacgggttcgtagccgctctggaggcacggccgacgctcgtggatcaagttagagccgctcaagtaaatgacccggaaatagcagagctgaaaaagaacatgagagtcggaaaggctcgggatttccttgaggatgagcatggcacaatctggatgggagaaagattgtgtgtacctgacgacaaggaattgaaggatctgatactcaccgaggctcatcagacccagtactccattcaccccggcagcaccaaaatgtatcaagatctcaaagaaaagttttggtgggtcagcatgaggagagaaatagctgagttcgtcgcactctgcgatgtttgccaacgagtgaaggcagagcaccaaagaccagcaggtctactccaacctcttcaaatcccggaatggaaatgggaagagattggaatggattttataacgggactgccccggacatcatcgggacatgattcaatctgggtagtcgtggatcgactcaccaaggtggctcacttcataccagtacataccacctatacgggaaagagattggcagagttgtacctcgcaaggatcatgtgtttgcatggggtacccaggaagatagtatctgaccgagggagtcagttcacctcaaaattctggcagaagttgcaggaagaattggggacccgtttaaatttcagcacggcctatcatccgcaaactgacggtcaaaccgagcgagtaaatcaaatcttggaagatatgttgagagcatgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgagcgtcaactgttcggaacagaagtattagcagaagcagaagagaaagtcagaatcatcagggaaaggttgaggattgcccagtctcgacagaagagctacgcggataaccgtcgaagggagctcacctttgaggcaggagattacgtgtatcttcgtgtcactccgctccggggagtacaccgttttcagacgaaaggcaagttggcaccacgcttcgtgggaccatacaaaattttggaacgaaggggagaagttgcctaccagctagaacttccgtccaacatgatcggcatccatgacgtgttccacgtatcccaattaaagaagtgcttaagggtacctgaggaacaggctgattcggaacacatcgatatccaggaggacctgacctatgtggagaagccggttcgcatacttgataccagcgaaaggaggaccagaaacaaggtcaccaggttttgccgagttcaatggagtcatcatccgaagaggaagcaacctgggaaagggaagatgagttgaaagccgcccagtcgcacctcttcaccagcttcttcgaatctcgggcccaagattccgtttaaaggggggtaggtttgtcacaccccgaagttttcctccctagccaaattttaattttataaatgaccctaaaaaaatgttggtgaaatcaggagaaaaccctaagaaaataatgcaattaataatcggatttgacatgtggaatttttcttgagttctacatgtcgaaattcattaacaggatttttagtggaattttcagagctctagaaataattttaaccaattaaaatggagcaagtgcaattttaattccagggaaattcctttttctttttctttttctttttcccctctttttcctcctttttgcgaaatgggccgtcggcccatttcctttttctcccccccctcctccttgctgggccggccgcaggccgaggcccagcccaatagccggccgcccgcctccctcctctcggggtcgccgacaggtggggcccacctgtcggcccgttttcctccctcccgccgatcttcgctcgcgccgccgcgccgaaaccgccgccgcgccctcgtctccgcctctcccgggccacgtcggccacgtccgcgcgtgcgcc

SEQ ID NO: 82139 - DNA, 1412 bp, Oryza sativa
ctctagactttgggaatattctcatcacctggacactatggaatggttggattattgtggaattggattcacacctccccctctattcaaaatcctcaaaatggatttaggctgggctcggggcgcttggttttgatagtagcgcctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataacctattcgaatagccgcgccctcggttatggacaagccgagcaatgtacccaagttagtgttttaattcttaaaacctgcttaacaactaaaatgtggaatggttggcctgggttggcttgggacgagctgggacccagggtcgagttgacggttcggtccgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtaatctgtcttgctcaatttttcccaaacccagaagaggagcccctagaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaagtggtgtaacatcccggcctagggcttaataggattaatagaatactcatatcaacaagttgcaacttcttttccggaagtcactctccaaagaactccagggttaagcctgcttggcctggagcaatttgggatgggtgaccgaccggggggctgcagga

SEQ ID NO: 82140 - DNA, 10763 bp, Oryza sativa
cagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggataagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtcgatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctagtactctgtactagatgcattctagtattagatgtgagcatatatatatatatatatatatatatatagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctatactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcaccaaccaaacaggcccgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacatttttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagaccacttaagcatataaaccagcagaagaaccagggttagtcagaccggataggatgttttttttcttctgaaaaataggctgagaggacacattacacatctatctatctattctattattaaaacagctttgaaaggaggcaccacgttcgcttttgggggctaataattcccacattaatcagagaaaaaaaaagaaaatgagagtccaagtagaaatacaatctaaaaatagttattaaaacagctttgaaaggaggcaccacgttcgctgtgggggcaaaaaattcccacatcaatcggagaaaaagaaaaaaaaagaaaaggagagtccaagtagaaatacaatctaaaaatagctgaaattcggaattaaaactaagcaatattgaaagaagtttccatataacaacctaatacgagattaatcaaaatttgaaataaaaataaaataaaatccaaaattataaaaggaaaggagagtccaagtaggaatacagtttaaaaatagttgaaattcggaattaaaaataagcaatattgaaagaagagtccatataagaacccaatacgagattaatcaaaatttggaataaaaataaaataaatccaaaattagcaaaagaaaataaatagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagct

SEQ ID NO: 82141 - DNA, 8003 bp, Oryza sativa
  unsure (1)..(8003): unsure at all n locations
aaaataagcaatattgaaagaagtttccatataagaacccaatacgagattaatcaaaattcgaaataaaaataaaataaaatccaaaattagggaaaaaaaagagagtccaagtagaaatacaatttaaaaataggtgaaattcagaattaaaaataagtaacgttgaaagaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaacaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataatttcgaaacaactgaaatttaaaataaaaaataaaaacattaaaagaacatattggtattaactatttttttaaaaagaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagctgatgggcatcaatcccagggatttccgtgagttttttatgccaaccaaaaacactaaccattcaaaaatcagagttttttttaccgctttgttagctgatatttgctcggtgctttggaccacaagaaacaacatgatatttagatcgaaattggtttatttcccaccaatattaactttacaaatcatttttaatttggtgcactgaaaagttctttatcgcgctgaggaggtcgagatgatagacctgatgactgataagatgaaaagggtgatctcactgctttgagagatcagagaactgggattggctaaatcttctttttttttctttgtgctggcaagctagctaatattgagatgttctcttgctcaagttccttgttgcaaagtgcaaacaagtttgtatgggccaagagaggttgagagttttcttgtgtgggcaggcttgtgaagctgttgccacttggttgctaagactcctttttttgtaaaatgggtttttagacaaaaggtacatatataggccccgcttacattgaaagccatcacggcagcaaggagtacattcgttaagaactaattcaggaggttagtcatcagcactccttgtctagtcatcagaagtagtggcggcagtcggactctccccagcagcagaactatggccatcctgcagctccagcgcccgcctaaggagtccaataagcatgtcagaaaattctgagagcaacgataaacatggactacaattaaatgttatttggaacctcagaatcagtaatccacagttgtttggaaacacagtaaagtttcaaactatggatctatcaaatacacatgccattttgccaaagcacatgaaatctgttggatgacataaaatggataaaagacactagctggtcagtctgcttcatcaggatactagtttaccatgacaaaaccatccggctagaaaatcagatagcaacatttaacatgaaacaactaacatgttatttgaaacatcggaactagcaatctagctgcaatggtttgaaactggagtggattttgatccctggagtggatatcccctcgttgcttgcatatcactcaaatagttatgacnatgctctaactaaataaatagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggttgggtgtgccagtcaggccggcgtgtattggcgcggtcagaccggcgcagcccgcggtctgaccggccgacgctgtgtcggtttcggtttcgggttgtttctttggatatccgtgattgttttatggttatggcttctagatggatattatacgtatgtaatactgttgtttgctactaatgagtcaagttggagatagcttggtttcggaatatggtttctttgtttgtttcatgtgtaagtgactcgatgcctcgagagagtatttgcggtgatggactgggagttggcttggtggtaagacgatgtccgtggtggtcaaacatcatgtaggatactaaggctagagttgatgcacgtggttgatggagatttcatatggcatacgatggaggtattgtgtgcgtatgggatgcggagtcgaatttggaaggagtccaaattttgtaaggagtgatgttggtgcactttgtaaacacagagagaagcaataaagttgtcatctactttgagagttcttcgatttgtgtttcaccgggtttcggcagtctaaccggcatctcagcggcggtcagaccggcggcggcgacagcaagcgacagctgatcaggcggtcagaccagagtttcatctcggtcaaaccggtggctttcagacggtcagaccggacgactacctcggtcagaccgcgatccatcgatttcgagggtaacttttatttccgctaaaagtttttggtttttgggtatctcaaccattcaccccccctttggttggcttagttcttgtgattcaatcctacaagtggtatcaaagctttgtttgcttctttggattttaaccgatctagagtttttgccatggctgcttctaataagtttttaactaagcctcatgttttcgatggaacggatttttctcattggtgtagtaggatgcaatcttacattatggctgagaattatgatatttggagaaaagtttctcttccttgtgtgattcctgaagctattaatactgctgctgaaaaaactgcttttgaactaaattgcaaagctcgcaatattcttttgagtgggatttctcgttcggattatgatcgtgttgctcatcttcaaactgctcatgagatttgggttgctttgaataatttttatcaaggtacaaataacattaaagaacttcgtcgtgatcttttcaaaaagaagtacattaaatttgagatgaaacctggagaagctttggatgactatctttctaggtttaataaaatttagagtgatcttagatcttttgattcttcttatgatgctaattatccacaatctgagatttctcgtcactttttgattggtcttgacatgtctatttgggagatgaaagttacacctattcaggagtttgtgaacatgtctactttgactttggattcgctttacacaaaactgaaaactcatgagatgaatattcgttctcgtaaaggtgattctaagtctaggtgctttggtttcgtcttcaacttctttgaatgttggtacttcttcatcgaagtcttttgttcttgctttatttaatgccatgtccgatgatcaactcgaacagttcgaggaggacgacttggttttgctatctacacaaattttctcgagctatggaaaatgttaggaacaggaaaagaggagaaccgaatcgttgttttgtgtgtggtgcacttgatcatcttcgctcgtattgtcctaagcttgggagaggcaagaaggaagatgatggtagagttaaagaggatgacgtgaacaagaagaagaacatgaaggagaaggagaagaagaagcattgcatgcagtggttaattcaagaactcataaaagttttttatggatctaaagatgaagatgagggcaaatgtaagcaatttgttgatctagcttttattgctcgtaatgaaagttctcatgttgatgaatctgatgatgataatgaagaaaagcatagttatgatcaattagaacttgctgcttacaaatttgctaaaaaaactttaaacatgttctattgtgcttgatgagaaggatcacactattgagattttaaatgctgaaattgatagattaaaatcttcgattcctgatgatgataattgtcagtcttgtgaagttttattttctgaaattaatgctttgcgagatgtcaattctgttaattgcaaaaaattagaatttgagattgaaaaatctaaaaaattggaatcttcttttgctcttgggtttgctttacatgcttgtgttgttgatgagttgattttgacaaagaatgttttgaaaaaatacaaagttgctttttgtgcaagttctttggcgaatgcttcatgtgcaaataaggcaaaacaaaacaatggtgttttgatttctgaagattgttcaaagtgtgttttgaatgagatgaagttgaaagatgctttagggcgtgttaaacacatggaggaaattgttaaacaagatgaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatctaaggttagcacacacaatcatggtttaggttttgatccttatgctcataattctagacatcctcctactgttttgggtgttgctaggagaggtgaaattttgattgaatcagagcctaagaacactgtgtttaaatctgttggcatcatgtcttctttgaatacatcttcttcgaaatcaaatgttgtgaatgcaaaaccttctgttgttgcaaaaccatctacttcacaaacttgtcgtgagaagtacacttgttctttttgtggaaaagatggacatttggttggtttttgttttagacttgcccataaacagaaaaaggaaagagaaattgcttttgcaaaacgacattggcaaaaatcgggttttaattcgaggaccacggttagaccgacactgaccagtcggtcagaccggccagcggtcagaccgcaggtaaaccggcggtcagaccggttgctaggctcggtcagaccacaggcacagtggcggtcagaccggcctcggggcaattttgtgcgaaattcaactcagacttttgtgaagcaaaaaggtaagttttttggtaagtctgattctgattttgtaagtgtgtatgtacctactggttctagtggtcgtgtgactcagtgttggattccaaaatttcttatttctaaccccaacacggaggtctcgacatcttctcgttcgtaggtattttggcggcatactccccatgtgcatttaactttgagatgacgattgtatagcaaggtaacatcactttacttttggattgacataattttggtctattctcttgtttattagctttttcatgtgctaatgtttgaggtagtagtttttgttaatactattggatgtatgtcaattcttgagaattttggtgatatcgttggcaattggatgtctttttcaaaatctttgattttttcttgatttttgttcgggaagaattggaggttattttgagggggagttagtgctttttatgactttcttttggcatgttttgagggggagtttgtacctcatggttttatcaagcaaaaatatgacaatgaaaaaattgataaaagagagctttgtttatacatatggtattttcttgtgtatgctagtaatattttgaaggtttatttgtctctagcataacttgtatgtattctagtcttttcatgagatttagtttttgcttttaagggagatgatgcatgacacttaaattctatacttgaattaagaaaatatgtaatgttgaagctagcatctggtttgatttataaatgctctatttatatgctttattgaattgttattccttaaatagctttaattgctcattgtgaaaaagagaataaaaaatatgaaaaaaatgaataccgaattcttggaaacagtcttgacgacaaggacgtattcgatgtgagcaaaataatgggtgccgaatccctggaaacagtcttgacgacagggacgtacccggaataaaaaagaaaaatatgagcaaaaaggcttaagaaaagagaaagttcaaaaaaaaattctcttggttgttttgtgctaaaggttatttgagaaaga

SEQ ID NO: 82142 - DNA, 2373 bp, Oryza sativa
tatcggcagccttaccctgagtggtttgaaagagttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagctgaacttatctgacttgacgacgattaagcagcggcatgatgaacctgtgcacgagtatattcagagattcagggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattccaaaaagccgatgaaggtcgatggtaatccttttcctgttaatatggtgcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacggcactgattaacatggtctttaccttgccagccgatttcgggattgatcaagccgatgtcgacgaggtggaagaggaatcggctaagttggttctatcaccagaacaggcagtgtttgagaaacccgaggggacagagaatcggcatcttaaaccgttgtatataaatggctacgtcaatgggaggccgatgtctaaaatgatggttgatggtggggctacggtaaatttgatgccttatgctacgttcaggaagttgggtagaaatgccgaggatctcatcaagacaaatatggcactcaaagactttggtggtaatccatcggaaaccaaaggtgttctaaatgtggagctgacagtcggcagtaagactattcctactacgttttttgtcatcgatgggaagggttcttacagtttgttgctcggaagggattggattcacaccaattgttgcattccttcgactatgcaccaatgcttaattcagtggcaaggcgacaaaatagagatcgtaccagtcgacatgtcagttaatgttgccagtgccgatttaggtctttgggagatggatggccttgattgtttatctggaaaggtttgggatggagattttctaaagagtaaagtccatcaccggtccctaaacttgtaccgctgtgtcatcctggtccctaaactcgcaaatcgactattcatgtcctcaaacttgttcgactgtgtcatcccgatccctaaacttatagatcactcgtttaggtcctccaacttgttcagttgtgccacctcggcccctaaatttggatttgaatatcatctgggtcaaataggacggtctaa

SEQ ID NO: 82143 - DNA, 16649 bp, Oryza sativa
gggatcctcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtgattgggacataatagtgtggatctatctccaatgctttctgggcctcttgtaacttctcttcaaaggagtcaacacttccaatattgaagtaatacttgtagctgctaggagactctatcccaggaagatgacttgtagttatatggatatcactatcctgaattcgatcaattgaaggtgaactcctgacgtaaaccttagcaattgacttgtttgaaacaacaatgtggtcaactaaaccaggttccaacaacttattcttgaattcttggaagcttatctgaaaagaattacaattaagtgggtatcacaagttataatggactaggaaatgaatgtatgtgtcgcacagaaaaagaaactggtagggaactgaagtgtggatatatgatatagttatacaggattagatgattaataggatgtagaataccaaccatattgcatttcataccaacatggcactaacaacatacgaagctcatgctaaaatgccctatatcaaactcttaggataggatatgatatgccatcagtaatgaagtactgtagctagggtcacatgctgcaccaaataatcacattaatgctctcgagcaaaagcataccatctccatcagtacaactatgtgatttaaatcttttcagtcaaccataacttcagtcatactccctctgtttacatttgcttgtcaccattaaccggtgctgttacaactttgaccacaacttttttaaaaatatatatatatatcatgttttgatgaatgaaaacagtatgatcatatttagcatgtaatataatttcataatatagtactccctctgtctctaaatttaaggaattctggctataaatatatggatctggacatgcacgtgtccagattcatagctagaatcccttacatctagggatggagggagtatacttttaaatatttacaagtttcttgataaaatatgagaagtcaaacttaggatatgaatagtatagtgaaaattatttaggaatggaggggggcagctaattaattatcatcaattgtgttatgtacaaataaaacataaactaaggactacatgtgaaagcataatttttttttccttaccactttgctaggccagcgaaaccaccaaatatttttttcaagataaaaaaagtaaccttatatataacctcatatcacctctctaattggactgcagcaaaatgaacactgacaaaatttatataccacacagaattggaatgattcttttctgaaatttataaggctgaccaaaggcgaggaccttcagtaaagtaaatggggattttgataacagctatcttctatccacaagtgtgaacaggtaaaatgacaatgaaacacacaagccactactgttgctcatgtttaacagtcggtttttcagtaggaacagacctcctgctctgatgaagatgctgatgcagataacaataataggccaaaaaggaataaaggagcaatcatgtccttgaattgtttaatgctctcctcgaaattccattgatcacctgaactggattgctctgcacaccagaaatgaccacattaagtatgtggtttgcagtataatgctatatacggatgcatcaaactttacaaattgtacgcaaccaacttgctttgggctaaaggctcatgttgtcgtattccacaatactcatgctagtacctctcccttaaaggtgagcgggcagtttatgaggcactaaaactcaaatattagcattttcagctatacatgatacttacatactgttaggggtatttgtgcaataaaataaaacatcaactagccccactctgtttaacatgtattgccacttacaaaagctctgcatatcatcttcttaacattgttttctattatcagtatactaaaactagaaatcacaagttatgatatagcatgattttagggcagcactcggaaggttaagtcgccactggtatgtaaaagtctactctctttcaaaatattttgcaaagctcaacaccttaataaaccatatccaacacaagagcgaggaatgcaggttaaaataagcacttactctttgagtcggacttgtcactctcatcccctttacctttattctcctcctccgaatgcttcccgtggtctgaataaaaaaggcaacgttaaatattaacagagtcaccagatatccccaaaaaccacctaaccagccagaaagcttacttttcttcgacttgtcggagaatagccgccggaactgccggctagcaagcaggaacctccagtccccacccttccctgccccggaggccaccgctgcccgattcccgataactgacgtcacatagctgcgcagaaaacccaactcgccgcagggcagcggcggcgacgaagcacggagcccgccatgccccccgagcagagaaccctacggcaacgacatccgcacacgccgcccgagccattagggcgaggacgcgcaggaagaagccacaccaatcggagaggggaaggggagggggtgcggctcgggcactcacctggcgctgccgggaggagcgcgcggaccgggcgagggcgcgggagagggaggagaggctcatggcggcggcggcggcgagcgcattggacggagatcgaggcgggggcgggccgtattagggttttgatcccgcccgcgctccgcgtgcgtgatcgatcgaaactagccggtaaagtgtactgtgcccccgttttctcgcggagagagcgacgaaccgacgagacgaggtcacgagggacgcggttgatggtggcggcggagagggctcaagggaaatttgttggtgtcgatgaaagggcaggtggacacgcggcaagggattgccaccaatctggagacagttcggagcttccgctgccagtatgggtccatgggccaccctgttggataggccacgatattggaccgctaccaaactggtccatcacgatatataaatgaggaataggttcattttaggtaccttaacttaacagtgagtttgattttcgtcctttcaaaccacaatatttttctacaaatttcatcgaatttttaaaaaattgactataaaaagaatcaaatgatttataatatgaaacagagggagtagtagctagcaacaaccaaattagtttgattggtaatgaaaaatatcaaaccaaatatgcgtttgataccagcaatgtacacatttagcctccaaattaagtggcaaactagtatatttctaatattcatcaggtattagcaattaagttcgttagttgtgcaacctgtttatagctagctcggtggtctttccagcgtcgggcgaaccccacaagttgtattcttttttcgtagctacgttcagatcctttgacctgtccactacttatacgtatccatcagtaactaattacaccttgcaagtagatatccagtactgtactatcgagtcatcttcccaagtcaactccccactcacttcagctacagaaacagtgtttcctgggaccacggccagtccaggcacgaccatatggtcggcggcgagtcagaggacagcgccgtagcggcgtcagcgcgcgccacggacgacgaggccgaggtcgagccgccgccgccgccatcgtcgcacgagcgatccgtcgcgacacgacgcggcgcggcgtgctccgcgtcgccacgtcgtcgtaactcggcgacgtcacacgacgtcccatcgtcttgtggccactctggccgtagccggccggcgccgtcgccgtcgtcctcggacgtcgtcggcgagaaggccgccctgacatagttcttcctcttccttgccgccgccgcgggcgacgacggcggcgggccagcgccggaggcggcggagaagcccactaccgacgtcggcggcggtggctgggcgatgtgcggcgggaagagcggctgcgggccgtgatggtgcgacccctcgtacgtgacgatgagcatctccgggtcatcggtggacttctcgacgtgcttcttggcgctgcatcgggagctggtgcacttgtagtaactcctgcattttcaccggagatgatgttaccattgccgtgatcctgcaaatttcggcttctctgaaaaagactgctcatctgaaaacatcgctgttgtgttcattagccgccgttttaatgcgatgcagatggatgttaattcttgcagttcggcgttcgtgtaattaattacgttttcggtgatgacgtgcacttggagattattcaacagcacagtgattcagactatatatggcatgtgcatgtatatgaaagcatgcgtgtcttcgcaccatcctgtatttctctgaacatgatctggaattaatgtctccggccgcttgcttccgctggtgtgccactacgccagtgaacaacctacctgcggcgcgcgctttcaaccccgcgtgcacagtgacactgattgactctagaactccacgtggtgctactagttgggccctgtttatttctcacccaaaaattttatatcgtatcgcatcgaacattttaacacctacgtaaaatattaaatatacataaaaaaaataactaattacacatattgcgactaatttacgagacgaatcttttgagactaattgctctatgatttgacaatgtgatgttacaagaaacatttgctaataacagattaattaggcaacaaatttgtctcgcgatttactgacggattctgaaattagttttttattagtgtccaaacaccccatccaacccatatataatacccgatgtaatacgctaaaactttacacccatggatttaaacacccccttactgatataatatatatatagctttaatttctctggaatctgaacacacgatctatcaatctatcatggttgttgtgaattaaaggctcctcacttctcaactgaaatgctagatcattcacatccacagagacagggcaatcaggaccgtgtccccccactcccccttaagacaataaggatatttaactctattttttaatatatgacatagttaacttttaataaatatttaatcaatagttttatttaaaaattttgtacaaatataaaaaaaatcattcttaaaaagtatttaacgataaatcaagtcacaataaaataaataataattgtataaacttttttgaatacgataaatagtcaaacgtatctaaaaagttaacgacatcatatattagaaaacgtagatagtaatttctttcgttagaaaaggtaagaaaattgaatggtcgaagcgaatgaactgctaagaccacaacatgctactcatcacatttgtgttagttacatgcaggatctcgtagtgtgcagtaggtacctaattaaagagtctcctaaacaaactccatcagttttaaaatacagaaactttcaacgtttgaatctggtttcaaaatataagaatatctagcacactattctagggagtacatactacttgtcctataaattattatttcccgttcaaatttcttcacatctctcactcccacctacccatacaccctacctatccatcatttatttattgtgggatttctatcttttcttgtctaccttaatatctgtccaataacctagaaatatttatatttacaaataaaggtagtagtaattattgagtactccctctgttttcgaataacatactgtagaaattttcaccaaaacacgtagatcatggtaacaaaatttataaccaaattgtcattggtagttatttggagatgattttaaagaatggataaagtggaggtggagggcaagaaatggatccaaaatagaagcacctagaagtttgctctatggtgaagattgatttatgttcacaagtatagctacggagagtagggtcaaaattaaaattctgctaataaaagtgtggtggtgataaaaatattttgaaacaaacgaattggaggaaaatgtcgttatttaaaaatggataaagtataaataaaaatagtatatcatccttttgttttgagaatgtttatatgctatttgacggaaaaacaccttacaaatcatgcaaatcctaaaccattggatcatattaagaatcgtgcaccatatttctaaccctaacccctcatttcttctattgtcattcccagcgcaaccgctgccactcgcaagcttgcatgcatgcgatgcctctgcctcagccccatgtgccgcagcccggccttgccggttggccgaatgaagtcaactgtgccggcaactcccccttcatcccgggccttctccccctcccacctctcttcccaagtcggcggcgcaagtgtccctgtctcgttgtcttccccgtcttcggcagctcctcgccgttggatccgtcaccactaatcatcgtctcctaaccataagctctggtttgcccccgtcatcaaggccaacccatcatcctcctccatctccgtggcttcgatgtggccgccgatgcctcacctccaactcgtgtctacctcccactgtcgggccgttgcctccgacatctctttaagcatggcgatgtccctcttctttgccctcccctaccaacctccaaccctaccacaatcaaaaactctaaaccctaacttcactaccttcatagaggttgctagagttggtaaagaaggtatcgtcggagctagaggagaaaaactccggtcttctgagcacgaatcacgaattaaatttcaaaatgggtaatatacgtgattataaaaagaatatcgccagccatttaaccatctttttttaatgtaagagtgttgcacggctaagcgttgacttccccgtctagggaattcgtcaatcccttgttctgcaccgtatgacactaatcgatctgtactgtacgattggcacacgtgtatacgtatacccgcgagtccttccaagtcccactcgcggaaacacgacacgtacacacgcgcgccgccgtgggcgatagcaggcggcggcgagccgcgcagctagccatattgttcatgcacggattgcacgcacaggcttgaccgcgcgcgctcctggcggcgtttttctctcgatttcgccatggtacggtgcagctgcaagcggctgcccccagcgctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtgagagaagatcctgtgctgccagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttttaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggttaagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtggatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccatcgatcttgctcgctgccactgccacatgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaaattttttctcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgtatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctaacactctgtactagatgcattctagtattagatgtgagcatatatatatatatatatatatatatatatatatatatagagagagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctgtactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcatcaaccaaacaggcacgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacattttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagacc

SEQ ID NO: 82144 - DNA, 3444 bp, Oryza sativa
gcgaccataggggcgcgggcgcgccgcctcccgtcggctgtgccggcgtggccgccttcgggcgtgccccgcggctgccgtgtggggcccggctgtcagccgcccgcgcccttaggtgcggctgacgcgtgggacccacggcgccggccggtgcgagcccgggtgcgcctggtccaccgtgggccgtggggctgccgcgtgggccccaccaccgtggacccggtccgcgcgcccctcccctcggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaatgccttttcttttctgttggtcgtgtagacgctgcagcttcggaagatccgctcttcgtggaggttgaagccggcgtttgggaaagcgagcaaggcaagtcacatcatccttgaacatattgaatcccagtttataaaattatgttgctttaaattattgcattatcgctttatttaaattcccgcgttatcactgttttatctagccatgcctatttagctttgttatgaccttattattgttattgttattatttccttgttcaccctagaataaacaaaaccccaactagtggacactctactcatggtaccactagtatgattttaggtagatgcttcgctatttaattaggtaacattaggtggttttacaactctagactttgggatattctcatcacctggacactatggaattgttggattattgtggaattggattcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataacctattcgaatagccgcgccctcggttatggacaagccgagcaatgtacccaagttagtgttttaattcttaaaacctgcttaacaactaaaatgtggaatggttggcctgggttggcttgggacgagctgggacccagggtcgagttgacggttcggtccgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtaatctgtcttgctcaatttttcccaaacccagaagaggagtctctggaagatgaaggctttggtgtctagctcgtgcctgccgtcaagcgcctgtggtcgtcgccctagtcttccgctgtttcccgtttgtttttgtgtgtgctggccttcgctgcccatgtaataaattaactatttacgcttccgctggttgaactctgaactgtatcaacttttggtgtaccttgcctcctgggacaaggattaatgcacgcacgtaaggaacgcccgttgggttatttccggtcgtgacaccgatcatgcattaacccaaatacttgggtaatatttcttcaaatatttgccattgagcgctcgcccatagacttcgccatcaagtccttgcaacatatatgcccccttagagacaatcttataaatttggaacggtccttctcaatttggcgaccacttgccgaatttactatcacgagtaccaatcggcaaaatcaatttccatacaagttcttcttctgaaaaatctttaggtaccactttcttattataatggcgagcaacacgttccttatccttggtaacctttgcaagggctcgcaaccgtgattgaaccagatcctccctctcatcggccataaggttgtaatactcatcggctgttaaatcgttttgcaactccgttcgtcgagagccgattctaacctcccacggcaaaacagcctcatgcccataaacaagtttgtaaggagggacttggatcgatccatgacaagccatcctataagaccataacgcttcggccaaccgagtatgccattgccgaggataatcagaaattttccgcttaatcaacttgatcaaacttttattagacgcctcggcttgcccattagcctgtgcatgataaggtgaagaattcaataatttgatacccatgctatcggcaaactgaacaaactcatcggacacgaagattgaaccctgatcggtagtaatagtttgagaaagaccaaatcggtatattatatgttcttgaacgaattgaatggcatccccagaatcaactttcttcgaaggaatcgcttggtaaaataatcggttaccaccaatataaacttatgtccttcacttgacggtgggttaatcatgccgatcatatcaatttcccatcctctgaatggccagggcttaataacaggattcatagccgacgccggcgctcgctatctttctcaataactttcatgtaataggcttgtctcgtgaccctgaccttgcttgtcatcgagatcaactaccgtatccttgggatagacgcttgaaccctccacgacgccctcaaagtaatagcttgggttctccatcttcgagtggctatatatcaaaatcggatacctttagaaaagagtaaagtccatcaccggtccctaaacttgtaccgatgtgtcatcccggtccttaaactcgcaaatcgaccgttcaggtcctcaaacttgttcgactgtgtcatcccggtccctaaacttgcagatcactcgtttaggtcctccaagttgttcagttgtgtcaccccgatccctaaacaggatagtctaaaaactttatatcaaaaaataattcataactttttcatgtgaactctaatgaagacaacctttatatca

SEQ ID NO: 82145 - DNA, 20290 bp, Oryza sativa
  unsure (1)..(20290): unsure at all n locations
ctctaaataaaaattcatggttattttattttattttacattgggaagcaaaagatcacaattgttttttttggtatgagtttattttattctgttttgtacctttgtaaaagattcaacaaaagccgtagcgaaaacagttccaaggttgaagaaacagaacatcgaattaacagacaaacaagaaagctggaattgatgtggtagacagtaccaactgccaaccaatatagattgcaatacccgagctgttgtgtctacgacccaattaagcaatgtctattagacggccggggcgccatcaatctgcatcatcacgctgctgtaaacctcgatcccaaaagtgtagacccgaccacgttgggcgccgttggccaagctccatcacccatccactgtgcagaacatggatgatacatttcatgcatatatcatcagcgagacgtacgaaagctcctggcacgtggcgacatgccgtgtaccaaaagagcaggcaatgacctcgactgcacatccggtcaccgaaccatatccatccacgcccatctaacttggggaagaaacgatgtgcatgtatcagcttatccaagtgagagcaagagactgtatcggcttacactactagaaaaatcatacagtaagaaatgattctgaatcttacatttttatatgaatatattataataaaatatccttcttaatgcgaaacggtacgacatccatacagtgcgtacaactactacaagttcaagggtggagaaacagacacgaacaagggagaagctgctagtacatacatattggccggtaattaatactccaatcatttaatatattcctactgtttcactaattacaaaatttaactattttcttgtatgatatgtcgtgaagtgtcacaagcaacctagaggcactgtcctctgcgggtattacgcgtgcgaattcctcacggttaatgggaggtacagggttaacgcagaggatgtaagtctctagactatggactagacagtatcacatatttatgatactaatatattgtttttctctaatgcatgcagttgccaagaatagaatttcgaacaagctttgacgatacaggcatcacaaatgtccagagcgatttgtgtcacttcatccaccgtgagtgctgtcatgtgtgaggagatttattcgtcccagagggtgccctagctacaagtgacgaattcaagcaactttgggagtagagtactgctatgccataatgtaattagatggcgtatttgaagtgacaatgtaaaaaaatattgtaatatatattttgacaacacttttcacttatgcaatatatgtagatttctcagtaccaaatgcttgttaattctaataatcttcctacatcaatttctattaaataattaaaaattaatttatgggcaaattattattgtatcaaatttcaaaattttctacccatcttcacaggcggatgtttttttttttgcaggcggccgctttctattttcgcaggcggacctgtctagctaacgtccaactgcgaaaattatcttcctaggaggacggccgtcccgcctgcgatcttcacagtcgttggcttacaggcggagccgccgtccacctgggaagacctgtttccaccgccggcgataatgctttttctagtagtgttatccacgttagtatcttttatttttcgtttttctttgacccctggcaacggtcttctgaccgtgtgtgtcatgtactcaaactctgttcttttcttctagtatattagcgtgtaatccatctgtgtgttcgtgaaaaatattggactgacacagcatgccaaaggacgtaggtatatgtcacaccctgaaaatcgctaaattataaattgttgtgaaaaaaagaatttttagaatttatttaataattaaagcaagtgtgtgaataaaatctatgaaaaatttgaacataaacttgagctagataaaattttattaaatactttgtatgcccaagtattttctggatttttcccagaattatttgagaattggaagtatttttaataaatgaaagatcatttcagcaattatttaaattaaaaagttaattaaaattcctcttctttgtttgggccgaattcagcccactcctctccctctctcttagctgaagtccactttttgtccctctagcaatcgggccaagcaagtaaggaaaaggaagcccatgaaaagtctactttacctcccctcgctacagtaccttcttcctcctccagccgagccgtacagagccgatccgtgtgcgtgcgccgccgcttccttcgcaaaatccgtcgcatcccgtgatccgtttccaaaattggttgcaaaaacggattcccctcgatctcctctaccttatccctaagaaacccctttgaataccgttgtatatcgcgtgaattcgacgcggtttcgagctccgtttttccggcgaactcggataaaccctcgtttttctctcgccaaatcccgttgtttttatccaacctcttcgcacaaatcctataaatagcagcccctcgacctcctcttccgtttccccctctttcccgaattttttccttaaccctagcctcctccccgcgagctccctctctctccacctccggtcgcctctccagccgccgtgcgccgtcgccccgcccgtccccggtcagccccgtcacctccctcggcttcgcaagggcgagagctaccccggccactccttcctttgcgccaaaccccaccggaattcgccgtcaccgtgaagccgatctaatctatctccggccgcgctgttcgtcgtcgtccatcgtcgccttcggtcgccgttgtttccattggattcgtagctgtgaggagaaactcgtccacccctccattgccgccgcccgtcgccggaaagccgtcaccatcgtcaaccctaggtcgccgccctatggagcttgtcgccggccatctccctcgccgtctgtcatcgcgtaagtggtggtaagggttgccttgatctcctctctctcccggtgccctccgtttgtgtcattgtattgtggttctctgataaccaccgttcccgtgctcaccggcgttgatcctgtatggcagccatgtcatcgctgacatcagcgccatcttggccatccaaaattaatataaatttgtcatctctttttaataacatattattcttttttaatatatgtcatctaccaaatatgatctaatcttttccggaggatgttttaatcttttgtctcagctataaatcatttgtaaattgtttaattaatttggaatagtctttttttaataggtttaattggaattaaatcttgtaaaattcatatctaattcatacgaactcggaatgaggtcgttcaagtctcataattcatctaaattcaagctctacctatttatgaactttagttgtactgtttatttggtttttattagtgttatttctcattttgtgttctaggtttagttttctgttgtttcagaggatcgttcgttcgttggagaagttcctgaagacgaattgaagacacttgtttgcaaggcaagtcacacagatcccaaataaccctttgagcatgttgaacccgtttaaagctaatgttttatttcaacttatgcattattttcgaatgtcatcgggtggtgagcctttcccaattaattaatagccgaatatgactttatttttctatgggttataatttgattagctagaaccttatatattggattggttcagctaaatgctatatatatataattgcttagccatgcttagaaacattagttcattaatgggatgaatcatactacattattatttatggttatatttaatggtagctcatgatggtcaatcgtgttatgataattaattgatgattaaaatatgattaatggtgggttgtgagcacatagttttgaaggtcgtgctcatgacaattaaggaccggttcgcgagctactgttgtgagacattaaccgtgccaaccacaagccagcatgagcaacggctttaccttttgtatagcatgattcattgcggggtgcaagactgtgaagcggcgagaagtccgtgggggtcgctggggagtccatgcctctggtttttgagggagtgattatgatccagaaatggtgcgctgtggtgagttgtgttgtgcaaagggtactgtcacgatttccccctttgcagtgccgtggtggtacttcaaggcatggcaacatgtgtggaatcgtgtcttgtgggtacagtggtacatctctggccagagtaaaactattcaaatagccgtgcccgcggttatgggcgggtctaacaatatttttcgtgattagtccacactactcattaatgataataatgtgataattaatttgactcctggtttggaatggataattcctggtttggaggtttaatctgtacgaccggggttggttgttcaggtttggttgggcctgtgcagcatggttgtgctgttcagtgttgattaatattgatgattaattactctactgttttacaaattctcaactctttgctaaatgctgctttcgcaaatgaatcctatattatgccatcctttgatatgcttgtgcacttgcatatttgctgtgtagcttgttgagtatgtcatatgctcattcttgcaataatcatcaaacctcagttgaagaaaaaggatccagaaggagaagacctttggcttagatcccagttgagctgcctgtgggagtggagctgaagcttcgctagattttattttccgctgcagttttctttatggtgagaactaagtgcatcttatgtaagtatttatcgttttagttattttgatgaatctgtatattaaattgtcagtttgtgtacctcggctaatttctggacgagggttttaatgcacaaattagttccgaaattacctgtgaatttctaggcgtgacagtatatctcctcgatatatcatgcattgcgattgctcatcagctctcgctacgcactcactgccgttggctgctcgacacgtcggtgcaaagccgggaactttctgccttctgcgtgggcgcagatcatgtttggttgcgatctttcgcttggtggcgcgttcatgtttcagcctttctggtaaagaaatacaaggcttttcagaagtgtcgggttatgtttttcaatcggattactgaacttttttggcttctggctgaaatttccgccattttgagctcacatatataatactatgagcaaggattttaacagaaattaaggttaaggatgcctctggtagtttagtcagccagttcaaataaaactatcactactacgtaatctcaaataggtaccaacttaaaggtgctggtaagaggaaaccgacacctattattaatcgtagataccggttacaactacaaaccgatactaatactttaggtgtcagttattaaaaaaaataaaagttaaaatacatcatttgaggatagaccctatcgtttacctgacaaataaataataacaaaaattaaatgaatactaaatcactaaatcattgtacataacaaaaaatacattaaatgccttccagagcgctcataaaacaccctatatcatgccctaaaattctaagaaaaaccaataaattgacgtatccattatttttaactattaaatctatttttttcaaaaattcttaagtcgccatgtgtcacgtcctataaaaaacggagagaaacttagaaattcatagaaaaatgaaacacactatcatcggctttcacttaaatcatttagacaaattaaaaaaataaaatctcctccgcctcctcctcgccctcacacgcacacaacattgtccatcctctccctatcatttatctattaaacaaaaagagaaacaatcaataaaaagagaaacaatcaataatattggatttttttagaaacaaagtaaaaatgcaggcgctcacaacgcgcgcacgctcatacctatgagggcacacatgcacatccctcatgagtacttctgagagactgggcgcacatattttgagattgacaaagtcaccacgagcgcttcactgtcgacgggtacgtcgtctaccactgaaagaatttatcaatctaggacttgaacccgagtgggcaagttccaccacaagaaacctaaccagttgagctacgttcacttcgtaataatattggatattaaaacaccataatttttaagctatattcctggaatactcctatgttttttaaaccggtggaaccattatttctaagaaaaacaagtgtgtatttatggtacatcacatttttaaaatattattgtgcaattatattttatcattatagtattcaggttaggttgcatagaacctcttacccactctacatgaaatgttcatagatggaccgtctctcaaactacatcaatcatattaggctatataaaatttagtggattcatgtcccacccaattcatcctctaataaaccatgataatatatatacattaataaaacattacttttactttacacttacttttatttccgttgacatgttttctaaagaaaattagtctaccatcttttcaaatgacgaagaagattataaataattgcttatagatatcacttaaatataagcatagagcaattttgacaaattgaaagctgatttcaaacaggagtttgccttgcatatgcatagagcaaaggaagctggcatctcgctttggcaatcatggctagataattttcattagttttcccttgtaattatttgtaatctttgtaaattcacccatttattatattttaatatatattgcaataggagcctctcctgttgtttcatgtcaaaaaaatatcacttaaatatgatataatataaagctaatatgttaaaaaatataaaaacaactaatgccgacgaaaacaacggagaaatcgtggccggttaatattttgctcctataagtacgtgtctcgaacttaacgtacgacgcatgcccgcgcatttgcgcggactaccttcctaattaatataaaaggagctaaagtaacttataataatataaaacagaggtagtatatacttggtacccactagttataaagttgctacgatgattagccacatcaccgcaattacctgggaccattagatcttaaatcaacggaaaaagtacaccgaaggtccctcaacttgtcagcgagatacaaaatcatcctcgaaccacgaaaccagatatgcggggtcccttaactatacaaaaccagtcacccgagatctctcggcggttttaacgccggatttctcctacgtgacgaatgagtcagcgtggaacccacgtagaacccacgccacctcatctctccctctagtttcccctcttctccctttctctccctctcacttttctcagccggcgacagccggcgacaggcggcgctgtgggggaggaggccaccggggggaggggagaggaggaggtccggcagccggcgtcgcgccggcggaggcaacgccgccgtcagcatcctcccttcctcctctctctctgtcttttctcctgttgcaagccggccggcaacgaacatagtggcgcggcggcgccaccggggaggatggtgctgcggggggcacgcggcagaggtgggtggcgccggtgccgaggaggaggaggtcgtggcactgtcgtcgtcgtcgtcctcggcgtcggggaagaaggtgggcgcggcggcggaggctggggggttgccgcggctggtgtcgtacaaggtgctggtgctcgtgctcgtgctgcagtttctgtacagcaggcaggcgtcggtggcggtgcccaagagcgggccgctcccggggtgcggcgccgccgtcgacctcgccctcgacacgctgaaagtttgtgtacgcgtcattctatcttgggaaacatggctgcagtgctgctcggtttgaacttcaggtttatctggtaaagatcaaatggtgaactgaaaacagtaggtgtccatcttgttcaggcatagatgtgtttataaacttcagaatctgtattactcctagtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagatcccagagattctaggcaaatgttcagagttcagagacttgcaaactctcagatgatggacagtgtcatcgaccataacccggtcagaatgtctctataccaattttagtattctgcacaaatctgacgacgtgatatatatcataatcgagctgaaaagattagcattggctagctacaaacagcaagttgacaggctataataatctcatactatagtcctacttgaaaaggattcaaaagattgcttctttatactgtacagacgatggtagaactgtactacagtatagaattcagtctaggttcttcagacttgccaatggcttgaacaagaataaaaacagagacacctttcgaactgaagaagcaaccatcaaaataaacaggctcgtgaattacagtatcttggagatgaagaagcaatgttcagctttccatccacactagccgcggcaaccccctagcctccgccgccgccgcgtccaccttcttccccgactccgaggacgacgacgacgacagcgccacgtccaaggccgcctccggtggttccccggccatcccgcctccgacaacggcgccacgctttccgccgccgagggctacgacggcgaggaccgcgtcagcgcgctccccgacgacctcctcgtcgcccgcctcccgtcaaggacgcgactcgcaccgccgcgctcgcctcccgctggcggcgcgtctggagctccacgccgctcgtcctccgcggcaagccccttgtgcgccggcgtggagggccctaggggcggcgaggtccccgtggaggcggtggtggccagcgcgtggaggaagcacggcggcggcggcgctggtcgccgatctcctcctctctgccgccgaggccgtgggcgttgcagccgtcggccgcgccctcgccggtcacccggaccccttccgcgtcgtgcaccggtccgagctcgccgagtcctcaaccatctgctcgcctgcaagcctcgcgctcgcgctcaacaggcagagagagaggaggaaccgaggaccggctaacgtggcatcctgacatgtgggacccacgtctcgctggaatcaatcacacattctgcccctaaagcgccagattcaacgacaacaaggactcctcccgctgcctttggagctcagcatcacctcaatcttctgtttcatataggttcaccgaacttccatacaccgattgattgtacgcttgctgttctcaactgggcctctgaatttcctctggtttcacctttgcgagtgagattgtcatgccgcaaaagcagatatggtccggtattcccttgttccccgtattggttatgttctttattccttgtctagttgaaactaatcgagctccgtaggagagttgtgtagttccactccatctacaaaagagaaagggctcctataacttgatcgacaggacccaaccaactaaactattgattttggcaaagctagaccttttgaggaaaacagatacagataacgaaaggaagctattagtttttcttgtactcgactcggcttttctttactgaccgcttgcgtaaggaaagttgacaataggaaaaccaggtgagaagttttagagctagcgtgccctacttcaataaggtattacctcgccgagggggtaggattggattcattcacttgcattcctgctagcactacaaaaagctccggtcttaacgcccttacggaagcagtgcagcctttcctcgggttcgtagagtcgggtttcccgtttacccacaacggaggagctgcccccaccaaccaaagcaggtaggcggccacggttcataacgcttggtcccacgctgactcagccaccacatagaccaaaacctgggtcaaaaccaccgaaagatctcgggtgaccggttctgtatagttaagggaccctatatatctggttttgcggttcgaggacgttttttatctcactgacaagttgagagatattgggtgtactttttcctaaatcaacatttcatgagggaaaaagtacaccgaaggtccctcaacttatcatccagttacaaaatcatcccccaaccgcaaaaccggatataacgcatctccaaacttacaaaaccagtacaaattaggtccctcagtggttttgaccttggttttgtccgatgtggctgctgagtcagcgtgggacccacgtggactccacatgttagtatgccacgtcagcaggtacctgtttcccctcctctcccttcctcctctctctctctcacactcttctctctgggaaggccggccaacggtgcggaggaggtcgccgggcgaggaggtccgacggccggccggcgatgcggcggcggcggcgacgcggcggcggagacacgggagaaggggaggcggcggcggcaggcgtgcgcacctcctcgagctgctcctcctcctccccggctactcccacgacgccgactacctcaccgcccttcccaatccctatctcatcgccgagctatccacctacgggtccgtcgccgatgctgtcctccgggccccgccaccttcctccgccccgcagcctcgccaccctcagtctgcccgacgcggtggaggtggtctgcgtgctgaaacaggtggaggagaggcggctgtcctgcatacttgcattattttttacggtaaatctccctgagctcccatctgaacctgacaccgaaatggcatcaaagctgttggaattgtgaaggtgatcgacaggcccacgcatgtttcttctcgctgtaaacctcatcccaggaggtttgtttgtcaccaatccatcctgtaaaagagatcaccacaaaaacagaggaaagtcagatcctacatccattgttcagttccataatctcacccttatcaagcaaaaatgaaacaatatgattcaagttcagcaagagaaattctgatcccaaacagttcggcacaaaaaaattctgatctcaaacaaaaaatatcacacagcaacacaaaaagaatgacacagtacgattcaagtttagcaagagaaattctgatctcgaacagttcagcatgaaaattgctgatctaaaaaaaaaaaacatgacacagcaacaaaaacttcccaaatgatcaatcacaaaaatgtaagctccctttcccctatatttctttagcaatcttctttgcatgccaaaagccttctttcttatccatcaccaaaacgaaacaaagcaatgcaatgatgatgcactgaaaagaaaaggctctcaacaacccggagcaggtgctgcgcaggatggagcaggagaggcggctcgtgcggaggggcaccgccgggagcgtgtccgtccgcgtcctcactggcggcggtggcggcgaggccgtctccttcctcttcaacggtgcctcgatggcctcctcgggagccgccgtcgccggccgcaccaccctccgggcacgcgcgccgccgtgggggaagacgacgaatgcggcggcggaaggaggatgatgacgggagctatcgtcactccttgctacgatgaggacggcctcgagtccaccgagagcggcggcaaggctcgtgagtccacctctgcgcccggcccgccgccgccgcgtcgccacgccaccctgccgctcgtcgccggccgcccagctcctctcccgccgcccgcgcgctgctcctcccctgtcgcccgccgccgcattcccaccttccgtcgtcatcttcaccaccggcggtggagcaccatcagacgcccccacatctccggcgcccgtcgcctcctccatccctcccaactcacttgagcggacgcgagcagccgcaggagctcctccagctccggccactggcgtggtgctcgtgctccgcttccgcggcactctcgccggaaaaagaaccgaggaagagaagagagagaagaaccgaggaagaggaggagagggaggggagagatgatgtggcatccttatacgtggggcccacatgggtcccatgcttactcagttgccacgtaggataaaaccggggtcaaaaccaccgaaggatctattgtgaccggttttaattagttaagggacgccggatatctggttttgcaattgagggacgattttgtaactcgacgacaagttgagggaccttcggtgtactttttcctttcaggagtgcacaaggccaccatctagaccaatcaggcccaactaaacggcctccgctttcacccatcggcccattattgttaaagtcccgcatgttcaaataatctattgtgcccatgaaagccatctgaagagcagttacgcaaaaaaaaaaaaaaaatcatgcatcatcactaatggtgaagatcagaggccatacttaattctccacccaaacctctttcaattcaccgttattgtcttttggaaaaagtccaaatacccttctaaactttcgatggaagtttgtctagcactctaaacattaaaaccggacatccaacctcttaaactttaccataccatccatatataacccctaagatgttttggatgacggttttgtatattttgaaagcttaaatgggtaattttaaataactaatataacatatttgcatatcatcagttataagtcatcaatttcttcttacacagtgatatcatactattattacgttggtatttgtttgtaaatgagagccaataaggaaaaaaaagaaagatttaagtcaaaattttaatatatatgtccaaagtgaatgacatgtgagcgaactcatccaacttatatacgaattagatgcaaaccattatgcaaaaccatcttaggaggttatataaatggtattgtaaagtttagggggttgaatatccagtttcaaaattcagggtgctagatggacttccatccatagcttagggggttatgtggactttttccttctcttttatcccagctgaggccacacgctaactccatgtgtcgttgtactaattaaattcaaatagcccacaatatatgcgagcaccttgtttaatgttgtttgaatttttattacgaatgtttatgtgtggataatatttttttaaaaaaatgacttcatttaatttagacatgcatgattttgatccatccacataattataagcatattgtataaaagcaaaactagaagtagcattggattattgataactggctatattggagtcaattttcttaacaatgtcatcatatctactattaaaagcatcttctaacgtatcatcaaatttatagatataagactaatagatatatctatacaacgatcaattgattttttaatagcatagggtagatcgggtggatcggaggttatcttgtgtgaaactatgacatgaggtagcaggatatctctttttggagatgtcttgattgatcttggcatagtgtgcaagcgttgtcttcttcaacgccaccatttgctcttcaaagtcttgccgctcctcctcggtcaagtcctccttggtgagattgttatcgatcacgttcttgcttatcatggttgatgcagacccccataaaaggagtagtcccccaacccggagctactttcccatattccgaattcaagggtttcaataaattacctacgcgagtttgtcttggtccaggtctagaactatcttcaacggtttgtgtagccataaattccatttaatgatttgtgttgactttgtatactattccgttgtagttgtaaatacacgatcttttcgtagatccattgtaatcttgaaattctataaaaatggaaacagcaactttagtcgccatctccatatctggtttacttgtaagctttactgggtatgccttatataccgcgtttgggcaaccctctcaacaattaagagatccattcgaagaacacgaggactaattgaagtaagaagtctcccggggagacttcttacttcaattaaattatttcacttttttagtcggaaccttaggtggttcttggaagaagatagcgaaaaaaattatccctaaagtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgtgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatcatagtcggaatattttaattaaccaaatatattaatatacggttttgagttacttattataatcggcaagtgcacctagcaataatggggtcatcttttcgcttatgcttatgcttatcaactaaaatttaaattttcaatattaaatttagagctgattttaaagtttttttttatcgaagtttatttttcagcgtttgcttttagatcgctaagaagacgtatataaaagttttatttaaaaattacttttcgtttgcaaatatgtcatttcgcttattccacagcgaaacgatggccaggaatgtttggtcttttggtaatcaaccatgtggacttagcaaaaaattgagaattaatctaaagcttcccagaacagccgatgcaattgaatctgctttgatttattttttactaggtaaccatgtgtagtagatcgaaaggatattgcctctgattggtttttctattcctctagtcaattcgtttatcacgtactagcgcgatcggattcgatcggctagatcagatcggtcagcaacgtcggaggcaaaaatatagcaacagcagaattaaagtgttaaataaccagtggtctattcgctgatcggagtagaaaacgatgatctcatgcacacaatcatatagtagataaacaatgaacatggatatagggagaggcatcacaactttattgatttctcatatgtgtatacatcaaccaacctctcaagccctctctctctctgtatatatacccataataggaagagtcctgttaggatacgtttctatatatttggtatgagcctatatttatctctggcagaagataatagtttcataacactccccctgggcgaataccgcgctatacacatatctcattaaaaactccattcaaaaacccagtgggaggaaaggataggagaaaagagtacatcatccacgctaattatattgcacttgttgcctcgttaaaaaaccttgcgtgagaaatattcaagtaaaaactcactaagggaaaaaaagtacaacacacgattttcttgatcgcataatctttaagatcgattattctttataaatagctaatgatctatatgctttattatattaatcaacttggattaacacaacaatatagcggtagtaaccttcaaggtaaattatcaaaacaatgattaatttgattaattcttggtaaatcaaatttaagacttccaagtcttaagtatgataatcaatgtttagcatatatgctccccctcaataagacatccgttgaaacttccatgttccaatgtcataaccacatttttattaatgtgtaaaacaatgataataaaattaccacaatgtttaatctttcgtttacttatttcataagttctactatgaacatgagaaataaatcaacgtataggagcaatatgtataaccacttattcaaatgtgcaatacaaacaaagtttaatccttacggaggattatgggaaaataagttgcaacgatacacatatgcggtatgtataaactgcatatcatttatttattcatgccttttgccagcgatatatatagcggaatttaatacatttatagcaggagaatatcagtcttttccatgaccaaatgaatcgtcgcttttcaccacttcatttcctattaagtctaaacttccatgttcacatagacttatttagcgactatggttcaatctcattgctttcttcaatagacccaatatgagtgctactatgcaactctaccatggactttggttccggatccggattctcattaattagagaaatattagcaatcatagaagcgatgttgtcgacaactattcttttctccacatactcattccttgaggttaattcattataaaccatatcttagtcatttcccaaacataagatgtatggttgtccgcatcccagaattagatagatgtgtgcactttaattccgggttttcatcttcatgatgaacctcttcatgaggcaattcaccttcatggtgattactctacaagagttgtaaggagttattaatgggtacattaacaatagtcgttagatcttagaatccgcatgcatccccgtagattttagaacattgactaacatgtcactctgcatttgtggatatactattcaaaacccggggtataccactggtagcagaaagtttactacaagtaaacataacttctgattactcctttaattcataattatctggcaagctcccgcttctggcttacaggagaataaactaaaccttcgagtttagtttggtttgtgcgttattcttacttataaagatctttttcttcttgaaaatataaggcatctttaacacatgggcttttctccccctaatgtcgatattccatctttatctaatagcatatcacaaaaatcccctatcataggcactggattaatggaattcggtccatttgtatccccaacttcatgtggaggcccatatatgtatgctatggtggtgatatattgtggggacacccaatttaggcttggttcccccaaaatccactcgtgatcgtctaggatttcaatcacgtacagattgatatacagaacaactttcgattatttacacaggtttgttcatacaagctaattatactactgttaaaaggtgaaaagatccaaactaaaatatccttatttgaaatacaagaaaatccaaagtactaaactcctaaacttcttcaactaatagaactacaattaataaattccaaagaatttcaaagaactccacaggcaaaagctcgagtgtagactagcctagaaaaactagtcgttgtcgtagatctcgcttccttctgatctccttgttagcacgtttcctctatatgtcaaattatgcaagggtgagtacttatatactcagcaagacatattataaataattaaaggtgaatagatatgaataaataaacaataataaagtaaaggaataataaaaaccataaaacatatttatcctcaacattttaattttaaaaatacttatacttcaggagtaggaatcaccctaatgacacaactccagaatcgggagtacgacacattcgaatgatttattcacctctgcagagactgtccagctttacccacacgatgcccacagatagctacgctgagaacaacagagccgttcgaaggtcccacttactactagttactgcacagtggggtcnttgggtntcattcatagtgggtcgaaactctttgccaggcctaggggcaagggtattctattattcgtcacacttttcatgaatcccactgttataaaacactgccgccaaactccttacgcaagttcaccccaataccgttcataaaccacccaacagtctttcatatagggggacaatatactaggctaagtccaattacttgatggtgtggatggacccaactatgtcatttccatggtataagggggtaataataatccggttaaaccacccaaaactttccaaactccccacaccatcttcataatttatgaacatttataatcacaatattcacaatctcaattcataaatgcccattttaaccggattcttaagtttgtaaagatgtttgaataataaaccacataaagtgatgtccaatgcatctttcaataatatcatgaaatcatgcttaaaagcttttaacatttacccacgagatgttaaaagagcaaatatcatgcatcaaatttaaatatgaagattatatcaaggtttctatatgatcaaaattttagttatgtcttgccttgcgccttaagatttcccgtggctttagcgtagccatctgggtccacgtcagctccttggatgctgataaaacttgctgtacggctaacgtacgaatacgaaaagatagcaaataaagcctataagcaaattgctacaaagaaacgataaagtcaaggaataaataaaattggagcgaggcgagaggaaaaagggaatgggttcaaaataaattttaggttgaaaataaaagagaggtggtggtttctataggttggtaatcgaataaaattgaggaaaggataaaatggagaggtggggtttatttggtggattggtttctagtcggtgctagggtagggtagcacgacggctagatatttggagttggttagccgatgctaaggcataacagctaattattggctcgtctagtcgatgctacagttaagcagcacaacggctagagagttgggaagtttgtgtaggtttgcggggtggaatagtgttactctacagccgtgagtggcagcagagcggtttgaatcgcacagagcctgaaagctagtgtgcggcgtgctgtggaggtcgagggagtagtgaggctccgaccactatacacgtcgaggcgtggggtgcgaagagagacacttcgaccttaggattaggttatgccgggttttatgaccaacggtttgacgtcggggtttgagaccacgcgaacgtctccatggaaggcgtaacgttcccacggcgactatttggtagctaagggatgaaatagttgaaggttttagaaataaaaagggaataaataaatcaaagggatttgaattcaaaaagaggttttaaatagattaaagaaataaaacttaaaatggtattttaaaagaaataaagaaaagggtatttaaagaaattgaaggataactaaaatttaaaaaggtttttaaataaaataataaatttaaaattaaagggatgtaaagtaaaataatttttaaaggctaattaaaataatttaaaattagaaagtaaataaataaataaggaaaagtgtttttttataaagaattttaaataaatttttttaaaagaataggaaatttggtatcaaaacgaagagtttgaaattatatgaatttaggtcaaagtctcactgggattggatttgtggttggaaagatatgggtgtctaaagatcgaaattgaattaaaatcaaataaaagagaaaagttactgtgtagggggcccacttgtcatatgtctcttcttcttctaattcctccttcctcttgcttcttctctctttcatcacgaacaaacagagagaagggagaggaggggcgccggctctccggtggatgaaagactgtgacaccggcggcaacacgtgttcccaagcaacgcgtactcagggagggtagtttccggtacatagcgttagggaggtgaccggaacggcggcggcaagagcttgctccggtaacaagaggaggtgactgtgatggttggtttcggaaggggaaaggaaggggaaactaggaaaatgagttcgcctcgtcgaggcaaacccgatggcgcaagggcttggtttgggatgctctagggatggagatcgatcgatggtggccatggcctaacatggcccggagagagagagaaaagctcggtttgtgtgggataaacaaaggggggttcgatctcttatataggcgatgaaaggcggttgccgatggcggttgtggaggcggtttcagaggagaagaagaagaggagcacggcagcggtgtcggtttgatttcttagcggcgaccggtggcgtgagggagaggaacacggcgccgg

SEQ ID NO: 82146 - DNA, 2133 bp, Oryza sativa
tatatatatatatatatatacatacatatatacatacatacatatacatacatacatatatatatacatacatatatatatatatatatagtaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatgtatatatatatatatatatatatatatatatatatatatgtggggatcattttacgatagggtcccaggctcccagctgcgaccgtctgctcagtaggtcccgcggtcccgccacgcgccactcgtcttgaccgcgcgctcggctgccgggccagcgcgccgaaccgccaatcaagcaggaggcgcggcgcgggcctttggctgcctccctttcccaagccgaaacgcacgattcgcgcccgcgcgcgcgcgcgtgccccctgtgcgtgttggtttcaggttttggcctctttctgcccggggaatgtgggatccgccgcgtcgccctgcgctcgacagacaccgaccccggtgggggcatggaggccatgtccatatgagcaacgcaacgtcgtggcctcgtgggtagggcaagggttggcttccgttttcccgccggcgcttttcggtgttcttctgatttttggccgccgtgcggtgcgatcgccaaatgtctcggactcttggttgattctgttgtgttgtccaaccacaagtgccaactgacaactgccaaagcccggttgttgtcacaacgtaacgtaccaatacggcgggcgcgggtaggacgtggatatgagttacccacaatttttgccatctcttctacggatgagttcgtgcttaccaagcaaacagtgtgtgatggattacttaaatccgtggaactattctactggttttttaaccttagctttcaaggtcgatccgcccccaatgaacaaggcgggcgcacgcaagtccgagcgagaagaagctctgatgtaaacgctcgtcactatcgagtttttcggctttcggccgcgggatcttgcgttgcttcgttcgggaggtaaataaataacggccccaaacgaccagtccatggaaaattctgggccgctactgacagcataaggcgggccaatatagctgggtactatcaggctgtcaccgttgtggcccaagcccaacattttattcagccttttgtccttttcgaaacgtacgttgcgtagaggaaccaatccggcgactgggcggccatttccgtccgccaccatattggaaattggatgatttcttctgtcgtgatatacaaagagtacttcctccgtcaaaaacaaacatactttttgttcaaatctagatatatagaagttgatttgttttgttttaagatagagagtatctttattacttcaaaaaagaaatgttgaagtctagtcggtgttgtatttacgtgtgggcggacgagagagtgccacgaatattcttcgtcctggagaggccggccatcgacgacgtctgagcttttgagaatcttatccgagcaagcaaaacgacgtgagtagcaaccggcatcgcactcgattcccttggctcacgtacgcagcacgctgcccgccacgtattccacgctgcacgcacagcccccgaccacccccgagccgtgaacgtgaacgcgatcaccacccgggcggccggccgcctcatccgctcgtctcgtatatggacaaaatcgcagaaacaccaaaagcgaacaggggaaaaaaaaacggggagtcgagtcgcttcgccgcgcggatgagacgcgcgctgaccaccacccgac

SEQ ID NO: 82147 - DNA, 5264 bp, Oryza sativa
acgtaaaacgaaggtcctattattgcgtgattaattaagtattagctaatttttttcagaaatggatcaatatgatttttttaaacaactttcgtatagattttttttgcaaaaaaaacaccatttagcagtttgaaaagcgtgcgcatggaaaacgaggcggaggagttgggaacaggcagcaacgaacagagccttagagcaagcctaataacatagccagctactggctctatactaataccatgtcacctatagccatcaggcccatcactaatataataggctgactgttaggttggctgtttgtttaactctattgaagatttagatatttaatattagcatgtgcacctgatctcctcgcatctgattggaagaaagcaatatttcctcgtgtgttgtgcttcagccgggcgatagatggagcgcccgctccatcctttttcttcccttctcactcctccacgtcggattttgctgacgggtaacgtgctagcgccggctgattaggatgtattaaacctgctcttaggagtactactctctagtcaaattgctttgacgttgaaaaagtggacatcattttttttttgctagtgggagtaattctgtgacaaaaaacagtatcattaggtttaggtttcaatttatttttgatataatcatgattttgtggaaaaatcaatcggcaaagtttgattgtaagttaccaccttcttcggtatttacaacggtgggtagaaatcccatcgcccgaacgcgtgcacacagtcgcacacgatttttggtgcactttcttttttaataacattaattaatgacggaaacaattatgctcgggcgctctgtacctaacaaaatatcgggcgtcttatcagtcaaccattccacattcctccgtggcggtggtcgggccatggtttgttgtgaccggcgagggttcatgcagctgcggtggcttgctagcacatcggcgtagctcgaggccatgagatgggaggaagacagcaacccgtgcacaaattttgataatttgaccctttacagaaactcagcctgttcatctacggttaagacgggtttccgccataacccagcccaacccggagctggctggtattagacggtttggtctagcggtttgaacgggttaaaccgtttgtcgtcttcttcgtatgagaacgaacagagagcaggacgacagccatggcagctgtcctttgcaagcagataaaaattcctgcagatgatgcgcaagcacttctgtagatgaacgaacaggctgacctggcttcgtgcggcgctttcctcgttggtcgatgagcacggccggggcgaggaggatgacgagacgaaagcggcggtgagagggatgcggagccggcggggacgacgcgcgacgctttcctcgttggtcgatgagcacggccggggcgaggaggatgacgagactaaagcggcggcgagagggatgcggagccggcggggacgacggcggtttcaacgggttgtaggttaaagcagcccaacccgtgcagaaccggccgtgcggttcggtctggttcggtttgatggtttgaccgggttgtgcccaacccgtgaacagcctgaacagaaacttattaaaaaataaaccgtgttaaaaacttattttaaaaatgaaccgtgacctcagcgccaattccgatggcgctgcgccaccaattttagcgctaacctccgagttgtcataagttagccacattatcaaggccctctaaagcaaaggtcatgggaggtcatgggtttgaatccgcgcctgtgattttcaaccgttatatgcctaaaaaatttgctagcttaaggcttcgaacccaagacctagtgctaaaaaccaatagagctaaccactgcactagtagtatatttcaggtaggcatcaccaatagagccttttaggctttgaaaaggtcagcgccaatgagagtggcgctgacccatgatgatgtggctaatttatgacacctcggacggaggttagcgctaaaattagtggcgctgagatgttggatctcagcgccacttccgatggcactgaggtcgcggttcatttttaaaataagtttttaacacgatttattcttgtaataagtttttacaaagggttaaattgtcaaaatttatggcatcccgtgtatggatctggagatggcgcggtttccgttttgcccaagtgatgacgatggcatagcgagctcccaatagcaaacgatgacagggtggtgagggcctagggaaacgacggctgctcgcctcagaggagcagaagggcgttgtaccttctcggcgtggatctccagcgaagaacggaggagagcactgagccgacaacccttggcaatcctgtgttcgtcggagggaagaagatacagtccaaaccggatatattttatttcatttttttttatgttttagctagtgtacttatgatgtttctttgtgtttggatcaaatgttgatagtatgccatattttcatctttgatgcacacggttttgtttatgtttcaataattcaaacctaaaaaaaattcaaaattaatgtaccatatgttgtagtggaatgtttcaagtgtgatttggttatgtttcatcatttaaaatgttgtgaaatattttcgtataaaaaggtgaaacaacaccaaattttttttttggaaaaccgggcgttcaatttgtagtcgtatcccactaatgatgcttgttttcattttcagcgccgctaatccctgtatcgctggacacgacacgtgccctagagcgagcttgagctttagctcgtgtgagtttgggcgcacgaactgcctaccggtgagcgaatcatcctttcacgcttagctggattatgtgacagccggaagaagatacctaaagaatagagaagagggttcgatactatcgtaacttttgaagcctgctctatctctagaaagaacacaatgactgagttttcaaccaacgacaatggaacaggatcgatattgcgaagacgatgacaaaggaagcatctctttagcctttgacaaaggttgtggttcggcagctagctacttatgtagccactatagtcctaggtcagcccatctgattagatagagtgcactcagtcccttcccctacttcctctttttttttttctgttcagttgtaattggcaactttactcgtcttattgcaaagatatgtaagtcttttacgtattaaaaaattgctcgcgagctttgcgctgggtgggcttgcatttttgggtctaccgtttaattgggtcaatttatgcctaataaaaagtttaaagaacactgtttcttctttgattaaattttacattagactatttttttcacataagtttcaagtagagattttatacatttattcagttcatccgtttgaaggaggcatctatctttatacgccatcactctctactctctattactccgaattactattgagtatattgatctagacatctagccacaatcaggcaaggccatcagcccattacgacacagaaaaatatcttgatatctgcccacgtcagctataaaaaagtatcgagagttcttccaaaaaaaagaagaagaggcggctaaaagtatccaagcatctgtctgcaactctgcatcatagcggccggggtgccactctgcagtctctcactgtgctggacatggagtccggcgggatactcccaccatccgagacatgcgccggctccggttcaccggacggccgcggcggctggcgcgccgcgcgcttcctcatcggtaacgccgtcgctgacctctcgccgtactcgcgcgcgtcaccgcacgcacgcaggtcgatcgattctttgcctcgcctgagcgtttctcggatggatggatgcagccgtcgggttcctggagcgcatcgggttcaacggcgtgcagggcaacctggtgatgtacctgagcgggccgatgggcatgtcgacggcggcggcggccgccggcgccaacgcctggggcgggacggtgctggtgctgacgctcgtcggcgcgctcgccgccgactcgcggctcgggcggtaccgggcaatcgtggccgccggcgtgctccatctgctggtcagttctttgcttccgatccccacctgtaagttagttaattaccaacatctcgagcatctatccatgtcgtgatcaagttcgcgttctcaatttgatattccccggcccggcaacactgtttttgtgaatggattgtttcacttttcttgggtatgttcttgatagcgagggatggcactaactttatcacaattagatggtagtcgtttgtattgaagataaagataaatttaggacataagaaacaagacatttttatcgcattataaattgagttttaattattttaaacctaaaaatattatatgatatttaaaaaaatcgaatgaaatgtattgtttagcggtttgaaagacatgttaatgacaatcaagataaaatatgcattttaatgttgttgatagaagcagatggattaaattaaatattagaaagttgatacgaattataattttttttaaggaaactttatgaaaaacatttttctgaaagaactactctctccgtccctaaatataagatattttggttagatgtgatgcatcccagtacaatgaatctagataattgttagcaaccaaatcaccaaacaataagaattttaccacgaacaactattcagtcaacaatgctgttttggaggtggaagatggggaaatacatggggctagaaggttctggaagctagggaatgggaggtggaggagggaataggtactcgacaaggatccagcccggacccaagccgcctaggttggtcgccgtcctgtcttttctgttcgtctttgagtgagcagtagctattgcgttatgtattgctcttcctgggtttgcttgggccgggatttgcgtagcggaccagctgtggtgcagcccaacaaggtgtctaacaatcccctctccttgaattcggcttgtctccatgccgatgaattaaaacctcccggatcccatggttgctccaaatatttggtgttagacaatagaacattattgaagaagaatagagcaagtagctttagcctcgataacttcttactccatgcgaagtcctcatgtgtcatgcctgacaatggcactgttatgaattgcttgccaacaatgattcccaacaatttgatatgat

SEQ ID NO: 82148 - DNA, 1583 bp, Oryza sativa
gcccaaacgctctcgccgtccacgcacgcgcagccaaggaggacgactcggcgagccgcgcgagggtggcgccgccgccgtggacgggttgctcggcgcggtacgtccccgtgccgagcaagaagacggggaggtacaccgccgtcatggccaagcacgcggcgaacccgagtgcggctcacgctgtcctcgacgtagctgagcgcgctgttggagatggcgtagccgcaggaattgaagaagtggtaccagttgaagtaggagctccgcgacgcgcgcgcgccggggtcgctcggcggcgcgaactggtcggcgccgaaggcctccgagcacgggttgtggaagccctgcgccagcgcaaggaggtagagcgcggcgtggaagaaggcgaggcgggcggttgatggcggcgccgccgccgcctccgccggcggggagcaggcggtggctgcgtcatggcagctcaccgggtgtgggtgcgttgctcgcgtcactgatgagatcgtcagcatccccaagctctgtaatttttcttaaggatcaaaggttaaatgtaaagcaacatcgaagaaagagaatgtgtttgctccctcaaatcatttctattcggattccctgtaatatgatatatatcacattcgacacttgctagcaagatcatagatgagcttcgtttgtgggaaatggcaggtgccaagggagtgaagtatattatgttaagagattaggcttttgttttttagggagtgcaggcaggaagagttcctccgggaacgcccccactgtcttctgttatgtacagtttctctcacttcttctataatataaaaccagctcgctgggttcttttaatatatatatatgtatatatatatatatatatatatatatatatatatatatatatatatatatatatatatatatatatgtatgtatgtatatatatatatatgtgtgtatatatatatatgtatgtgtgtatatatatatatgtatgtgtgtatatatatatatatgtatgtatatatatatatatatatgtatgtatatatatgtatgtatgtatgtatatatatatatatatatgtatatatatatgtatatatatgtatataggatactcatatggggcaccatggtgcccgggcaccatggtttcaaatgcacaaaattactcaaatttttcaaaatttttaaattgtgagtatttacctagttataagaattcgattcatacatatatctatcaacaaaataactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattagttatatactcaatttcaacaatggtgcccgggcaccatggagcaccaaacaaatttactatatatatatatgtatatatatatatatatatgtatatatatatatatatgtatatatgtatatatatata

SEQ ID NO: 82149 - DNA, 10850 bp, Oryza sativa
atccgttgatcctccgtgatctaacgatctgcaacaaaaggtagctaagagaaggtactaaaaatcgtgggccaagtattaacttttaaattaggtggagggtcagtttcaaaacaaactagagagaaaagcccagtaactttgcttgacaatagtcaataggaatccgtcaaatttgtgctttaatatcttggtgagactttgtaagtagaaacccgttaacgtaactaaccaaagaagagaatcaaataataatatactagaattaattaagtaatcaactttgcattgatccgttctgtaaaaaaaaaaatcaactaccatctaccttctgtaaaaaaaaagaaggtatatataagatggaagaaaagattgttttcagattttgtactgtttttttggtaaagatttagtaccgttatatggcactataaatgaaaattagtgatgaaaagcgattgatcgccatggagggaatatataaggccagtgatgagcgtcaactaacaatgaaatgggaaaagttagagtagtttgttggttaagaataattagaatattaataatttgctgcgcttatgttattttctgtaccgaaaataccctttcaaattaacggtagataattcagtaagagaaaggtacctactctcactttcaagcactgtaaaagctctccacttgggtacgaatgtataccacctgcgtgactcagcctagatctcgcgtgaggacctttttatttttttaaaaaaatattattattaagatctaaaccttttagctatcctcatgacagacgtgataaacaacgctgctgcgaagccaaccagactggtatggtcaaacaacactactacgctaacaaaacgggtgtataaaaaaaatagtaatcgcaagtattggtagctaacaaattcactagcacggacagtgctagctcccgagaacatccagggaacctcgggcttaattacagttacagctacaggggcaaggaaagcaaggagaactaactaaccagcaggtggagcacgccggcggccacgatggcccggtaccgcccgaggcgcgagtcggcggcaagcgcgccgacgagcgtcagcaccagcaccgtcccggcccacgcgttcgcgccggcggcggccgccgccgtcgacatgcccatcggcccggccaggtacatcaccaggttgctctgcacgccgttgaacccgacgcgctccaggaacccgacggctgcacgcacacgcagcagcagcagcaaagccatggcgagcgtggtcttgtcagttgtaagaacgattcgcgagcgagcacggcgagaggtcggcgagatttaccgatgaggaagcgcgcggcgcgccacccgccgcggcggccgtcggcgtcggcgtcgggcttggagccggcgtcgcatggctcgtcggaatgtgcaaggagaccggactccatggctagcacggtgacactgtggcactccctctctaatgctttgatgtggacaaatgcttggatacctatatatatctatatatttttttgacaaaaagcgatgctcacttgtcctagctgacgtgtggaattagcaagatattttcgtgcacctattgctttgcagcgagtcgtgtgtgcaattgtgtcctcgccattaatggctagatgtcgggatcagaaaatcaagataatatagagtacagagtgattatagaaagagataagttcatcggggttaccagcttcgtactaaaaagtaaaaactgggccaccacaaatcacaatctacgatgttgatgcatttccttacttgtacggttctctaaattaaactttgatgaggtttttaaaaaaatgaactttgatggccaattttccattgaatgggacacgcttgaaatgcaccattatggttttgtttgatgaaaaattcaccagtatggttgcaggcttgcagcttaattataagctgaaaacagaatgaacaaagggaaaatttactgtagtgttaaaacttttgtacttctactcttaccattccaaaagacaaagcgaaaaatagaatacgagaaaaaaaaaacccagattaatttaaaattcagaattaactgccacgcctgaaataagtcggtcccatgattaaattggaagttcttctgaatatgatccgacaataccactttctataaaaactgtatattattattccagatattgttaaacataaactaaagttgcatttcatgattagattataactgcttgtatttttttcattgctattcttataacatcaactttagcatttgaactcatcaagtatctaaagattaacatatagcaattattagtaatcctaaaaactaatacaagtatgtcacatcaacccgctaaacactaaaggttaatatgcaagcatagtaacatatctataatttattactctctctgtttcatattttaagattttctagtattttccacgctctcatgtctagattcattaacatctatatgaatatgggcaatgctaaaaagtcttataatatgaaattacattatgcaactcagcatatatatataaacaagctaaattatcattcctcacatcatttccagacaatatttcaacctaaattcatccatcatttctataacatttgacatttattagcgcgcgcgggatgtgccattgagacgaaaagatccatctacaattaaatatcaactgataagactttgttcttagtgtagacataaccctttgcaaaatacaagaacaccagcacatctaaagcactaattccggccaaaagccagtagaagtagtcaaggtgagcacggttgagattgtcggagaaccagctctctcccctactcctcgtcgccgacacgagcatgccactcgcgtagctccccacgccgacgacgctcatgcacgctgccacgccgacgctgcggagctcgtcgggcacctggtcgtagaagaactcctcgaggccgaccatggtgaacgtggtggcgacgccgagcaggacgaactgcggcgccagccaccacacgctcattggcaccgcgacgcccggctcgtccaggaggccggcgtccctggcggcgcggagccgcgcggcctcgaccagcgccgcgacggccatggcgaggcacgccgtgaccatgcccgtgccgacgcgccgcagcgtcgtgatcccggaggggtgcttggtgacgcgcctcgcgagcggcaccagggcgcggtcgtaggccgggatggtgaccatgacggcgaagctgaccaagctcttcagcgccgccggcgggacgagtaggacgccgccgccgccgcccgtgccgatgacgatgcgccggtccatggtgctgccctgctttgtgaaaagggtggccacctgagattacaccaccgcgtacatcacggtggtcatccatatgggaagcagcctagcgacaatccccttgtcatcgccatggcctctcggcggcgtgggcaagctgcgccggtagaacatgtcaatggcgatggcatttgcagcctctccaaaatcattcgcgagcgagctcaccttgccgtgtcgtccatggcgtcgccacgacgcgtctcggcgaacgttcgcggttgctccgggcggtaggttcccgtgccgagcaagaagacgaacaacgacacgagcatcatggcccagcacgcgccgaacccgatgccccagctgacgttgtcctgcacgtagctgatcccggcggttgagagaacgtagccacacgacacggcgaagttgatccagttgaagaaggagctccgcgacgcgagcccgcctgggttgctctccgagaactggtcggcgcccatggcttgcacgcacggcctgtggaagccctgcccgagcgcaagcaggtacagcgcgacgtagcagaacgccacgcggcccgccggtgctgccgccggcgacgagcacacggcggctgtatcctggcacaccattgtcgcttgtggtggtgctaccatggatgagaccgtcagcatgccaaggctctgtccaaccccaaataatttgttcaccatggtgactgaaatgaaatgttagagctcaaaattcagaagaggttagaggagattcaccaaccaggagatagagaacgccggaggccacgacggcgcggggccggccgatccacgagtcggcggcgagcgcgccgagtagtggcagcataaacgcggtccctccccacgcgttcacgccggcggccgccgccgccgtggacatgcccagctggccggtgaggtacatgatcaggttgccctgcacgccgttgaacccgacgcgctcggcgaacacagccgctgcattgatcatcacgaagaaaaccgcaatatttgcagaaaccagaaagtgagaaagagaaccaaaagcctcagtgtttgatcagctagatagtgttaccgtcttaccgaggaggaagaacgcggccggccacccgccgcggccaccggatttggagccggtggacggctcagcctcaggcaggagggcgcattgttcgctggattccatatcactcgttctgagttcttactcgttcacgcgagaactgcaaagtgtttggtttggcctcgtgccctcatggcgaatataaaaaggaggctttgaaatttggtttggtgacaccaatagtttgctagttcattcgtcattgtttgtaattttaagagtgaagtacacgtacggacactctcttatgcaagtgtgacatctaagttcatgaacttttaaaatatatttttgggtctctaaatttatcttgggtgttatacagatcaaaacgtcgtgcaaccatactggcacatacatatcagggagacccacatatcagtcataggaaaaacagattttaaaaacatcttttcgttttggatccgtagtacacccgagaaaagtttaggaacccaaaatacatttcgagagtttagaggtctatataacaaacctgcataattttagaatattgttcaacaacaagaagaaaatacatactcgaccgatctgatgtaatttcatatcagcgggctacatcatattctttttcacatgacaacatcataccttagatcttaatccggctcaccatggttagctcacccttttactctgttgatattgatatgcgggaaaatgattttaaggggtttgctgataaaagagtcggtgggcgattggcataggcgagccatgagcatcgaggtgtcagtgttggtgccagagccgtaggctggtgtcagtggcggggagccacctaagatggaagaaatagcgtggcggggcatcttgccgccgacggcttgagttagagcaatctatctattattttattaaacgaatagaaaaaggagtctagaaattctcacattaatcagagaaaaagaaaaagcagagtccatatagaaatacaatttaaaaatagcttaaattcaaaattaaaaaataagtaatattagaagaggagaccagagtccatatagaaatacaatttagaagtaactgaaatccggaattaaaaaataagtaatattaaaagaggagactagagtctctcctctagagtccatatagaaatacaattaggaaataaatgaaattcggaattaaaaataagaaatattagaagtagagtatagagtacatatagaaatacaattaggaaataactgaaattcggaattaaaaataaggaatattagaagtagagtatagagtccatatagaaatacaattaggaaatatctgaaattcggaattaaaaataaggaatattagaagtagagtatagagtccatatagaaatacaattaggaaatatctgaaattcggaattaaaaataaggaatattagaagtagagtatagagtccatatagaaatacaattaggaaataatagaaattcggaattaaaaataaggaatattagaagtagtgtatagagtccatatagaaatacaattaggaaataatagaaattcagaattaaaaataaggaatattagaagtagagtatagagttcatataggaatttaaaactaactaaaatttggaataaacataataaaattaaaagtagagtttagagtccgtataaaaatacaatttataaataactaaaattcaaaattaagaaaaacatgggaagaagaggagtttaaggtcaatataggaatacaatttagaagtaattataattcgaaattaaaattgaagaatattgaaagatgagtttataattagaaataataaaaattcagaaataaaaataaataatattgaaagaagagcatagagtctatatagaaatacaatttacagaaaatttggaattaaaaaagaaatattaaaagacaagtctaaagtccatataggaatatatatatatatatatatatatatatatatatatataatttacaaataactaaaatttgatattaaaaataattaataactaacacatatataaaatatatgaatattacacattagtagttttgtaaagttattgcaaaatttaaaattatgttatcattttaatatatttgaataatataatgagaaaacatatatgctattatatgtgagaaaatataatgatgctagccgcgcaatctgcgcgggccaccatgctagttttaatagtatagcccactactggctccgattcatctatagttcatctaatagccaattcatacaatagttacttactatactattaatatatggtcccatttgtcatacacatattgcgttttagagtccgtactgcagctggctacatatttgtagcccgctgctcttctctctcatcttttatctcattaaaatatgtttgcagctggctaatagtctgctattgtacctgctccaagagaatagaggggaaggaggctggctcgagaacggcgctgttcacactttccagccaatcaataaggttggggggaggaagagaaaatgataaggttattgtgcgaacggaccttaaagcacatccaacatttcataatttgtattatgtggaatgggattttctgttaaaaattgtatagacagtcaggtgtaaacagataattcgcatactaacttacatgttaaaataaataggtccgcaacctattttgacttataagtaaattcacaggttaaccacctacacacttaggcagcccatagtctaaaaactaaaaacaaggcttgttcgaagctaagatttggttgatatttggtatagtcacttcgatagtttattaagactaattctatcgtcattgtttgtatttttaaatgcatattgtaatacttcctccggttctataataattgacgttttagataaggttgtggtcaaacttttataactttgactattaataactttaaaaatatttagtttaaagaaactaataacaacgtatatagaagcactataataaaaataaacatgcatttattcattgtatatattataatagaaaaataaggtcaaagatatattttgtagtccgtgtcattgttcaaaacgtcaattaaaatgaaactggagggaatattgttcaacaacatgaagagaatgtgttcgcaggcccatccgatgaattttgttcacctcggtccaccatgctcatcagctcgccatctttgctctgattactgatcacttgatcatcagagtatatgataacgcactacaacaattcgagatttttttgtgtacactcgcgagcaatgaagcaacagagcacaaatcggaggtttacacgcagatgccatcatcatcaactcccctgtaatcacaattgccatcagcatcgttgcccttcttcttgtaggtgtacacccgcgagaagaggaagaaggcgacgagctcgacggcacagaggccggcgaggagccagtagaagtagtcgaggtgggcgcggttgaggttgttggcgaaccagctgccgccggcgcgcctcgccgtcgcgccgtcgatcaccgagatgaggaggctgctgaggaggtggccgacgccgaagatgctgaggaacagcgcgaggccgaggctgcgcacggcgtcggggacctggtcgtagaagaactcctgcaggccgatcatggcgaacacgtcggcgacgccgacgagaacgtactgcggcaccatccaccacaggctcatcgggagccgcgccttgggggcgtccgccatgccggcgccggcggcgacgcggaggcgccgcgtctccacgagcgcggacaggacgacggcgacgagggagagggcgaggccggcgcccaccctctgcagcatggtgatccccgacggcctccccgtgtagcggcgggcgagcggcacgaagaggcggtcgtacaccgggatgaagacgacgatgctgacgctgatgaacgtctgcagcgccgccggcggcacgttgaagctccggccgatccgccggtccagcgtcgccgcctgcttggtgaagaacgtcgacgtctgggagaagattatcgcgtagattatgcacgacgcccatatcggcagcagccggagcacgctcttcacctcctccacgaggtcaccggcgtcgccgtcgccgtctcctttgccgccgctcgccggactgcatccaccgtctcacatcaggacatgcacaaacagtcaaaacacacaaagaaaaacactactaaaatcgatcgaactattcttctttacgcacttggtgcgacggtttgatctccagctcttgatcaatgtcaagaacgccttggcgacgcgggcgacggggctggccgtcctggctgtgtagaacctgtacgagcgggtgccgaggaggaacgcggcgagggagacgacgatgacgatgcaggggatgccgaagccgaggccccagccgacgttgtcctgcacgtagctggacaccatggtggtgacggcggtgccggcgcacatgccgaagtaccaccagttgaagaaggagctccgggcggcgcactccccgccgtccttctcgtcgaactggtccgccgcgaacgcctgcgcgcacggcttgtgcgcgccctcgcccagcgccaccatgtacagcgccacgtagaagacggcgacgtggccggcgcgcgacaccgggaacgccgacgacatcgacagcgtgcccatgctctgcatccatggaaacaattaattctcagtgtacgcgccatggttgggaagaagaaccgaaggagattgcaccgaccaggacgaagatgacggaggcgaggacgatggcgcggtagcggccgagccaggcgtcggcgacgcaggcgagcggcagcggcagcatctgggagacgcccttccacgcgtcgatggacgcggcggcgcgcgccatcggctgccccagcggcccggtcaggtacgtgatcaggttcgccgccacgcccttgtacgcgaacctctccgcgatctccatggctgcacgcaccaacacaaacacaagatcatcatcgacacattcatccaatcgctcaaatcactaaaaaacaaggaagatttaagcatacccatgacgaacaccgacgacttccagccgccggtggcggcgcgggaggccggccggccacggtaatcgacggctccggcgacggtgtccgccatgccggagtccaagaggtgagacaccagcttgctccggtgatcggccatggtacagcttgttagggctttatacgaaaccgaaatcgacacgcggctgcttaggcagatgtaatccccctttcttaactctgaaattactgctaatcaccttccctaaaaccccctctactcttcccaaatttacccgatcttgcaatcctagttgaaaattatcgtacaaaaccccctcgaattaggacgctcttgctaatcaacccctgtcttacgctaatgcagcggggcacgtgtcacgcacgcgtggcccgtgtcgcggcgtgtacggacgagagtcgccacgtgcggagcacggttccctatcgtgcatttaggacaggcttctggtgatgcgggccggtggatcatggatggacggctgagatttcacggcttcgaagaggataggttcttcccgcgaatcaataccgacggcgactaggcgattactagtatagagatgagatgagccgttattgctgctttgatctttgaacttttggaaaagcaacggacaggaaactgttgccaaccagaccacgaaacaagctgtcctggatacgtttttcagcagcaccgcatcgtaaattttgcggtgttgaaagaaaatgtttatttacctattttctaaccatacgatttcaatacaactaaaattattttatgtatgccattatataagcatgagatgtatttttataccgtgtttgcaactttgcatatggatcaaaatgctcccgctaactctttctccccacctcattgacatgtgggcccacgcatcatcccccttcctatgttcctcatcccactcatctcctagtcgttctcgtgacattatcgccctctttggaagacactaatgacgagttcccggtggggagttggaggtcatgctctggtgacttagatactcggaaccctttgacaactcgagaatgagcaacatgactgggaggaggcagcggagaggagcagcagtagcacttgtggaccatttgacaacaagggtgcgagtgatggctcgttgatgatgccaacgggtcgagctgggcgagggtgtggttgtccggcgctggtgcaggatcacgttgataagctccacgttagatccagtgcctcctcatccacgatgcttgcgaagat

SEQ ID NO: 82150 - DNA, 2500 bp, Oryza sativa
aattttatgttccccttcaccaggaacattggcatcagaaagaataaccttcaaaagaatttaaccagaacacacatgactttttcatacttgcctttccaatcaatgtaaaccttagagtttgtgaagttaacatatggaacatactgacagaatgtaatgccaaaacaaaactgataggcttaaaaccatgcttactttaacttgtttccatccaggatcataattcaacctgagatggatgtagtactgcaaagcaatcgataaaacagccataaactctgttcctggagtaataacgttagaatcacatgtttgagattgctgttttggtggaagttttctgccttccctctcaaactcttcacgcaacctctcttcttctgcggcctggagatagaaaaataataagccataaatgcaattctaccccttgaagccgtcgatgaatgggaatttaaatgtcgacatattatcatacactgcataaaggaagataatttcactagaatactgaccgcatcagcagcatcttttgcagctctgaatcgtctagagcgttgctggttcatcttggcacgaggagcaacaccatctgtaaaaccattgtaagataatacaaaatatcaacaagaaaccatcgacaagaacaaaacatatgtggtaaaaaacaggaccctggacagcaaaagtttacaagcacaggtactatgctgccaaataaatagtttacgggtgaggattatgcctgattcaaaactcatgtaaatgactcgtcatagtatatagctaacttcaacaaaggcattagttggcagtatggcaagctgttctatgatgatgaccaacaggtaaaagagcaatgacactaaacactcctaatcctttaggaaggaaaaaggtagtaagagaattcctacacatcagatgttatacgtaccaatggccatatacataagcttccgagggcgaaccatgacaaatagcctatcgatataatcaaacatgcactggaaaacctcagcgaatgttgtcggagagggctgtaaaagataacacaatagcaagaaatcatggtcagcagagaaatcagaaagcacttgagcaatcagtaaacattaaaatatttgttcgaagagaaatgcagggcaatgacagagtagcatcatgcagtctaaactggtgcgtccaccgaatgaaaataaacataactcaaaaaggcaaattaacaaatttgcgatgcagagtttgaagattaaactacagcagcatcctcatcctaagatggctcatgtggcaatttagcagtttgtggttatttgcaaaattatgtttaacgctcaggtaaattacaaaacaggaagctacaaaatcatttcaccaaactatctcctctgccacagctccgtcgtacatcaatcaggcatacacaaatccatcacctgtacagcggagggacaccatacgaacacccaaacaaaccccagagctacgcaaacagaaacgcccaaaaaaaaaacatcgacgtaccctatcctcggggtggaagcaggggtgaatgatcccgttcatgtcgaggtagaggttgtcgaactcgaggccgttggggttgggcttggaggtgtcgacgggcaccttgacgccctcgatctccaccgcctcctcctccaccacgtccaccaccaccatcgggtacttctccgccagccaccggtagaacgccggcacacccatctcctcctcctccgccgccggaaccctaaccctaaccctagaaagcgagccgccgccgccgccgccgcgaggagccgggccgacggccgaggggaagggagagagggaagagggcgcgaaaccctaacgaagggggtaggccacgcgggcggggaggggaggggggtatatgccttttccggtctgaaaatatcttgttcgaggacgaagatagggagagagagagagagagagagaggcggttttgcggtttcgaccctggtaaactggggtaatttttggggggtgaaaaagagttttgttttttttttgtttttttatatgtacagagacgatttgatttgtccgacgcgtcaaggtgttgactacgacgaggctacgaatagtggtcgggcgggctggctcgggccggtcgcaggctaagattagtaaaattttgggccgagtattagttaggcccaagcccagtgctttgctttgtgggcttagtgaacttgtcagctgatgatgatgatgagatgttcgttacaaggaaaaagtgtttcttgttgatttggtactctcttttttttggtaaacttcaaacacttgatgacctgacccgactctaggaaagaatggctctttggaacacatgaattcttcaaaattcatgtaaaatccttccattgaaaaggaggcctgactataatgcgatgccaaatgctaaccatctgcctgaatattaatgaatgaactgtgaggactgaggacgggctgcaggaat

SEQ ID NO: 82151 - DNA, 654 bp, Oryza sativa
tcctgcagccctggtaataacaaataagtaaactctgcagactgttgaagctactgacctgaaaccaccacctgtgcgatgggatgaagacagtggtaggaggcctcatgataataacaacaggaggccttatgaaaacagcaacaggtacactatctaccttttgtgttattttgtcaatccttgcaacgtcattgaaaatcctaaccttctggtgaaattgtttaggcaaaacccagctggagcaatatctggccgccaacttggggaagctgcccaccgacttgtggtgaacagcttgaatgctcggagtggcggacaatacaataccccatcgatgccatatcaaaccataatgaatggcatgccttatccaaatgggattccaccaaggatggagcagcctgctcctggctggcatgttcctggtgatctaccaaatggtcaggtaccaccagcttatgcatcatcatcaggtcattatcagaacgataggtctgggccttctcagtatggacgagataaccatggaaggtacccatatgcaagagacaaccaccatgattcaagagaagggttccaccataccatcagagcggtggaaactcgtatcaatcacattctgctccatcagcaggtcctggacggtatgcg

SEQ ID NO: 82152 - DNA, 58228 bp, Oryza sativa
gattcagcagcagcaacagcagccgccgcagctgcagcaaaatgcacaagcacaactgcagcaaccagcatctcttcctctcaaccagatgcagagacctcaacttctaccaacgaacccattatctcagatgctggggaatactggctccaatcttccgatggcctcaagccacatgggtaacaaggtcgctctaattctgtgcagcttcagatgatgcagcagcagcaacagtcgaggaaaatgatgatgggcctcggctcgcctgccaacatgggtaatatggttaacaatgttgttggcctcaacaatattggaaatgttatgggaatgggcaatgtgcggccaatgtcgtccccaatgggaaacatgtcaggcttagggaacaaccccaatcagatgagccttggaatggtatccagtctctctgcacctgggattcgtccaggtatgacacatgctgctattgccaagatgcgaatggggttgatacagcagcaaagagcagcaggcatttacccccagactagcatggtcggaatgcctgggagcagttctccgattcttcctggttctgccaatttgtccatgatgaatcagctaaacagaagcaacattaaccctttgcagcgggccatgatgggtccaccaaagatgccaggcagtaattacccgttgactccgcaacagcaaatgcaactccagcaacagttccaacagaacccgctgcagcagcagcaactgcagcaactccaacaacagcagcagcaacaacaacaacagcaaatccagcagcagcagcagcagcaacagcaacagcagcagcagcagcagcaaattcagcagcagcaacaacaaatgggctctccgttacagcaggcggcacaggtgggctcacctgctggttcgcagcagtcattggtgatgtcgcagcatcagcaaataagcccacagcaaatggccgcgatgagtccacagctgagctcaggcaccatgcagcaagtgaataacaatgttatcaaccacgtagccacaccaggccctcctcctagcccgcagctcagctcacagacccatgggtcggtcaacagcatcgcaaactccccaatggagcagttgcaaggtgccaataaaggaggtccagggagcatgtagtgacggcaaataattgtttctgtgatggacatacaaaataatgcaaggtataaatatcggcagtgatcagcactttttcttatttgttgtggtaaatgatgttaaagttaggtgtcctgtaagttatagccaatagatgaagatattatggaggatcagccttacgcagggatttctgatgttgtagattttagataatgaaattagtacctttaggggattggtactgatgaaagttttgttcaatgggactactttcttgtttaaattaattatcaagtttgtgtaatagctatgtaaccgtggtgcttattaataagtatcttcatttgattgtggaaattttgccctgcttttcttgtaataatctggtataacactgcgattttgttgagctgtctacatattctgtattggtattaccacagtttttggtggaagaatagacggcttgttcatagcagttcatgtgatgccatagaagtatgtgtaatgtcatagaagtgtgctgtgctgttcatgcaacatagaatgcccaaaaatgacagtgtatcaattatttcccaggtgatgttggaagcctgaattatgacatttgagtgtgaacattaatgctatttcttctacatattacattcatgcttttacaattattgtgcatgtatgcattagacaagatgtaatccataaatccaaaagtattgggattcacaaagcagcttcatttggaacttggaagaagatattgcgttccggaatagtgaagccttggtcagcacacccggagaaaatttaatggagtcaaaataagtggattacatatgaagcaattcatagtgcataactcttctagctaaatttaccccttctttttcatgatttgatcgtataaataaaatacagtccaagacatactcacatggagtttttggagcagggcattatcacttatatactttcatgagatttcttattctactataagtgaatgaagcgattacttaaaattaaatactattggaggactgcaggagcttattctagataaaattcatgattgtttaattcatctataatggtaactgcagcttgtctttgctgataacgatctgtgatgccataagaaagcaggcagattggcaaatacgcacacatcaggttctagagctttatcacatttcagttctttatgaaataaaagttcatttttgcaaacgatttccattttcaaacgagcgtcccattcgatttccatggaatcaaaatcatatatacggaccagatgctcatagttgattaagaaaataactcctataaggagagaggaaacatattcccaagacctttgatgaattcaatcattgttgcgtctgaccactctgatttccaattcccaataatgggatgtatgacaactttgcatgaaagagccgagttaggatcaccatgttgagcaaaatgtatccattttaaaaacaaaatagcacaaatcaataagataggccatctcactaaggaaccaaacttgcatgttcaaagctcttacttgagggaagggacgaagggtatcccttcaacatatgtctaagatgattctaaataggtgatggactttcacttgaaagggcaatcttggctgtttaccctgtccttacttattgggttgtcaatcttacgacttggtccgaacaatcttcataagcactacaagtttcattttcaaaaagaaaagaatcagaggattctaacatataagagctcttcttttcatgtttagttagaacaagagaattgtcataaaaatcaggtaagttgcagcaagttttgctaggaaaattcatcaatctaatgcagttaaccaaagctctatcctctacgtagctattaaaatttagacaacataattagtaggacggttcaaagtgtcatgtcaatatatatatataactgttctatcacattggtttgtctgaattttagacaactccatgtcaaaatacagcttgcttgcaattgtatgcttagaataagggcaactctgcagcaaagggctgtgcctttcatgatatttggaatgttttcccttaagctagttgaagaggttcagttctcaactccatgtcaaaatacagcttgcttgcaattgtatgcttagaataagggcagctctgcttccgttctcattttcctggtaaacattttcaatcctctaccatcccatacaagggtcaaatactctaaagctcctgcttttggtaaaatagaactcacaataacacttcataatgaatatgccgagcaaatttatttttggagtacataaagacacaaggtagacagtagcaaatataaaaaaagtgctatatcctatagctttttatatcggcagatcaccacaggtacacggaaaactccattttattgtaagtccaggtctactacacatgtaaatgatgtttggaagctgtatgcaaacaaacctagtaattatcagacaaaatgtccaaaggccagcaaataccatcagaaggagcaccatgacagcatttggcaagccacctaggaaatgatgagtgtcagtactacgattggttctatatagaaggacaaactcaatcttggtcgaatgctcaaaatgacagatgacgtaccttcaaagttatatcattctgtaggccgacaccattattatgttacatctggaagaatggatgaacaacaagattttctttgagcctatgcaagcaattcattggcagctgaccatcaaactggaaagaagccaacacattgcccttcctatcacagtgtaaaatccgattcgagcatctgaccagcacatccccctccacagaaacaaccatcgcagaccagccaagatgctcaagattacactccgggaactgcctaatctgcgccatcggcaattcgatgcggtgcttgcatgcccaagtgctcctctcatagtcctgcagcacccaaagatcgatcctcgtcgtacattcaaccgcggagaagacaagggtgctatccatctccaacaaagacacccaaccaggtatcgccgggtggcgcatccactggaatgactcgctcgctgtatcgaacaccattatcttgcagcctccatctctgtgcctcagataccagtgcaggttgccgcgcaccagcacggaccgatcgccacgggcatgcatcagaaattcccttgccaatggctgctccacagtctctgatcccattgtcattgtgatgcaccttggttcatcggagcccaatgtgaggatgtggtagacacactcttcttctccatggaattcaccatacagcacccggtactcaccggaggggttgtgcgggtaaagccccaagaaatcggcatcgacgagctgcgggatttcggcccagtgattggtggccgggttgcagatgtagaagcggccggaggagaggagcaggaggccgtcgcaggaggcgatgacggtgtagccgagtggcggccaggtgtggtcgacgacggggcggagctgcgcggcatggaggtcgatggcgccgacgcggtcgctgccgccgcggcggaagtagatgagggggaggtcccgctggcggtggtggtgggcgcggaggaaggccgggtcggaggtgaggcggcgccaggcggtgcacacggcgcggcagcggaggacggacctcgccgggaggcgcacgaggatctcgcacaggaccatctcgtcgtcgaggccgccggtgaatccccgcggcgtcctcctcacgtcctcctccaccgactcagccggcgcggagtcgaccctctcctcgcccgcctccgccacccgcgacgcccgcgcgagcaatccgtcgaacaccttgaacctcctctccacctccatcactatctccgcctccttcctccgccgcagcaagccgatcgccggaagaacggcgttcgcccgcgcctccctcagcaagtcgaggagctccccggatacgccgccctccgccgccgcggcctccgcccgggcgaggcgcgcggcggcgccctcggcctccgcctctgaggccagcaccgccgccgccgccgcctccacctcctcggcgctcggcctccgcggcagctcccggtacagcctcgtcagctcctccaccgccgccgccgccggcgagctccccatcgccgcggaacggagggagtgaagtataataaataaataaataaatttataaaatagtcgatgcgaagtagaaatggtaaacgttggagactgataaagtgataattaataatcagatgagatcccgtctttttcagccgtccgatctgggatcaacggtcgagattggtgtttcacatgaaaacatcgaattcgcctcatcatcttatattttctatttgatcaagattgacaattcgtgatctaatagttgatatgaaatattttaagtttttttatgtgagcttttccttcacggctgcctaagtgcagattaacatgtacacatgggattatgagatggttaaaagcagtggcggatttaggatatttctgtggggttagctgatcccacagctttttaaaaaacaccctataaaccttaatttttatgtataaattcaaaaaaattagagaaatgaccccacttaaatataaaccactagtaattgatcccacaggtattaaatcctggctccgccactggttaaaaggttgatttctgaagaaacgaaccattctagaaaattgagacctaagtcgatgaagacagccaaaagtttcccttaacaaacacagcgtttattaaaaaggttgttctcgttccaaatactgcactgcataaaagtgttcgatctcagaatccattcataaaccatggccaagaaagcaagaaaccttgcctggtattcatgcttcggtatgcaaatttgcaaatcatcacatgattgtgcaaataaatcagctggatagcttatacaagagcgtgagaaaccaaaaaaacgtgtagctttctgaagctttacttgctacctcaggttgactcgcttgtccaaccagattactcacccaaaagacatagtttttcccctctcaattgtcaagcatcgcatcaaagtattgcacttaagtttactacctcaaatcatgcataaatttgcagttttccccatacgggcaccatccctgttgttgataaatgaagcatggcttccatggtcgaaacctctggggattctggttatgattctgcctgtcatggtactggtttccgttcattccctggcgaccatggtaattctgatgatggttctgttggtgatgatactgatcttgagacatttgcctgtgaccataataattctgatgatggttctgttggtgatgataactctggtcctcccaatggtaatcctggtttcttgacctgagaggttgatgcgtttcgcgatcgacacgagcctggtgatgaccagagccattggaaccatgttggtatgtctttgccttctgagtgaaaggctggaaggctggtttatcatggtctgtagagccccaattgttactctgacgatccatgaagcctgttcttgaagtacttgtcccgccctgctgccaaaacgcttcattcctgtattgatgattaggaggttgctgctgtgtgtaagagactgcttgctgtggagtaggagtaggagtaggtcttgaagatatctcctgccgcctcatgttctctgatcctccatgttgtctggatggaggagcctggtgattggtaaaatcttgtctggcagctgatgtttgggatactgcagccctttgctcttgcgaaggaggaacccgcggaagcgcttgattgtggtgttgatgtttgggatactgctgtgggtatgcagaactttgctgtataggagcaggcttgattgattttggcggctgctgctgctgctgctgctgtgttgtttccacttttacggcatgttggagggaaggagcctgatggttaatgagctgcgttgtgctagttcttgatgttcccttttggagaagcacttcgttgtgttgttgaggatgagggaactgtggcaggtaatggagcaattgctctgtgggagtttgctttgatgataaatgttgctgacttgagttcccagattcaccatgttggagtgaaggaattatcttctcagctctagtacatgaaagacacgcattagagaaatgacagcataattttagatgtaaaataacagagaattccctgcatgcattttctttcctatgtaaatctcatatttagatggcaatgcacaacagtaatcctgacaaaaaatatactacaatgaagcaaaatcacactttttctaacatgagaaagtgatagcattcagaagtaccttttctgaacagtattcgtagtcaccgtatgttgcggaaaaaccgcttgagatgattttttattcatgttgtcctgtcctttgctcttgttttccttgttcctattaatcataacaacattttgagaagtcaaaagttttcttttacaatgatatgaactctgatcacaaatttaagatgtagtagataattaaataatgctactgacgagaggaaaaaatcatagcatgtgctaccattctgatttagttaagtttcagagaaagtgctgtagaaaattaggacacatggctgggatctccaaaaaaaagcagttagatttcttgatcagtcatatgtttgatatatcctagcaccatgaccaacacattgtaactagaaatctagaatcagctcaaactttctaattagtctactgtctacttgcatcttcccaatcagaatctatttccaatgtttaaacaatggactggatgtaaacttcataagcaggatgagatgatctcaaagtagcaaattttcatgctggttctgaacagaatattttctctcttttggcccttaaatgatatgacctgttaccatagttttttgaacagaagaattcattgagatgcatacacaccatgacaaaggtttatattataatcatcactaacgcatgtcacagttaataggcttacctatttaatctcctcatccgttcattctctttgtccttaatcctgacttcccttgtcttacgtgccacataccctcttgcatgtttttcttggagggctctgtttctttcctcttcatcaagccatggctgtgagtgtaacagaaattagcttcaataattaagtcctgctttccctaagacaaaatgaacctttaagaacacacctgtctcatggtcttatccttgtagagatttctaccctttatgaggagtggatggaggggaggccatggtttgtaccccctactccataaaatctcaatctgcatttgcatatttctctgttggttttaagcggtctatgatgattattgtagcttaaggcaaaaacttatgctggtaaaaagaagtaagaatttacagtgaacgtgtgctgttgcttcttagtgccatagctttctttgattattcgacctgcatttgtcctttgaccacataaatgacccttgacaccacgaggagctccttttttcctgcagtgataatcaacagccaaagtaaaaaggacattatatataaatattgtgattggagaatcatgcccatcacttcagtaaattaacactctgcctaatatccattaccttttgtaaatattttgctcaaagaccacaacatcacctttgcatgaatcacctatgatatttaaggggtgcataagaaggcaaaaagttagagcttaaacagtccaaactgtagaaagaaaaaaaaggtattgcaaatgaaaatgccattaaattatgtattcgagaactacaactctaccagaagaccagaactatacttcaacgtgggcggtgttatttcagacaaccttaagtgcatgaactacggactatccattaactgaaacaagtttagaaagctttctaattttcttgtcattcatatcactgtgaaactatagcatgaatgttagactgatcaccttgacagttcaaaacaaaacttgacactggatacttcacctctcccatagttttcaccctggttttgaagcacaagaaagtggtcaaacaaaagcagttcatttgcattacaaaatatcaacaaagttgacaagtaacatataaagaagaaggacagattacataaaggatatagttcatactcaatttgtcctctgatgcgagttaggagcacttccttgttgcctgacaatcttagcttgtgcatcctcaaatatgctttgcattcataaacctttagtttctccaactggccatctgtgaattgcaatagcacatcactcatatgatcaacaataagaatatgtgatgaccagtaacaacatggaaatttactatttcgataatgtaccccatgaaactgtagcaatgctaagatacagtttctgcaaacaatttgtctgcttcggcttaaaattacattaagaaatgaaggtttacctgaaagagctaaaacatgacgattctaaaattgtactactgatcaaatttctttggaagtagtagaaagaatgaaaccagtcgtgcacaacatacattgtatcacattacccagttatctcaaattgcgttacaaaacaaaacattttttttttacttttgctaagtcgttttttttcctctcatgtcacactcttcacaagatcacactagcaggcaaaatttcaggccctcccggttaccagtttgcatcacattgttggagatatcacagtcacacaatggcaatcgaagaaagaactgaccatgcatcagcttgtccaccatggctagaagatccatctcctccttccccatcttcggcatccgcgatcctttcctgaaaattgcgaaactcgtacaaaaaccaaaacctaaatcaacccctttcgggaaaaaaaaaagcgagattcacggaggcgaagaaccaacccaaattcgcaaaccaaatcccgattcccaatttgtgatcgcagaaattggacaaagccccccaagatcattcatcagtgtggaaggggggggaagagaggggaggtgggcgcccgaaccgaacctgtccttgcgcgcggaggagagtgacatccgggccatcctggaccgcagcacggcgtccacctcgaggtcaccgtcggcggcggggtcgaaggtggggtcgtcgtaggagcccgcgtcggggtcgcagatgccggcgaggctcgcggcctcggggtcgtcctcctccgaccagtcatatccttccccctcctcctcctcctcgtcgtcgctctccacctcctcctccgatccctcctcctcctccccgtcgtcctcctcacggggcagggcggcgcggtggtcgtcgtcgtcggcggcgggggcggccatggatggcgtggcgggttcgggggttcctcctcgggtcgtcgaccgttggtcgcgggattcttgggattggtttgaagttttgaaaatttggtagatttttggcgtgttgcgtggttggggatttttataggcgtcagtctgctctttgctgggtcagctgagaagcgagccaagcagggctgcagtggcagctgcccagcactacaaacaattttttagaggtgatttcaccatggatggattacatatattttttagaggtgatttcaccagtcaaagattttcatttacaaccatatatctttaccaaccgtcccataaaaaataaatctagtattgaatatgacatatcctagtataacgaatctagacatatgtcatatacagtcctagatttattttttttagacggagggatagtatcatatgctagacaaatgacccgtcttcataggagagagaatatgccatggtcctttgttagagtaacagcaagatgattcgggtagatttaaggagaggagttgcagtggttattttactataagaagggcacgctataacacatccatcaattcacagcattgtgagcaacttttagcaaagtacattaacaaaacaagaaggatttgttcagttaatcatgagaagagatctgataggattggttgcaatttcacctctaaccccgcccctcaatctatttggtggagatacgaaccgaataagacctaagaggtaattaaccctcttctcctcctaaactagcatgcatgaccttgctagagccacaactcatgctatcattttggttgcacggaagcaggcgacgagagtgagctactccctccgcttctataataattgatggattaaggtcaaactttcataactttaactatcaataactttaaaaatatttagtttaaaggaactataacaacatatatatatatttgtctttcaaaacactataataaaattaaacatacatttatttattgtatatattataatagaaaaataaggtcaaagatatattttgtagaccgtgtcattatccaaaacgtcaattaaaataaaaccagagggagttgagaggagggctcagtctgcatgctgctacttgttttccctcattgtttagggagcgctgcaaggagatcaagactgagtaggcgatgttgtgctcgagaagatcaccgatgaggggaaggctgaccatccggttggccagtctattggagggcaaatttgagccaaaattgctataatttaacggaaaatgcaacacatacgattttttttgtatgatcttgttacgataaaacacaacggcatggacggcaggggaacctaacgtgagcgcacggcgcacgcggcagtctaagcgtaattatggaccctaaaggccagttcacctctaaatctgactttacgttcactactccaaactctaaacctgacttcatgttttgatctaatctgcaagtgtgaaactaatccaatagcatacgccatcgacaacgaaggtatgccatcttatttacttgatttcctttagcttcacaatcatctttttttacattattctccctctttttttttgttcctgggcaatgttcatagccatgaaatgctttctttattattatggatttaatctaaaattttcctttgcaaaacatatgccattatttttaatttaatatgaaactagggttgacactatcactgtccaaggtgcaaggaacatatttgtacgtgtaatttgcttaaccctgccacataataaattcaatattgagtgctacaattactatacaataagatattaggaagaatattgcttaagatatgattgaaaagaaaattgctttggttggctatccaagcaagccaatgagatagcaggccaagacgtcgggagcttgggcttggatataggatcaactgacggagaatttttttcatttttaaatttttatttttttaatattttgtaccggcgaaaatatttatagaagtagaccctgccgcttttggaaagggcggcagggtgacgtgagggacaggcaagataaaaaagaaactagaaaaatgcatttttggtggggcaataattgcatttgcccccttgcagcccttgtagagggcggcaagggatctcagtgcaaaatgcgcacaccttgtcgccctccacttgggcggcagaggccatttctataaatattttggatggcatcatatttctgtaaatattaaaaaattaaaatttaaaaatgaaaaaaattcaacagacggatccgtttgatcgtacaaccattgtaaaaaataattcgtatgtatagcagcgctgtaatttaacttggagagtggaataagtaggttgttggagatactcttagcctgtgttcttttctatgggttgggaacccatctccggcacacggaaaacagagcggtccattagcacgtgattaattaagtactccctccgtcccagaatataagcatttttagagttggacacgattattaagaaagtaggtagaagtgaatgatggagggttgtgattggttaagtagtggtggtaggtgtgaaaagtgaatggtggagagttgtgattggttgggaagagaatgttggtggagaaattgttatatttgggataaatcttgagggctaaaagttgttatattttaggacggagagagtattagctttttttaaaaaaaaaatggatcaatatgacttttttaaacaactttcgtataaaaactttttacaaaaaacatacagtttcgcagtttaaaaagcgtgcgcgcggaacacgagggagatgggttgggagcactgaagcaaagacacacagaagttcctactaaagagaattgaggctagtggtgtattgtcgtggggcgcaaattatacttttgattctcttctctgcttcaacggcgttatactagtaaaatctagagcccattagcgtgctaggagcgggagggatctccatacctgacgacggcgcatatatagacgcaattgccttatattagccaggtgaactagaattataaaattatattcactcaattttgcttaggattcactaggggaaaaaaattctctcattccaaacagaatctatatgcatgcgcgcgcgctctctctctctcttccttctttttgtttttggtagagagcatcaggcatagtaacgttcttccatgccttggacacattcttatttgacatgaatctcagtttctctgtctctcgcccaactcgcaacttctcttgcagtaaagctaatctgtacaaagatttaaaggctaacattgtagcgagctgtgtcgtgccaacccacgtgccgaatccacggcctagaaggtgtgatgtctcgtgctagcaatgaaaagggctatgaaaaaaatctaaatatagcaaaactgctagaggagtcgtgtccgtccaagcccacaaggccacaacaagctttggcgtcggccaaggcacagcccagaacatcacgttcccatgcagtgacggaataagttcactttagagggaagaggatagaaggaagaggggagtagtgaggatgacatgtggggccccactatttttttattatttgagtgtgtaactgacatgtgggttctacaagttttattatttttttcgaatcgaattaccgcgtaagcgccacgtcaatatcacatgggatgaaaacctagtcaaagaagtgccatgtaggcgccacgtcagccaaaaccatgggcaatactgccgaggaacctcgtttgcatggttttgtaagttggggatgcgttgtattctgttttgtggtgcagggacgaatttcgaactcagtgacaaattgaaggacctaaagtgaacttattccttatgttatcccacagcaaagccctgctgccgaaacctgtttgcatatgcccgacaccaacttgaaggggctaaggttagggccagcagagacaggacaggaggcccaaccacctacgttgccccagtgaacttgtgtgtgttcatggccagccgtaggctgagaagtgggggtatcaaagctaaaaaaaagctagtgaacgctcgcgtgcacaaacgtgccatttttttaaggtagtgtttttttttctaatgacgatgaagataagttttatagcacgcaaaagaaagaaagctagcgcatgattaattaagctctaattattaaaattttaaaaatagatttatttgatattctaaagcaagttcttgtatagaatgttttcgtatgaaacacatcgtttagcattttgaaaaacgtgctaataaaaattgaggtaaaatattaatcgtagtaaaacaccacctgctgggcgcccttgtccaccacggccaccggaccgccacccttattctgcccagccgatgccgacaacccgcatccgccaaattgatcgtcatcctatcgtgtcagtccaatcgccgtcctcccatgtctgtccaaccgttatccttccgtgttcgtccaaccgtcaatctcatagctaaaaatacttatattttggaacggaggtagtacttcatagtaattgtgaagtttatacagcgaaaacatcaaattaaagtttgtacaacaaaaatgtatgtatacaccgttccatttatacataaaggttatgcatagaaaattttgtttaaatgcgaacacgtgtttgacgcggctcgacggaaaacaaacgttcgcccaatagcctcacccgaactaaacacattgcactctatatagcactctgtatacggattcaaccagaacatacaattaaatgcattgggttttgactagtacctctccagtggttttgtcaaaaagttatgataaccaaagtgggtattgacgtggatccatagaatccatatgtacaacatttgaaaagtctaatttttgtaaagcttttaattttagcctatccgattaaggccgacaatcatatcaagccgttcccgtcatatatattttcaaaatcatactgatctatagaacgtacctccagcttgctagcatcccaatggcacgagagagagaaggtatgtgctagctagccgggccgacgcccgattaagggttcttttattttgtgttagtatctattagtttgtgttttttttacattattatatgccagtgtgtgctgagtttgtttacgtgtggattttataataattggttgtaactcgttgagcaaacgccaaaatattatttattatctaaaaaaaatctctactccaattcaaattgattcacaagaaaaaaacctgatctctccgggagataatattccataacaaaagaaacccgggacggagcaaagcaacgggcaacggcacgcatgtttccgctggggttgtttcgcttggacggacgaccgatcgacagtccaagcacgtcacgttgtgggagagcacacaaaaagcgaggctgctagctagctaaacccgcacacccacaggcagcggcagctcatgctgaacccaaatcaaacacacgccaaaattccttttcgccacgaaaacgttatcgcaaataatccaagtggaaggtatatatccatgcatgttgctggttttttccccgaagtttctttatttctagacaaaattacataaaccaccctaattatgtatcctttttcttttgagattttaatccataattaacttattttgttcaaaaaaacctatccacccaaatattgtcggtccgaaattaccccctctgcagaattcaaccaatttctttcggtatggatttgcaacggagcatatcagctaggtcggatgacagttttgtttgctgtgagctagaagcaatactccattattctttggctgagaacgaccatgagtccgactaatcatatagtcatactggacaagttttggctgatatggccaggcacagaatcaagtaaaaaaagaaaaccaaatcaactactcatgtgtacaaacaggggggaagaagtggagaacttcttggttgagtgggtttttacaataaaattgattatgaaagtgggatctcaaaacaaatatgataaatgaggtgattctgtaattctgtcttatttttctaactggtcatcatgacggtgcaatgtgaaccgctctttttatctttttccgcgttttttcttcatatgaacacagaacggcatgatgatagctactaccgtttttgtcgatacgtctgaggaaggaaagagatcaggcgcgatcgaccagagggaaaaaggagtgtggccacatatgagctgcaactgctagccggcaacgagccaggcagcgtacgatcgcttgggatatcgccgtgaacgcaaacccgatcgggggcacacggcgcgtgcagtgtatatcgctcgaaaagtcgaagcagggcgagcaggtcggcgtggcggccaaaagcggacgcgatatgctctcgtccttagctggaggccttcgttgcttaattcgccaaaattcccaaccgaaatgtcggtctcaataaggatctggggaatcaaagaggccggagagaggcgtgtcgtgttgtgcgaggagatcaggatggcagggtttacacattttcgaaacgaagctcggagagaaaagaattagtatattctattttgagcataacaaaagtttatgaattcgaatccagcttaaaacacttgacaatttaattttgtcctaaaccaaccaatcctgactttaaccatcaatgtttttttaaaatctatgtagtttaacatgccaattttatgttacgaaagtatctctcactatgcatctcacaacaaaagttttctaatgttaaactatataaaattttatggataaagaaagctgttcgatttgttttaaaaaaatctaaaacagatcgaatacaattaactgtcccaaatttcaaaacttgcatcaacattcggatggaaatcttatatttttttttcgattacatggtagacgcacatgcatacacaccactgcacacgcaacaccatattcatacctccataaatacgatccctagaaaatatgctctaaaacggaaatcaatggtacatcctagtcccctaaaacctctttgcattttaaaattacgaggccctggttgtaggtccacttcatcatggaccaacatctcgaggcagcttgattaataagctatcacagcctccttggaccacttctggctaattaattttgttattttccatgttttgtgtcacatgtaactatggggtctatggaaggaagagttgaaatggctctagccatagtctttttgttattgacttcttgtgctttaggagtactattatagtaacatggtactactactagtagaattcattcacgtgcttaaaagcggatacgaggttgcagttcattattggtcaaaactcaaaaagttcatggtaatatagatattttaattctttaagtactctgttccaacttggaagatggattggtcactgtcttctttcaaatctgaaagagaagttacccaacagccggtcggatgcacatgcgcatcgatacaattcaagaaacagattggactactccatgttctcctttacaggaatgtttgattattccaaattactactccctccgtccaaaaaaaaaaaaactcaatttctgggtttctgtgtctaacgtttgactgtttgtcttatttgaaaaaaatatgaaaaaatttaaaaaggtaagccatgcataaagtattattcatgttttatcatccaacaataatgaaaatactattcataaaaaaaatcatataagacggacggtcaaacattggatacgaaaaccgaataattcggtctttttgatagagggagtacatgccaagatgatcaccggtccttcgtaatatcatccacccaccatgaaaaagagaccaaatttaacatagagatgtttgaattccatcatcgttctttcagtatttttttttctgtacatttcaactctttccaatgaaattatatgatccctagcatatgtactactactaaaactactactactacttgtgacagataggaataatcgtgcactgtacaaatgctgcaagcataagcatcctcacggcctcgttaattatgggattaaagctgacgtgtactgatcagagcgcgagcgcgaggtggtcgccgcgcgccgccgccgcggcgtcgtggcgccggtacggctggccgcgggcggcgagcctgcccttcctcttctccatgaaccgctgcagcgacgccttcctcgccaccggcaggtccgccgactcgccggcggcggcggcagtgctggcgagatcgtcgcggggcacgcccctggacgaggcggcgagccgcagcagcgccgccgccctgtccgcggggcactcgtcgagcaccagcacccgcccgccgtagaagatggtcatctgcgccgccgccgacgatgccgcggcgccgcctccttcctcctcccgctcgtctccggcgacgtcggcccccggcatgagcgggagtggccgcaccgccgccgccgccgccgccgtccgcgccctgtggacgttatccgccgccctcacgtactggctcagcgcgccgcacgccgccgcgaacctgctcgtcgccgccgcctccgccgccatcaccggtgatcgatcgatcgatcgatcaaaatcaaccagccgctgcttgctctcgatggggtcgtcgaggtgttcggagaaaatctcgggttaatttcttcttggcgaggtggctcggggggcctcgcttttgtaggcgggaggtggggtcgcgtgggctgggctgggctgggctgcgcacgaagaacacgtgaaaggtgaggaggaagcatacgacgccgcatcgcatcgcatcgcgtcgggtggtggactcgtggggtgtgagggcgacggcgccgcagttcgacgtggcgttgggagggtgggtgggaggctgacggggtggggcccacgtcgcgcgccacgccgactgggtcggggtggtcaactcgtcgcgtgcgtgcagccttccgacacggtgggttgctcaccgtcacaaaattagccgatttatttatttggctcccctatttctttctttgtttggattgtttattttgtaatcatcattggcacatgtttagggtggattccactcctgtattatggataaaaaaagtgatagtataaataatgatttggcttgcaataaacaacaacccgaatgctcctgttattattgtagtatacagtaccactaattgctacaacttgaataaaaataatatgtacgttctcatgtgttcttttatttaggaattattatcatatgaaatatgattatgagtataacatcacataataaaaggaaaaagtacaccgaaggtccctcaacttgtcatcgagctacaaaatcgtccctcaaccgtaaaaccagatataggacatccctcattttacaaaaccgttcatttagaaccttcggtagttttgactccggttttgtccgacgtggcggctgagtcagcgtgggccccacatgtcagggtgtacgcgtcagcgccctctcttccccctcttctcttgcttcctcggtttctcctctcaatcttctctgtaggccggccggcgaggtgaggcgggtgttataggatgtgacactttatagcaatctagaattggatgtgacactttatagtacaatatatctggacaagaagcatgtttggattcgctgtactatgaagtgaccatccgtcactaggttgttatattatgggacggaggtcggagggagtactagattactttctctgttccatattaagtttatttttttatctcatttaatttgtttcaaaataactttttttttctaaaataataactgtatcggagtttgtaaaattatagaataattatattgggactagataaagtgatgaataattgtttcagggtgtacgtactggagtttctgtgcttttgggctctgggtagggcccattccctgacccgagcggagctattaaaaacaccggtccagctcgactgagtcgatagcctatcggcccagaaaaggatcctctgacgtaaagttatctctgacgtggtcactgatagatgggcccgcagtcaccacgttcgtctgattttccgtctgaggatctccttcccggtcggcccatgcacgcggtcacgcaccggctgaccgccgcatgcttccttcgcgtgtcgtgctggcacgtacggacgtacgtaccgcggtgtaggagtactctgtagtacaggagttctctggaagtactaacaacgagaagcttcttcgttgcggaggtcaggatcgagacgtgacaaattggaacgagaactgtgctgaatattggagtattactccatatttcacgttaacatttgaattcaacttcatataactatgattttttttcgatggttctgcaacttttatctcttttttttaccttattaaaatcctggatttattcccagagtttaagtatgccatgtgatccaatcatattgaggtcaaggcgtcggcttcagaagattagatacattttgcatagtaaaatattttggagttttgtgcttttgggctttgggtagggcccatttgctgacctgagccttgtaaagccggtccaactccgggtgctgggccagcctctacgtacgggcaggtaggtaccggccatgccggcttgtagctgtcagcctgtaacgcctctgcctcatatgcatgaactcccaagtcccaacgttacaaaatactacccccatcttagggcctttttagtttgcgaaatgaaattttttttgtcacatcggatgtttgaccggatgtcgaaaggggttttcggacacaaataaaaaaactaatttcataactcgcatggaaaccacgagacgaatcttgagcctaattaatccatcattagcacatgtgggttactgtaacccttatgactaatcatggactaattaggcttaagagattcgtctcgtgatttccctcttaactgtgtaattagtttttcttttaatctatatttaatgctccatgtatgcgtctaaagattcgatgtgatattgttgggaaaaactcttggggaactaaacggggccttaatataagttatttttcacacaacacacataaacatacaaaagaaaaatactagaatatttttattttatcaaatcataaatcaattatttatcactttatctattcccaatacaattattccctaatttcacaaactccaatgcaagattactttaaaaaattgaacttatttttaaacaaattaaatgagctaaaaatgaacttaatatagaacagagaaagtaatctagtactccctccgtcttataatataacaacctagaatcttcataatacaaaaatctagatatgaagcatgtccgtattcgtggtactatgaagtgtctcatgattcaaacctagcactaggttatgtcacatccatataccccattcttttcgattaaatttgtacatattttacctcggtgtgcattaacaaatttttcgaacggctacatagtatatttcgtgtgaaaactaaactttttataatttaaaacaattaaaactcaattaatcataaaataataacttttttgttttacgtattcatactagcttaatcttttatttcatctcggagctataaaaaatgcgggtcattactagcagtactctacatgcttttatttcatcccggagctataaaaaatacgggtcattactagcagtactctacatggacgagaagtttcttggttgcgcatgcagaaataattaactattttattactcttacgagtaatgataaagaatttgccactagaccccatgttatagacaaatgagggtctatgagtcatagatagcgagtgaaaattttttaattgacacattttaaagtgataaatagttaaattgtcccgcacatgcaggccgcacgagactgacaagttggaacaaggattgcgctgaacattacttcctcctttctttcacgttttccttaggtaaatactttctttcaccttaattgccactattgaccagaacaagtaataattgcacgtttgcttgtcacgtttagcctgcagcttaatagaataagccataatttcaattttaaaagtgattttaggactttcattgtagtttaatttcggcatttgcatgcttttaaatcttcaaaaacatgtgtatatataaattctatatgttaaatcgttaataagccatcgcttataataagtataataagcggtggtctaccaacgctaaccaagaacattctaaaagccaccaaatatatatatacgagggaataggctgaagaaaattattactattggtttaaaaaaagatagaaaacgtgtattgggtaatataatgtagcgtgacaaatatttgtggacctgtaaaatgaccaaattaaagagacaagtaaacgtgaacgtgaacaaaagccttacttttgtttggaatgagaattgtgctgataaagttgctagtctttctttggtctgcgctatgcatatccaaccatggataaacgctatagttatgaaaacgatgagccatcgatttatcgcattgtttgcaggcatgcacgctccatgctaaattagttaatttaatactagagtgagttcgcgcgctacgctgcgcggtattgtagcatgtaatgctataactcacagaaaaaggtttgtccaagaagattacataacaacaatactcaattcctcatgtacctacagcgtgataagaacattatttaacctaaatagttctttttataaccaaagtccccagaagcagttccggatagatgataatttatacaacaatttcacgacgcatagtagggatggcaagcatagtatgattcatccaacatctatgggcacaagatgcagtttgttatgtaaaactaactgaaaatagtacatggttaagtttctcataatcttgtttgcgaggactgcagtattaaaatagtatctgtaaactctagcattggccaaaaacccagtcagatgagacaatagtattgcattgatcaactatggtacgaaaaaccaactacatttcagattcattagttttaagtagggacttgactcttcactatgagaactttctactcaagaaacatatccccctcggcaattcagatcaccaaatgcaatacccagcatctgctaaaatcattcttaaagttaagagtttggagaattaactcagcatattagagatgttactaagtagaactcaaaagtttggagacttaagtcagcacatagagagatgttactaaatcagtagaaggaactcaaattaatgaacagatcctcacttcagtctatgttatgctactaatcaaatcagcggactcttaaaatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaaagatcatcatggttaacgcatgtttagggatatttccacaggtatttcaaatggttttcctgctgagcaggctacagagaccatattgtttaatttgcacattgcagcactcaactgacttggtgttggtaagtttatttggtaggcaaaagaattggactggggtgcttcagcctaacacagtgcagccttgagatattaagaccagctcatagaaaagcattaaccgttgatgtgcatggagtatttttcctgtatggtttagaaaatgatcagatggagtgctcttttttttggtcaaaatggtaattacatataattaatgaataaaaataaataataggaaggattaactttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaagggaaaactaaatatttaccatttaaacttaaaaagctacttgcacagaggctgtaaaactacaattctcttttattgtaccatatatgttattcatgtgtatgaagagaacacggggagactatagtagcagttcgtaatggtgtcgcatatataaactcatgtataatcagataaatttaatatatatcaaattatagataatatcacagaatatacacatctagaaatcctcatgattttgtattgacaaaaccgaaccaaactaacatgttgtacccatccaagaatacctcttgtaggtaaattgggagtgttaggattaattttgtagatcgactatccaacaaaccataggacaatacatcaataaagattaaagcatctcctggttccccaaagaaacttcaatgcaagcatatgtagttcctgtacaaaacttgccatgttaattctgcaaagcaataatagtgagaaagccaaattttataggggactttttcacatgataagataaaaacaaggaaatactactattatgcaattactggactgagtgattgatgtctacgcctgtcatttacaaagaatggcaatatatgggcatatggcgatctgtttgcaaagttacacaaaaatataattgaatttcagaaccatctgtggccatcagacatgtaaatggcatatcataaaaaggtacaaacaatgaaaggcaaatgtttaatggtgaggtaaaaagagaaattcctgcagcttacctttttctgttgcctttgcctggctgtcatggctatcgtgttctgaatggctacataagaacatgaatcagaggttggcaaggaagtagcacaagaagctcatgcgatggataaaagtatgaaatgattgctcttaatttgggtatataataatttcattaataagcaacactaatattttacaaagctagtaaatgttgaactctaaaaatggggcaagtctagccgtctgttcacccatatgctgaaaacccacaaataatttgtgtaaaaggattctttgtagtgcatcattgtagaactacttggcctagtgatcatgagaaccatcataaattacatggtaggatgatttgcaaaacaacatagagttcaatttaatggtatttgcttacaattttttttttaaaaaaatattccatgatagcacgtggttggccagtgagctatgcaattacaactttaaaattattagcagtcaacatcttaaactacaatcttataccaaataatttgaacttagatattgtaattttaaattcatacccaccttagtattagcctcgccttgagttgtactaagcaagccccttttaacacatccttatctaccaatgataagtttctgcaatgtaaatgaaagttaagcctgcaacaagtaaatcttttgatcccaaaagatcttatagtaactattcaaattgttgtcccatttacattgaagagcttagttttttactgaaactgaaaacaggtaacaatggaaaacttcagaagaattcattgccctctgaagcactgttaaaaagataggaaaaatttgtattaaatacagcagaatcagcaagaagcaattcacatcaccctggcttagttatccaacaatcaaagaaatgaatagtctttacctaaaagccagatataatgggaggagccatgtaagcgacgcaaaaggtccagcaagcaaactgcttcatgaccatgtaaatggaaccagtgggaacaaaaatagaaggaactctttagagatgattcaacataatatagttatcatttagaacattattcttttatttagaggtaacaacaaaaattcttttgaaatatatttttgaattctgtcacacatcttagcaaactcctcgggccatattaaacatctaggacactcatctagccaatacaacaagatagtacaatttgccaaaagctatttcactaagggaacaaaagctatcactgctacaacaagatagctgtttcactaagggaacaaatgctatcactgctgttgaacaaccaagaagatgcagtgtaaaaaggaaatataacctccagctgttgaatatcaactaattaggctcaattcataggacaacaacccaaaaggtaataaatgcaaccagagcagtgacgggtctggggaagaaccaccaccacctcatcctgccagtctatcttctgcatgtgctagctgcatgacagcatacataaatcatttcattaggcaccatgtttgctctgagatagaacaaattttcagtgcaaagcgatcctgtttggcacacacctatttgcaaaaaaatcaatcaaaaagaactcattatttgctccaaaaactcacctacagacaatatgatagtagtatgttgggctgtacaggagaggcaacagagaggacagcttcttctcgtcctaatcctcctctatgccattggcctacccagtagacagtagaaactcgaaatccacatttaaatcaatgtaatcgctcgaatcacacgcccattgatgaaaggggaaaacacagggagctgctaatcacgcacctaaccgccggcggcgacagggacccgtcgaactcgatgcgtcgtcaccacgtcgaagacctccaaaaaactgttgggggagccgcagcgacctcaaatcgctgggacctccagcagcagccgccgctgccaaacccctgtgctagaggctccgacgccgccgccaggtccccgacctcaaggctatgttgaaaccgccgttgagcccctccatcgagcgcagccaccaccgtacactttagggaagcactgttggaggacgggtaaaacgacggcgctggaaaggccatggaagaggaggaggaggcggcgccgcggcggaggagcatcggcgccgccggtcaaagaagcgagaagcgagaagggagatggggattgggatgcgacgtggagagacgagagatcgtggattccacgtctgggtaaggacggaaccatctagataggagacgaacgatcagattatgtccacgggtgagatcgaacggctctgattcgatggactcaatcgtaaataccaaaattataagggcttttctgcaaaaattaatggcgtcgatcaattaggtttgcagatacgtgtgtcacgagatgattagtcgaaggagtccaaatcgccctggttgcggcaaagctaggagctttaagatatctagtataagccactcaaaacatatactcctcctatcttcgtcttaaaatatagctacacgtgcataatcataactaactattttaaaacgtttaactattttaaaacagaggtaaaccactcgaaatatgtacctatattatcttcatcctaaaatatagctacacgtgcataatcatatctaactattttaaaacggaggcagtctttagaaaaccactactctactactctgaaacctagttcctacgtagtacatatgaacttcgaatttatctttctaaaccactcaaatcatcttaaaaaggcctttgtaaacctgtagcagcgcacgatggaccaaaggtcgaacggagaaggcccctcttcactcttcacccctgtggaaacaactatagtgcgcagagagatctttttagagtggccctgtatcaatttttgcgcaggaaattgcatggtttagttttttttttgttggtgtgtgcatgtatgttcatacatgtgaatgtgcgcacgtgtatacgtacacctacgttagtgtttcgaaaaaaaaggtaaattacatcgatgatatataaacttgcgatatgggtgcagtatgatacataaacttacaaaataattgttttggtgcacgaatttatataatgcgtgtaaacctgaggccaaatgagaaattgaacattactccctccgtttcacagtgtaagactttctagcattgcccatattcatatagatgctaatgaatctagacattaactttctagcattgcccatatttatatagatgctaatgaatctcattagcatctatataaatatgggcaatgctagaaagtcttacattgtgaaacggatgaaatacatagttaatcctacttagttggatatttattaggaacaagcacacatatttgaatgatgtcacctagatatgtatgagcgcaatcaaatgtataataaatgatggtgattatacacacaaataatataaaatatagatgaagtatgcaatgaatagaaaatagtgaatgaacaaaaatatatatccaaatagaggttattcgcacctgtagcatgcctcgttaccacttgctgtttgtgcggattacattctaaatatgctctaactcagtattattagtcacagtctgctgatttggccttctatcgttggtaatagacaaattcttggtgcaaacaactcgtgttttcactgagtgattgtgtctcctctccttctctctcctactattcttgtgaacattgtgcctacatattgttcttgtgaacatcgtgcctgcaggtggagttagcatggctaacgggcactagcgagcatgcatgatgtggtaatagccttcaaaaacggaggcctccatgtcggtctggtggacaaccataaatgactggtagaaagaaggagcacacaagctcgtgccaatcatatatagccatgcatggagagctcatgaccacactatattttaggacagagtaggacttgaaaaggtaatatatatgaaagctacttcaaatgaaacatatattgttctcagtatttttctttgggagtattttctattaaaaatcgttacgtcgtttctacactatataaattattattacctacatttacgtcgttttaatccctatatatggacaatggagatggcccctcttcaggcttcttcacccttgtgggaacaactagagtgctgtatcatctgatccgacgatttatttcaatggtctgtatcaaattttgcatagaaaattacatggtttagttttactctcgctgataatttgaaatgccaacaaaactattattccaagacaacaaaacaagacgatttcgccaacctctatcctaaattgttgcaatctaagccagctatacttctaaacaagccagtaaattggccttgaatcgtacgatcgattcaaatcaaaattcaaacgaatcttggtcacacgaaagaaaaggaagagctcgaattcagtagaacgcggcgtcgtcagtgcggcctgatcccggcgtccttgccggcagcattggcggcgaatggcgagtatgtacggcgccgtcgccccgagccgcctgcgacttctcttctccacggaccgctgcagcgacaccttcctcaccaccggcaggccggcgtcgcgcccgcgcgccgtcgtcgtcccgcccagcgcgcgccgcggcgcgcaccagctcgacgaccgcgccccccgcggggaagaagtcgtcgaacaccagcatccgcccgccgtacatgatcttcagctgcgccgccgcagccgcctcctccctcacgtccggctcgacgtcggctcccggcatgaggagcatcgtggtgtggtggtggtggtggtggcggcgaccgttcgccgccgccgccgccgcctcggccttgacgcaccggctgagcacgccgcacgccaccacgaaaccgccagctccggccaccgccgcaatgatgatccgacactgccatgatcgatatctacccggccccggtacatgatgactctgagcacgcgacgcagcgtgctcagagtacggatataagtacgtacgtacgcggtggatgggttgaagagagcgggtggtggggcgcgtggtttggtttgaatggatggatgcaacccaacaagtggccacacgagacaccatgcgcggcacggggggatgtaaactacactcgcgagaagcggacgatgtcgtgcgaattgagcttagctcaatggattatactaagattttttcttttttaaacctgtctacctgggtttaaattttaacactgattctcacatctatggtgaactattttttttctatgttagacatgtagaaacaaaatattatgtacattggatttcggtatttaggaatagaatgttatgtccattggatttctatagtatttagaaacaccgacaagtgtcgaaactttttttttgaatggcacataggaaatagtacagcattagagaagaagaaaacctgaggtctcacttcatgattatttttctcccaaattctcatagaaaagccctttcgataggaattttaagaaaactggtaggaatcaatcttttttttagaggacttaaacaattttttttactatagaatacaaatcctctagtatttctatatttttttctttcattcaaaggggtcctaagggtttgatttcctatacacacaacaacattgtgaattaatgtttttttttaaaaaaagtgaataaacagtaggttttggagaatacgcaacacagttaacacccaagttaatacaatttgcttcaagtagtcatatgttttacaatttgcttcaacttccatgaataagtaatttactcccatcgtgttacatgacactacacaagacaataaattaacaaaacaaataacataattaatcactagaccaggcttttctaaacaaaattattaaaccatgtttatgttatggacacaatttaaatgcatggttggaacgtttctgttggtgttcacagtcacaaaggagtagtgtattgatcaagtgatggaaagaagaataacgtgcaggccgtgcgtgggcgacttgcatgcaaaatgcaatgaaacggctaacaacacatgcaaatgcaatgaaacggctaacaacacaattggtgcaaacaactcgtgttttaactgagtgatggtctcctctcctactattcttgtgaacattgtgcctacatattgttcttgtgaacatcgtgcctggtggagttagcatggctggacaaccataaatgactggtagaagaagaagcacacacaagctcgtgccaatcgtagccatgcatggagagcacatgaccacactatattttaggacagtgtaggacttgaaaagctaatatgaaagctagttcaaatgaaatatatatgttctccgtatttttctttgggaatagttatatttatggcactatattttccattaaaaatcattaaatcgtttttacactatataaattatttacctacatttgcaatccatttacattgtaaatttagaaacttacactcttgtcagtgtacaaaatatggtataccctagcaacaacagaaaaatataattcatgtatagaatacctcatttccatagaatggaccccctcccacaccaaattatagatatagcatcccaaataaataaagaatactgtcagggttatggataccacatacccaatagtaatcgactaagctcggtaggacccatcatataccaagtcttatacggaacaaacctcgtatatagaagaagttccggataaggaagtactaatagagttctatatgaaaacgacaatgattactcggattgtatccatattggtctccctagttctacttggacaaggggacatctatgggtataaatacaagccccctagaaggagaggggacaagccacaagacacaacatacacacaaaccaatacgtggccaaatatcgacattagagattagtctagacataccccatctggtgtctacggagatcagtaagagagatctagcgccatctctgatctcgacaggtttatattcgaggaggaagactaccatgtcgtcgactacgagctggttatccatgccgccaagttgatgacagttagataggttatcccaaatattatacttgtgtgatccagatgaataaagagcaacaccggttttggccaacaggatgtaaggctattacctgtcagataaggggcacgaacctgtataaaaatccttgtctccatctcttttacctcaatctcgcatataccctagtaccaacgatccccataccatccaaataccgtagtcacgatctcaaacgtcgacaaatacaaaggccatagagttctattcagacttgccccagtactataccgaagatttctaagattatctccatgagtcccttatgaaaatggacctatgagtataaatatataaccccgtgaaaggggcgaaggacaagtaactctaaatcaatattttctgatgttccggttggatcgatattgtcatcgtttctaactcttgcgttccaatatcatttccgagaaaaaaaaatggtaacagaaatggtttaagcatttttcctaccgttttaatccctatggacgaaggtccaatggagatggcccctcttcaggctttttcacccttgtgggaagaactagagcgctgtatcaactccgacgatttaattctatggtctgtatcaaattttgcgtagaaaattgcatggtttagttttactcctcgttggtaatttgaaatgccaacaaaactattcttcccaaggtaaaaaaaaacaaaagtattattccaagacaacataacaagacgatttcaccaatctcaatcctaaattattgcaatctaagccatatatacttctagacaagccagtaaattggccttgaatcgtacgattcgaatcaaaagccaaacgaatcttggtcacacgaaagaaaaggaagggagctcgaattcagtggaacgcggcgtcgtcagtgcggcctgatcccggcgtccttgccggcagcattggcggcgaatggcgagtaggttcggcgccgtcgccccgaaccgcatgcgacgcctcttctccacgaatcgctgtagcgacaccttcctcaccaccggcaggccagcgtcgagcccacggctgtcgccgactcgccgccgtgccgcgcccgcgcgtcgtacgtcctgcccggcgcgcgccgcggcgcgcaccagctcgacgaccgcgccccccgcggggaagaagtcgtcgaacaccagcatccgcccgccgtacatgatcttcagctgcgccgccgccgccgcctcctccctcacgtccggctcgacgtcggctcccggcatgaggagcatcgtggggtggtggcggtggcgaccgttggccgccgccgccgcctcggccttgacgcaccggctgagcacgccgcacgccaccgcgaaccgccagctccggccgccgccgccgcaatgatgatccgacactgccattgatatatcgatctacccggcctcggtacgtgatgactctgagcacgcgacgcattaggccggggtgggtgggagtacggatataagtagcacgagtggtggtggcgcgagcgcgacgttgtgggggaaacatggggattcgcgaggggcgcgcgggcgcgagagaacaggggatcgcatgaccatgggtacgtatacgcgtggcgcggtggatggttgaagagagcgggtggttgggccggcgcctggtttggttggatggatggatgcaacccaacaagtggcccacgagacaccatgcacggcccggggggtgtaaactacactcgcaaaatgcagacgatttcgtgcgacctagctcgattccatcagcattaggaatcgtgctcccctgattttaacttgaaaaatactccctccgtattttaatctatgacgccattgactttttaacaaacgtttgatctttcgtcttattcaaaaaatttatgtaattatcatttattttattgtgacttgatttatcatcaaatgttctttaagcattacataagtatttttgtatttgcataaaaaatttgaataagacaaatggtcaaacgttgattaaaaagtcaacggcgtcatacattaaaatacggaggaagtagaaattaaggttaatatccttggcagttgaagaaagaaattaaggttaatatccttgacaagaatgatagttcaaacggctgcgaagtgaccttagctcaatggaatatactaagatttttcttttttaaacatgaagaaaacagtaggttttggagaatacgcaacacaaaacccaagttaatacaatttgcttcaagtagtcatatgttttacaatttgcttcaacttccatgaataagtaatttactcccatcgtgtggcatgacactacacaagacaataaattaacaaaacaaataacataattaatcactagaccaggcttttctaaacaaaattattaaaccatgtttatattatgcacacaatttaaatgcatggttggaacgtttatatatgtcggtgttcacagtcacaaaggagtgatggatggaaagaagaataacgtgcatgcaggccgccgtgcgtgggcgatctgcatgcattgtctgcgtttgccactgtgctggtggcgatggagaaggccttacgtggaagatttatactccatccgtttcatattataagactttctagcattgcccacatatatatatatatatatatatatatatatatgttaatatatacacatgtatgtatagattcattaacatctatatgaatataggcaatgctagaaattcttataatatgaaacggaagacgtacaagttattactattgcagatttatgtcgacgataactgtaactacactaaggtttaatatttacattgtattttttattaaattatacgagaatttttgtcattataatattgttacgaattattattcacattcgttacttctttgaaactttactagtacatctataaaattaattcattgtgcaaacattactatgatttggttacctctatgatacgttatttccaatgctctattccgttaatcccccttttcatatttttttgttgttccggttgtattgtatcgttatagtttccaactctaccgttgcaataccatctccgtgaaaaagaaatggtaacgggaatggtttaagcacttttcatgaccgtttccggttgttttattccctatggacgaaggttcaatggagaaggcccctcttcagtcatattcacccttgtggaaacaactcggtacactccaacgatttttttcaaaatggtaggtctgtataaaaaatttgcatagaaacttacatgatttagttttgctctctttggtgatttgaaatgcaaactgcacttcttccaaaacaacataacaagacgatttcccaattaatctctctggtaaaatattgagcggggcgccgcatgcggaaacggcctacgctacgatccgtttcgggcgcgcgcgcggcgcttgcaccatgcacttgttgaacaaatacactcgcaggaagtggatgatagcgtgcgatctcctgattttaacctgaaagaaaaaaaaatcaggtaatgtccttgacacggatgatagttcaaacagctgcgaaatgagagtagctctttatacggattctcacatttatggataattaatcattcgatagtagacgatgtagaaataggatgtcatgtttattagatttttataggatttgaaaacactgggaagtgtgaaaagttttaattgattggcacatatgaaaaagaaaacatgagaagaagaaaacaagaggtctcaccttatgcttatttttccttcaaaattcttctaggaaagccccttccataggaattttaagaaaatcaatcatttgtttcaaaagattgatagaataattttctcatatagaatacaaatcctctagtatttctatatttttcgtttgattcaaaggggacctaagggtatgattttctatacacacgcaactgcattgcaaatttatggtttttcaaagtgaataaacagtaggttttggagaatttgcaacacaaaacccaagttaatacaatttgattcaattcagtaatcctatgttttacagttttatgaaaaaaatgtttgttaatgagtaaattgtaccatagatacaagaactttcaaagtgggtgtgatttagcatatcaaattgtaaatcgcttatttcggtgcataaacttgtcaagtgtttgcaaacaaaagccaaaatagcatgtcgtaactaacttcactaagttggacgttgattaggatgttatgtaggtttacatgtcaaaatgatgttacctaagtaagtcatgttaattatacatattaaaaatgtatatgaagggactatgcaatgatacaaataatagaagaacaaaataactgttgggttacgcgcaggctacgatagcataaatcaaaattttctagcgcataacccaggtaccatgcaagtattagattacagatcgttaccactcgacgcgctgcgcagcggaagaaagcgctaagaaggcgaaggaaccctcgcgatgtagcgcgcgtcgatgtagaggaagtagtcgatcgcaccagcttgaccttctcctcctcgtgcgttctcctcgccatactcccacgccgatcagcaccacaaagtagcggcgcctctatcggtatccacacgtacagggacggaacgccacacgcagatgtgctagcacccgcgcgcggctagggttttgctcgtggaggggagtggcggctaggatttctcacgttatgcaatacaatccgccggtcacacccctcacgaatatataggaaccatgactcgagcctccaaggcccgtaggactcctattcggatctctatccgaattaagctcatattagatctcaatccaatccccttattccggcccattaagcatgtgaccctgtaggttcatgcacactcggctgtaacccgaaaactccttttcggtctacgtgtcaacagcggtccctagcagaacgtattgacccgccgggcatacataaagatcatatcggctgaacatctagcgtatacttgaatgaaccactttgcctcatgatatcgattaagctcaaggctagatgtgccatcctctaatagctcaatcattcactcaaacttgcgatagattatataacttgtgatagactcctcaatcatctttagcatggccatgcacttccataatcaataacatcgagggggcacagagatatctctccataggaggggcaaatcccatcttgattattcatatcccactacatgtttcatagcatacccgaaaactacttttgtaactacctaattacagagtagcgtttagcagtcactaagtaagctactacacatgttggaaaccatgataatgtcaggtctaaggattcaacaccaacactaaatgagattactgatgacacaacacatatggctattgcagtgtctcatgttgggtctatccaacaaattgttccccaacatgtgtccacattattaatttggtatttctataccataatccatgagacataatcatcaattaatacatgtgctgatcatttaaatatatttgtttcacatgtgatatttgatcggggatcctttagaaatagtaacaaacaacataaagagtctcataaaagaatcacatattcattaaccaataatgagttatctatttcaaggaataaaatcgaataaatatgtaaatatagtatgtgatacaacaatatgtataaaggtcagttgtttatatatataaaatatgccatgccctcatatgtgtgcgagacattccattccgactaactcaacataattaggctgtgttcgctatgggttgttcccaacttggaacagtagcacggaaaacggagcgatccattagcgcgtgattaattaagtattagctttttttttcaaaaatggattaatttgatttttttaagcaacttttgtatagaaactttttgcaaaaaaacacaccgtttagcagtttgaaaagcgtgcgcgcggaaaacgaggaagataggttgggaaaatggacgtccgaacacagccttagtcagtttctgactagtttgcatgcactagaccacttcgtatatcataatgtacttaaattgcacccacctaataaaagcatcatgtttttttaataaattatttatttattacgcatggaagttgatcgtaccattatttaccctcgtgaaaccacctcttcttatgttgccttttattttcaacttttcttccctatttatctaatggtccatcgaaagatcatttttcccatggttaataggatctgtcaccccagaaaagagttgttgccacctaaaattaagtttgatattttagtagacatgcatggtaactaaataggtaatgatgcatcatataattattatgttctcaagaattttaacacattttttattattgtgtttttttattcacatcgtgtttattataggacactacacaaaccaataaaaacatatgttgcattttactataaattaacaaaactaataacataactaatcactaaaccatgcttttctaaacaatttttttaggttacttttctaaaacaaaattattaaaccaggtttatgtttatggacacaatttaaatgattggaacgtttatattggacacagccacacaggagtgtactgattaaatgagggttaaatgggtatatttgaaaattaaggaaaagaaaaataacgtgtgggccgcgtgcgtgagcaaactgttagcatgcatgttttgtgtggggaataagttcatcggaggtcccttaacttgtcaacgaaagcgattttcgtccctcaaccggaaaaccagatacaacaagtccctcgactattaaaaccggtgcagataagatccctcggcggtttagatgacggttttggctaacgtggcacttacgtggctagcttgactcggtcttcatctgacgtggcattgacgtgccgcttacgtggcaattcgatctaagaaaaataatagatcccatgggacccacatgtcagtttcacacacaaaattaataaaaatggtggggcccaaatgtcattctcacccctatctcccgtctcttctgggcgccgtggggacggcagagatgacctcgacagcgtcctcgccatgggcggcgcgccgccctgctcctccgtcgccgccggctcgacgactccccccgtgccgccgcaccgagggccactgcgccgtcctccgcgtccccaccgcgtccgcgacctcctctgttggcctcgctggggattaccgggattggagggcacggtcgactcccggcggccccacctttggttacaatctctctagccttgactacctcctctgctactggaatcatgcgcttgattggatcataggccgaagctgcttccagtccaagaagagtacagcctctgattcataaccgagccacacagctccaagcaaatgtagctcccaactctccgcctcatcaacgccattgttgcacacacacatagagtacgcctgcaagtttcacatcatgcattagtgcaagaaacgagttcattgccgccctgctcctccacccttgccgtcgccttccctctccggcgggccatcgtcttcagcggcctccgtggtggtgaccgcgcatggctgctcacgcggctggccacaggaggagtcggagcgcccgactgcgggctccaacgacgaggacaacgactccggcgccatcgccacggcgcacgccaagaagccgttgtccaccattgccaccgcgctcgagaaggagatggagtttgagtggcgtcaaagtattgagggcggggatgcggccaccgcagctcgactgcttcttgcgcttcccgccgtcggccagcaggggccacatcggccggggcacgaaaggcggcggcgctgccgccgcgagctcgatggccttctcctttactgccatcgtcaccgacggcggcggaatcggtttctttggaggtagcagcggcggcgtgtcgaaggtgccgagccacacgcgtcgcccgcttcaccaacacccgcctcgccgccaccgccacctccccttcttccccttcctcctcaccgaccgccacgcacgccatccgcctcgccgtccatccaagcaatccaacctcagcagctcaagctgacagagagggtggatgaggcggtgtgggtgtcgccgaccgtgattccggctcaagcgaaggtccggcctcagctcctaagcaccgcccgccgctgctccgcccttctgtaggtgcaggggagagagaggatagagagaggagggaggatgacacgtggggccacgtgggtcccaccattttttattattttgtgtgtgaactgacacgtgggtcccatgggttttattattttttcgactcgaattgtcacgtaagcgccacgtcaatgccacatcagatgagaccgagtcaaattagccacgtaggcgtcacgtcagccaaaaccgcccttaaaatcaccgagggacctcatttgcacctgttttgatagttgagggacccgttgtgtctggttttggttgagggacgaaaatcggattcattgacaagttaagggacctcagatgaacttattcctttgtgtggatgtcactgtgctagcgtataaccatactctcggccttctgggcttttctttaatgttctttggagcctttgtgttgtatgtgcgggtcatggctgcgaagaatcaaggcagcagacagtctgcagtagaatttttttcttttaatatttacaaaaataatctaccggcgtaaaaaattacaaaaatagaccctgccgccctagtggagggcggcaagttgacgtggcagacggcggctcgacgacgccgtctgccgctgtctataaaaattgcatttagccccttgccgctctctggggctaaatgcatttttcgcagccctaaagagcatttggctcgtactttttttttttgcatctgagccccttgccaccctaggcggcaagggacccagatgcaaaaattaccagccaaaaagtactaggcccggactggcttttttgtatggggcgcggcaagggttttcgtgcaaaaaaaaccctccctctcccgtctgccgtcaccgcccgtccctcctccgtttgccacgtcagcttgccgccctagtggagggcggcagggtctatttttgtaattttttgcgccgatgtattatttctgtaaatattaaaagaaaaaaaatgaaaatgaaaaaaattcgtctgcagtacacccaaccacggtagtgcgcaaggacacgtggaacgaaaacggaaagacataagatacgacatactgctccctccgtcacataatacgagggattttgagtttttgtttgcactgtttgaccactcgtctcattcaaaaaatttgtgcaaatataaaaaaagaacaagttgtacttaaagtactttggataataaagtaagtaaaaaaataaataataattctaaaattttttgaataagatgagtagtcaaacagtgtaaaaaaaactcaaaatcctttatattggacggagggagtacttagcaacgaaaccactgcaagatgttaaatcccaattgtctccttctgttgttggcgtctttttcgatcctaacacgagacttacctaaaaatttacggtgttaacggggtcgctaaccacctcgatctagacaactctaaatcaagatgggttttgaagattaaattggctagcggagtcaatttaaagaacaaaacaggcaccgatgccgatttagattgatttgaagataatcacgcgtctcgtgggcgaacggaaggtttacgaggaaacctattaagggataatcgcactctcacgacgaagacgaatgatttatgatgcaaatcgacaacgatggacgaaactagggtaaagtataaggcatggctgaaaagtaaaggtaaaaaataattcgattgtgtagggattgaaatattgtgtggttttgaatcgaatcggccttagcccttataaaggggatggttttgccttctgtaacctctccttcatctccaactcgggacagaaacaaatggaaactcgaaaaataccttcacaagcaagaaaactcgaggcccaataaacataggcttggactctaccgatctgaccggccacatattgccggtcaaactggccccacacaccggtcatactggcctagtgaaggaaacccggcaccttccaaaattttgcaatatttccctatttcgactatagatgccaaattttggcgtaagaatatgtatccattttttttcttccctccgtcgacattcttaactgtttaatctgtttgaccctgcagattgctcgctaatataaaaagggacatacggattggcactaaaggtattggaaatattataattgacacctatagtgcttttcagtcctaaacacacgcccgcgtggataccaatggcaagaactagcacctttgtgtacaactaggtgtcgttttttaattggaactgaaaccaatattttctgttagaaaaaggtgccaattccagctaaaaactgacaccttttatttctatctcattagagttattgattgcgatacccacgttaaaacaagcaactatatgatggtcaatgataggtgttggttccagttaataaaccaacacttttatgcggattgagccggtcttatccaatcgagccgagcaaacctctttttttctctacccttacttttttttgtcgccctctcctctttttctccgcccgcacacctctttgttttcgccctctttttttttctcctcctctcccatctccctcctccaaggcgtggcgatagcggttgccgctccctgccctccctcctcagcatggcgatggctacggctgctcccatcctcgacgtggctgcggtggcggctgctgctccgtgcatgacctcctcctcggtgtggcaacggctgctgccgctcccatccccgacgtggtggcagcggctgctgctcacctccccggtgtggtggcagtagctgctcccctccccgaaatgcagccaacggtcgttctttggtgtggcggcagtttgatttgtgaatattttgtgggaagtttagaatttgggatgttgatctagtaaccaccatatgacgatggtttgatttagaatattgattttgtggggattcttgattttgatttatgattgcaaatgagtgcacaagattttcgttcataccaactaacaaatgtcacaaaaaatctagaaataattaaacttatactcctaatagcattacacgtatctataaagtctcatattcaaattcattatattttaaccatgaaaaaaacacaaaattcttacagatttttacatgaatttaaatatgagactttgcatatacgagcaatactattagaaatacatgtccaatttttctatagaatttttcatgacatttgctagttgtgtgccacgaaaaatttgtacacgttccctcgtctccctgcctaaaatctagcagtgcagagagtgaagcatgtgtaaacacgactagatcgaatgaagcgccccgcgcccaatcatgcggtgcgatccggccgccacaggtttttccggctgccgcggccgttcagattcagcggtgcggcggcacgcagcacaggcagcagcacgtgaaacacgcgagcacagtgcgtgcatgcaacccaactgtacgtacgcgctagctggaccaccatcgatgtgggtagatgagtacttgcatgcatcggtcggatgatggcagtgtacagtcgtacgcttggaccgcggcacgtttcgccaccacgcgcggctacagtcgtagcaggacagctgcagggcaaagctcctcgctgactggccgatcgaggcgcggccacttgtcgatcgctccgtacgcgtgacgagactgtagcggcaaaggccctgcagtggccgaagttggtgtgtgcgtatcatcaggcatcagctcgctagtcaaccgatcaaccaccactcggttccggccccgtcatttcacttatttggaaaataagccaaacaacctctttacaaacgaaaaatagtttgtgaataaaacttttatatttgtatttttagtgatttaaaagcaaaggctaaaaagtataatgcaatgaacccccctaaaatcaactccaaattttgaaaaatcaaatttaaactgataagcataagtatgatgatgcccgataaaaacaacctttatccgtctaataagaaaaataaacttttgttcgtctccgaggaaaaatcaattttgtctagaaagtttacttttttttttccattgaatttcttttatggaggaagcatgttttgcatttctgcagcctctggatatcacaaacgacatataaagagaaatacaaagatggatgaatctatcatagtgtgaactgttaaggagtccattgtgagcctatcaagagagtttttttttttgccgctagctaatttttacggatgtttacactgattgatcatgatagagacggatctggttaaaagataaggcctcgactaaactttaatgttagtttgatctattatggttaaaagataatactagctcatggattgttttagactatgaaattattgtgttgtgtataatgtctcatagattttttatagttactgtactgccgtaagaaaagtggaggaaaaccttttaaattttcagccgttggattatgagatgtttgtattgagcggaagctaccatcaaaatgactgatctttttccttcaggagtatcgaatggtaaacggtgggctttctcatataaaagagatggatggttttcttcctctaaaagacggttttgttaaaaacagctggtattctaagcaaagaaaattataaaaccagagtaagacaatgttttttaagcaattatttgttccacaatgttcatgtcttactacatgaaacgatatgatgtagaaccatgtaaacaataaaactacaaactataaatattgtggacaaatagcacaaagcaacttgccaattatttcttgatttgataatttgttgagaaggttaaaaaaagccagtttctattttgaactacaagaaaatctaagaaaaacagtctactttgaatctggacaacaattagttcctttaaaggcttggaatatttggacacaaaggaatggcttcatctttgatcataagccaccttctttatcctctcggaggcaactttttaaaggatgcctccttttattgtttaggttgaataagagagataaggatgaagtgaaacattggattatgttgtggcaattctagattgtaatctcttttctttcttttattaataaattgaaatcaatagcaggccggggcctcccttgatgtgtttctttaagaaagaatatgtataaaaatcgaccctagaacccaaactattcatgttctcgattgccttgatcttctcgggatttgcctctattcctctgccagagacgaggaaaccgagtagcttgcccgacggtactccaaacgtgcacttctctggattgagcatgaggcgatatcgtcggtggttgtcgaacgtttcccgcagatcgtcaatcaatgagtcgtttgtcttggtcttgacaacgatgtcgtcgacgtatgcctcgacattgttgccgagctggtcgctaagtgcgccctggaccgtgcgctggaaagtatattccctgcggttatcagtccgaatggcatcttaacatagcaaaataccccgaatggcgtgatgaatgctgtcttctcttcgtcttctttcgccatgctgatttggtggtagccagagtaagcgtcgaggaaactcaaaagctcacagccggctgttgagtccaccagttggtctattcgaggaagagggaagtgatccttgggacatgccttgttgaggtcggtgaaatcgacgcacattctccatttcccgttggccttccgcaccatgactgggttggctagccactctggatgaagtacctctctgataaagccagctttgagaagtttgttgagctcttctcgtatggcttattttcggtctggtgcaaatctccgcagtttttgctttactggcttggcatcgggtcgcaccatgagtttatgctcaatcacctccctggggacccccggcatgtcggacggctgccaagcgaacaagtcagcattgtcgcggaggaaggtgatgagcgcgagttcctatttctcgcttagtgatgccccgatcttgacggtcttgtcggggttggcactagagagtggaacgatcttgatcacgccgtccggttttggcgtcttgtttgtcttgctcactttcttgggtggctcagttgtggcgggtaggctgggcgtttgctcgaccatgtcgaggctccgcttgtcgcattgtaccaaaagttttgcattcccttgaatagtgattgttcccttcggtcccggcatcttgagcacttgatacgcgtagtgagatacggccatgaacttcgcaagtgcagttctcccgatgatggcgttaacgctgtatcgaattcagcgacatcaaaggtgatctgctccgttcagaagttgtttgcttggccgaaagtcacaggcaacgtaattttgcccaatggtttggacaaggactggggagtaattccatggaagggttgatcggtgggtgtcaactcgcttcgtggaattctcatcgcgtccaaagcgctagcgaagagaaggttgattgagctgccaccgtcgatgagaacccgcgcgaccttgatgttccgaatagtgggttcgaccacgatcggatagcgtcctgggatgacggcagtcttgggatggtcttcttccgaaaattctatcttctgttcacaccacttcatcttgggtgcagctccttgccatgttgaacagacttcacgttccactttcttgtattctcgctttgaggagtacgctgtggagcctccgaaaatgtgtgaaacgtggaggtcagagtctggatatgctgagtccaattcctgagcagccgcctctgcatccttctcgaccacgcgtactcgcttgcctttttcaaatgccatgtgcttctcgagcgactttttgaaaacaaggcagtcttccaaagaatgtctatccatcttgtgtatggggcaccatgctttcttcgcgtcgctaccttgtgggtctgggcgcttgggagggttcgcgtattctgctgcgagaacttccgcttgagctttacttttcccacttttgcgatttttcttcttgcttgactcaggtgcgtccttggctggtttcttgtctcctccagtcttcggtttgtcgttcttgcgtctcagtgcgtcatccgcatgagcgcatcgatcgacaatttcgaataacctccgagtagtcgtgatgcgcctcgttgccaactcctgagtagtgtagcgatctctgacaccggatttgaaagcgtgaattacagaagcatcggtgatctcggggattgtgtttctgcactcattgaagcgtcgaacataatccctcaaggattcgcccgggttctgtgtcaacgcatgtaggtcgtcttcgatcgcgtggcgcttgtaagttccttggaaattggctacgaattgctgccacagatctgcccacgaagagatcgagtaggggggagatgcatcagccatgaacgtgcagagcctttcaatgcggttggcaagtaatttgccaacgtcttgttgtccgctccggcggcgtagagtaccgtggagtaaacctgaaggaattcttccgggtcggtgctcccatcgtatttctctattgctccaggtcggaatctttcaggccatcagacatcccgaagtgaacgaacgaaagctctacacccagcgctgggggcggtgggttgtcggcgatcatacgtccttcgtggatgtctatctgatgaagatcacgaggatgatgacgatgacgatgggtcgcttggttccggcgcacaagtacgaggacgtcggccgggttctcgagaatcctgtcgccgtctcccgctgttgtctcggcgccgatctccaccatcgtcgtcattatggcgacgtcctcgaccagtatcgcccggcgcccgctgttcacgatcgtcgtgatcgtggttggatggcggctatcacggtgtcgatcttcactcgaatggcctcctcgttcttcattattgtgacgccgtgaagagacgcgatgtcgggaacggttctcgttatctcgtgtgcgtcgcgcctctcggcagccatttaggtgatcgcggagatcaccggtgccgcgaggtgggggggtggctcgatgaggcgattcccgctgttcagggttttcaccattagcatcaccagttggtggttgttccggacgcgctgcagcagcggcctcttcgaatgcgttaccgaggttggccactgattcccgtagtcgttctatccaacgtgcgagatcgtcgttcagaacgggatcgtagggggtttccctcagtattgcgttgacggctctgatgtgttgggccggagtggtcacttgattctccgcttccgcattggtgcgtgctgacgtgccgacatcgtcgatagccaatacctcccgcggcgcgctcgttgtcgatgatccatagtcttcgaggaggtgcaagaatgatggttcgtggggattaatgtcgattaccccaacaaatcgatctgaaattggcgtcgctccttgttccttgtctttatccctgatggggatgtgtgactgctggaccttaggagatggcgtcttcatagcgctgagaaagaccttgcagcttgagaggtcgtgattctttgtcttgtgaataggacaatagacatcacgagttggagaaatgcgctgaattccacgctctttgcaggcgcgaatttcggcgcggatgttgagaaaaacccagcaggcttgtaaagtgtgtttcctggttttgtgaataggacatcaggaccttgtcgcttcggaagtcatcctcgtcggctcgtggtccttgtcggaacgacaaggtttggccgcattagaatccttctcgagctcggatgtcgtcgatgttccattctccgcttcggcgggaggatccttcgacatggagtcgtcctgggttgtaaccactgcgttctcgtttccggtcattgatgaaccggctgagatcggcatcgtggtgtaaaccgggaagacgatttcgccgacttgagtccacaccagcattgtcgaagcaggaaatccctggttgaggttggtgttgacgttgttgtcgacgaagctggatgacatagtagtagaaccttgagcaccaagtccccctacctggcgcgccactgtcgacgtttgatgtcgcaattctggtatttgcatggtatggggatcatcggtgctagggtatacgcgagactgaggtaaaagagacggagacagggatttttatacaggttcgggcccctgaattgtcaggtaataaccctacatcctgttggccgaagccggtcgttgatcttattcatgataatcacaccagtacaatatttggggtagcctatctaactgttgtcgacatggcggtctgacgatctgactcgtagtcgacaacagggtagctttcctcctcgaatccgtgcccggcgagatcagagatagcgctttcgtctctcctgacagtatccggagacaccgtatggtactagccatgcttatccctgaagtcgatatccggcggcatgtcttggcgtatgtcggcttctatgtcaattgtgttgggtgttgatcctctcatggtgggtgtccccctgtcctcttaggggggcttgtatttatacccataggtgtccccttgtccaagcagaactagggaaaccaatatggatacaatccgagtagtccttgtcgtttccatgtagaactctggttgtctttccttatccggaactccctcgaggtcagtttccgtataagacatggtatgtggtgaatcctgccgagatttagtcaattactattaggtatgtagtatccataaccctgacaagtggttataagtaacatggtggcaaaaattagaagacaaaataaaactatatatgtgataaatgagaacacccacacgtgcatgcttacgctaaaaattaattggagaagaccgtagaagaggtcgatagataaatcttgggctatataacacaatactcatgcatatctgtataaacaaaccttgtatttatgtaaaatgcaaatagaatgtgatcagattaccaatcaagtaaaatgtaagcatactagaagaaccacactaccctaaaagagagagaaacaaaaatgtcagggagttttcacaaaatattgtcctagacaaacgtgggttactgggttgcaccaaattgaggaggcaaggaaacccgaagcagaaccgctgatatgtggactagccatagcatccatagcgtggagcggccagtacaaatcatctgaatataaaattttattatatattgctttgttcgttttataatatataacacattaattatatgtctgattcattctcaaaaatatatatgtaaatgtcattctttttgttggtactccctccgctccaaaatataagtatttttagctatgaatctggacaactgtgtgtccatattcaaagctaaaagttgttatattaaggttgacttatatacatttgtatatttgcactactagtatattttttaatgagacaatgctcaaacattctaattaaagtcaacacagtgttattcagttattgtacattaaaaaccgaggaagtacgtatttaagtttattcggctaaactaaaaatgctttaccgttcgtagtacgtacgtgtatcactgtacagccagctcgctatcctgataaccaagtggaacagaattaaggaaaacgtggagacaggaaataaagagagagagggcacgtcgctctcgagcggccgcgacggggatctggtctgatcctgatccttggatgatcgatcgatcgatcagctctatccgtgccctttggaattccttttcctccactacggcagcagctgcgatcgacgaccagcgcagtacgtacgacgtccgtaacgcgcgtgccttttggggttttgggtttgagtttgggtttggccgcctcgatcgctttctttagctcctaaacagcatatttataaacgaaaaataatttataaataaaacttttatacacgtatttttaatgatttaaaatcaagggctaaataaataaaattcgataagaaaacctcaaaatcaaacccaaattcaaagttaaaaatttaaattttgactgataagcataaagataaacgagaagatgggctatttctttatcactggcttacactgttacacatgtggctactggccggtcttcgtggcaaccgggcgataggcatccggcctctggcgtccccattccgaatgggaaaggaaaactacgtgaggggtagccatgggccatggctagctagctgccggcgtgaggtggaaacacagagtcaaaatgtgctgcatgccagctgactggaatgttactcgcgtgaaagttccatgatttctgggcgctggtgcggtgccttagtatgggtgtggccctgttttgtcccccttgaagctatctctaaaaagcaatccaaatggacaatatatatatatatatatatatatatatatattaaatttgtttggtgctccatggtgcccgggcaccattgttgaaattgagtatatacccaattcaaatgagtatgaaactttttcaaatatttaggtattaacattaactactttactaactagttcaaagcaagtttgaactgaatttgaacttgtttttgttaaattttgattctaggtatatagcatccaaatatataattagttaggtatgtaatcatggattgtgaaataaagttaaatttgagttgttttgttgataggtataggtatgaatcgaattcttataactagctatatactcataatttgaaaattttgaaaaatatgagtgattttgtgtgtttgatatcatggtgcccgggcaccatggtgccccatatgagtgtatatatatatatatatatatatatatatatatatatatatatatatatatatatatatatatatatatatatatatatggtgtttgaatctcctgaagatgaagataaaaatgaagatgaagataaagattaagtgtttcatgcaaaacgaggtggtaataacatgtgattaattgagttttaattattataaacttaaacaatgaattaatttaatattttagaacaactttcatatagaaagttttcacacgaaacacatcgtttagcagtttgaaaagcgtgccacaaatatccaaaactttatccactctttgtagtggaaatgaacgggtatgatatcttgatagtgtttaaaggggacagaattaaacacatatttagattacactcggctacatatcacttatagtctgttacaatgacattcagttacagtaaaaaaaaaaatcaggttttacaaattagcttgtctctagatttccgatttttaacatgtttatcccctttttattatttcattccaaacaggctagctatatccattaattggttgaaaattctataagattagcttcaaatttgggaaagatcaataggtaataggtagtcccaaaaaatatctttcacaatgcatgctccctccgttttatattatttttcactgatcaccaatccataagtcccgcggttattactattgacaattaattaaaagagaacttttatgttttcatagctctgaaattcgtaattaataaatatcgagttttctcggtttgaacccttggttgtagccttttcctgtaacgaggaactatagtcattccccttgtacttttggctggttcgaaccattttagatttgggctgtgttcggatgggcaagttcccaatctaaaatatctctttttcatgctcatgtttctaagctgttaaacgatgtgtctttttaaatttctatataaaagttactttaaaatcatattaatctattttttaagtttttattagataatatttaattaatcatatgctaatgagtcactccatttcctctgcgggagagtaatggtgtcgtctgagctagctagtttacacgtgactcatatcttcgctcttctcattataactcaagtgaacattagagcaggtacaatagtatactataagtcagctataaacacatattgagaagataaaagaggatagagaagagcagcgtcccaaaaaaaagacaaaccttaggtttccgtgtctaacatttgaccgtccgtcttatttgaaaaaattatgaaaaaaattaaaaatacaagtcatgcataaagtattaatcatgttttatcatctaacaacaataaaaatactaattataaaaaaatttcatataagacggacggtcaaatattggacatggaaacctagagtttgtctttttttagacggagggagtagccagctgcaacatggacttcaagacacagtgtatgtatgacaggtgggaccatatattaatagtgtagtatatgtttaaaaataactattgtataaattggctattaaatcgactatatatgatttagagctaatagttggttatattattaaacttgctcttagtattttttctatatggtatatcaataaattatatgggctctaccctaaggtgagtcaatgggtctaggatagctctaacttatcttcatgataacgtattgtcatacaaatatatattctcaaaaaccaacaatattgtattttgccgctatatttttactatgacatatgaatgtgtacaaaatataacactatattcttgacaaaatcaaacctatcattcgcatgaataaccaaaacaaaaaatacattattattttgatgaaaattgaaacgagcagcaaggttttcggggcatcaatcactcactattgtgaccagagaggtagtactctcttcttccatactacaactggcaactttttttttttgagatccttgttatcacaaaaacaacctaacaccttgtttaaaacatgggaaatcttttccgattaaatcatgcaattaattgatctctacgaaaatcctaccagtactttgtacttccctgtgcttaaatacacatgttttcttagaccactttgaatgagagtttcatttccattaaataaggtgtcatatcaatattttctatgatgtggaaatgaattaataacgtgggagataaaatgagtttcatctagataaaattatatctatactgtttccaatacaacttgtctcttgtatgtattgcctataatgcttgtaaaaacagcaaaactgaaacaacgtatttaaagagttattttaataatcaattaaggctatgttcgttgtgggcggttggaaacaaatattacagagccgtctattagcgtgtgattaattaagtattagtctattagctattttttaaaaaaaatagataaatatgattttttaaggaattttcatgtagaaactttttttaaaaaaaacacaccgtttaaccgtttaaaaagcgtgtgtgcggaatactagggagaggggttaggaacaccctgcatcgaacaggctgtgtgatacatttgagaacataagaataatatcgaaacgtatagtggagagggaagggaaacaaaacaatcgtacgtcgctcaaattcctcgcgttgacgaattctggaatcaaaacacacgcttgcatgatcgacgaaaattagattaaaactaatcgaaccatctcatcacgtttcttcccttttgttgactcggaaattagtgacagtggtccaaaacgtcaacgacgtaggagaacacctgtgcttcgaagaaaaaacgggagaagaagagacgccaatcgcgatcggtggttagctggcgtgtggcgtgtgctttgaagcggtaagcacaggggatcgatcggattaatggactctgttggccacccaagaaattggcctgcagacgtgtgcggtgtgccaaccaaccacccaagaaaaggtcataggctctcatagcgcacatgctcgctgggctgctgcttctgcacctgcctcttttatactagtttttttttctttactttttccaacatgtcgctgtactactactatgttaaccacgccaatttgttaaccaattataaccacaccgctcccgacgagaaaaaaaacatgacgttttggacacggatacggtattcacgtaattctgattaaataggtaaagtatttaaaatccaaaaataaattcataattattacaataatttttgagattgatctgcttatatgatctttaggtatccaatctaaaaatcttcaaatacattctttttttaaaaaaaagttaaatgatacgaacaacaagtcaataacgacatgttttctcttagattaagggtttgtttggtggagcttctagctctttcaaaaaagtacagctattttacatattctaagaagctatgtagttagaaaatgaaatagaagtgagaaggcaggaaacccagctttcccatattttcagaaaccggctaccgaccagcatttctcagaattttaagctctctaaataggctctagatatcagtacacccaatataagcacaatataaccattctaactcttcccatgcatcattcaattaagggtatgtagttttggtcaaaaaaaataatttaagagtacggtgtataaaatttgcaaaaaaaaagaggttgttttgacctctgcaatacatgaaaaatgttgaaacatgtgctctggaacatggactaaactagagggagagtatgcaaatttgaccaggaatgcgcagaaattcaaagatcgtttcctactactacatgtttaatcagaaagcagagaaaaggtgtactaacaacatataaaagccagtacacatgacaacagtctttccagtcttttgagtaataattattaattacatactatgcatagaaatggagacagttgtacttgtacatcaacaaaaatggataaatctaccattatttttcagaacactgtatatgctctagtggaggaaataatcacttaaatcagtgaaagaactctttgggtttgggccaaagaaatctcaaacagagacgaacttaaatcatggaaaacaacaatttagtcagtacttaattttttttctccctttgtgatattctcctcctctaaaccgggcagataaatcttcagagcccgagccatgtcgccggctcatctttcaccggcgcgacggcgaagcttttctccggcgccggcgacgccaccgccgccttcttgtatggttcgctcgttgtcgtgatcctgcaaattgatatgcacgcatgttaaaatccaatgatttaagaaattactaggggttaaattaacagacaagataataaaaattcagtcagaaaactgctctgctctacttgggagaaagatttagttatggattcgtcgaatttttgtttgaattctaaatattcggaacgaatttgatgtttgtagtgatgttctcacctgtgcttcctcttctggaggaaacgctgcagcgacgccttcctcgcgatcggcatctccgggagcgcggcggcgtgcgccggctgcggcggcgagcacgcggagccggccagcctcatgagctccgcggccttctcgaccgggacgtcgtcgaccacgaccatcctcccgtcgtagaagatggtcagcggggccgtccccgccgacggcgtcgcgacgccgtcggcggcggcggcgcgcggggggaagagctgcatagtccgcgcgtcctcctcctcctcctcctccgccaccgcctcaagaaccgtcaccggcggctgcggctgctggcgctcccgcatgtactggctgaggaggccgcacgtgacggcgaacctgctgctgctgccggcggcggccatggcgtccacctccaccacctcgcgttcgtctcgtttctttctttctcacgttgtctccgcgaagctgcgctgtg

SEQ ID NO: 82153 - DNA, 7195 bp, Oryza sativa
agtgcagtaggttattttctgaaatgtttcagatcttgtagaaacaagttatgcttgtttgtgtgtatatagagtatgtagatcgatctccattgctgctgctttctctggaataaggattatgctgtgtttaggtaggattaggaggagacaaagaggggcgtgatgctgatctagctggtcagctcctggcttccaattgataaagagatcatgtaatatattctgcttggatgatcgttcagcttaatgttagttccaacttccaagttgatcagattcctggtgtcgtgtcgaaccaagctgctgggagttcgtttgcctgtcaatttgttgcttgataagaaattctctgaaagttaattaaagagttgcttcataggaattgaagtttctttttctaggtaagaaagatcagaagagttgataattaagaacttgagatggatggattccgtccgaatcagagctgcttgtcctggattgtgattggttgatttctggtgacaaggaatcctcgtggaattgggttcaaataccatggttgaattccaaaaatttccaaacagcatttgaacagctaccgccttatctcaattcatcgattttgagcgtaattcagagaacaagtggtgttactgaaaattagcttggactcaaaattcgattggttttgctgagctcaacaaggtttaagcaaatactaataacaatctacgccaactgtggcaaacgagtccttagctatgcttgtctcatcgacaagcattgggcgctttctagagaaaacttggaagattcgatcccggacaatgatgaactgaagctgtgatacggaagagtgagatgataattaaggcctcgaggtcatttgcatttcaagagtaaattacatctatggcacatgatcatggtacgccatagctgtataaatagatacaacaaaatttacaaattgtatgattcgatataagttagtccatgcaaatccgagccaaaacaattcatatacgatctgatgtggcgcgcactggtgaccctttcacctgtgagttggaacacacactattagctgttcgtagttttgcagaaaaccccaggacatgtaaatttttccatcaaagtccctgcgtctttgagtgctgtaggacccgaggtagtcagggtcaggagttgaggtggatggtgaccggtgagattgaactttggagctgaaagttcacttcaaagccaacaaagaaggaggcagcgaccacgataagcaaatttcacaaaaccctagatttctgggcttctgtgatgcgaggttttgttattcgtttcatgaaaccccaggttttggaacaaagtgtttcataaaacatcagctacaagcttatattgtctatccggctaatatatttatatctataataaatgtaaaaagatgcatgagatatttttaagtacatatacatgttagctgcttttgaataatcgtttatcatcatggtatgatcctttatgtgtatatttaaccaattatatgttattatcagttagaattatgttaagtttttgtgcattaaaaatttgagaaaaaaataaactatatgagatgaatgtgtactttgagttaactaatatgaatttacgaaaaaaataatcatatgcaataatgaaatgtgagtattttacacaatacgaggtttattgaaacattttaccccaaaactgcttgaaataaaacacaataactagggttttgtgttatggatgcgtcaaaacctgaggttttgtgaaatttactcttttttttatatagagatggattttcatctccagaaagaatatctcatcatttcttgcatgccacctaaacaattgtgaaaaaaaattgttaacatagattactacgaaatatatcatttcacaaacatgcaatgcaaattcaacttttacaagttgcaataaaaaaataagctgaaaatagtttaacttacgttcacagttatatttgttacgacttgtagaagttgaatttgaacttacatgtttgtgaaaagatatgtttcatattaatctatcttatcaacttttttcatattttttataaatatttaggtggcatgaaagaaacgaggagatatcccctcgagagataaaaacactattttgttttctttttgcatgtattatgttagctagggtttatatagactagtcaagttgttgtaccaaaacgaataatttgcaagttattcgagctatctgtatccactatgcaagttcctatgacaggcataatttactcatattttaattagtttgtgctgttgattaatcagtatgttatattttaatggtgtcgtctatctatacacatactacttccgtcttaaaaatataagaacctagtattagataagacacatcctaatactacaaatttagacataccatttgtcgagatttatggtattaggatatgtctcattcatcagtattaggttattatagtttgagatgaagagagtattaattaggcactttcaaaaattctcacgttagcaataaggatccatagatagatctagtcatgggtcacctaggccatgatcctggaccaaaaaaggattaaagcccactatgttcctcgatctttttttattaagatgtagattttatattggttttcgttagcattttttaaaatgtattttgtaaaaaagtttctacatataagttgcgctaaaatatcaaataaatttattttttaaatttatagtaattaaaacttaactaatcatgtgttaatagcttttttttttagtaataaggatccatgatggatctagtcatgggccacctaggccatgatcctggagcaaacaaggattgaagtccactatgttcctcgatcttttttaattaagatgcagattttatcttgattttttgttagtatgttttttaaaccgttaaacaatgtatttttacgaaaagtttctatatagaaattgctctaaaatatcaaataaatatatttttcaaatttataataattaaaacttaactaaccacgcattaataactctttttttttccgcgcccttacttaatatccatcttcattagtttcatacaccatcatttaaatgggatctcatgacttgggcctagcctggatttgtctctgaagtgacctagcttctttgtgtgatcccattatcatagctggaccatattatcaaataaaacatgaaattttaaatattgtggactctttagttttatccttttcaaaatattctaattttcaaattctaaattaataattaacaagttataactaagataaaagccactctagtttatttgaaaataaccaatacaacatatggttaagattttaatattcttaatatcggtagaaatagtccgtgcaagacatagattgacgactagtttatctattttttattgatctcacaagacagtagctccggccatcatcactgaggtggtgtttggatcgagagactaaactttagtccctgtcatatcggatgtttggacactaatttggagtattaaacatagactacaaaattaattgcataaataagagctaattcgcaagacaaattttttaagcctaattaatctataattagcacattttttactgtagcattacataggctaatcatgaatgaattaggctcaataaattcatgttgcgaattagtctagtgttatgaaataggttttatcattaatctacgtttagtacttctaattagtgtcccaacatccgatgtgatagggactcaaatttaatcctagatctaaagaggccctgatattcaatggatgcaatcatataaaaattctgcttctgctcattcaatttataatttaatagaagaagaagaagaaggagaagaagaagaagaagaagaagaaggagaagggacaaattcataggacaacatgcttaacagtacaatcgtttaattaactaattaacggtctaacgctaagccataagctatataattttgctttatgtggttcattggttttggtacgttttatggttaaccaacctagcttagctatctatgtacgtagctactccactagctaatttggccggccttatctgtaaactgtaatttaactctctctaataaccaaattaagccaccaacaatcaccaataccgcttgcttgataggagtatttgggcagcggccgtcgcggtttcgcctttcgctcgctcgcatagagttgcgtgtgcgtcgctgcatctctgcatgcttgactttgacttccgccgccacacccacaacacgacattacatacgtgcatgggagttaatattttttagtatgatcgaatgatatattcatatatatataaatctagcaaatgttattgttattttttctgtctactttgggtgagatcgaccactggcgtttagtgacagtaggggagtgaccgagtgagcatctagaggaaaagaaaaactactcaattcccccttctaaaatataaatatttctagttatgaatagttaaaagttgttatattttaggatgaaggtagtatgcacgatagctagctaggtggggattaattttagatggtttttggacaaactttcaagagccccatctagagtaggtataaaaaattgaataaagaaaatgattccctggtcgggttgatgtaacatggaacttgtcaattaatggtatacagtggtcaccaatatgttagtagatattactatctccgtttttaaatatataacgccattgattttttttaaaacgtttcatcattcttcttatttaaattttttgtgcaaatataaaaaatttatgtcatgtctaaggaacattcgacgataaatcaagtcgcaataaaataagtaataattatataatatttttgaataatatgaatagtcaacgtatttaaaaaggtcaacgtgtcatatattaaaaaacggagggagtacaaagttatctcgactgaaaatatgggttcttaaactctacgaacaacataagtactaaacatgcttttaaaagtcaaaatagaacttatagttatatatagtatgtgtgtttacggtagaaatagaatccaaattaatcttaatcctctgttaaatagatagagatgcaccacctgacataacaaggtagcaaacttttaatatttttgcactgcctttgcttgttggcgttcctactgctttcttgggttgcgtgctaattatattggctggagaggggtacacatttttaaaagagtagatgcaagtcagaatgtggattagctcaaatattctcccctaacaacatagtttaaataagaaataacccccactcatattgatgactcactactgatgcagacttgcttacgatgatcacgaagcagatggaacgaccaaacccttactcgaaaaataatgcattttcacttatggtttattcaagggataagtccattttacaccctccaactctttgttttgtctaaaatacacccaaaactctaaaaccggatatttcaaaccctccaactttcaataccattcactttacaccctcaagtggtttttcagctggttttcacctgatgtggaggtccattcagcaaaaaaataaaaaagtataaattagacccacatgtcagtgcatagccacctcttcttcttcccccatctcttcttccctttctctctctatccttcttcatcccagaccaggagagcagtgacggtggcattcttgagcgccgacggagctcaagcatatccccagccttcccttccgcgccgaccaccggcgagcacgagctcaaggttcgcctctcctgccacctccaagagctccgtcttcaccatgaaatcgagctcgccggcggagcttgagctacttggggacgtagagttcggtggaggcgacagagcttggggacgaggaacgcaagcttgactaggcggcaacggatgcggagcttgagctcgatctcgtccttgaccaagcggtggcggcgctcgatcttgttcttgagagaaggggaaggttggctgcggccacgaggccatgctcgggagaagagggaggttggtggcgacctcgatgcggagcccgccttcttggccgaggtcggagaagagggggttggctacaagctcagaaaagagaggtcgccggcaagctccggcgagggttgatggatgcggatccaccccctcccctcccccttgctgcggtcgaagaagacaggtgccagcagcgcggcctcgagtccacgacgagcttgatggaggagccgacgctgctaggcctccaccaccacgagtttgtcgtcgcccgcgctgtgtctgccatgagcttgcttggagccgcccgcgctgtctccgcctccaactcgagcttgttgggcggtgttaccgccggcggccacggaagggcgtggagctccgagcggcgaggagggggcgctccacagatggagctcactggccacttcggctgctccaggaatggaggggagagtgaggtagaggggaaggaagaagaagagtggaatggaactgacaagtgggaccctcctctttgctgatgtgtatttttttagatgtggcatctgacgtggcatctagttgtaccaaaaccagcctaaaaccgctaaagggtgtaaaatgtccggttttgatagtttgagggtgtcagatatccggttttatagttcgagggcatgatttagacaaagcaaagagttgagggggcgtaaaatggacttatccctttattcaatagctctcttgtgataaacctaattacaaactttttttttgcaaccgtttataataagtttatcctccaggaaagttcactgtacttgagatgtggacctctcgatccccataaatatatacttgagatccctatgaatgcatacttgagattgacgaggtcattatagacacctcgcagtcgatgagtatatcgcttgcactgaaaagaataattagttgtaaatacaagcaatcgtgtcatgtttaagatcactactacagatgtaattatcctggacagcggctcactttggttccaggctggccataagtggctccgcctgcaaccaggcgaatgccggggttgggcagtgggccgcac

SEQ ID NO: 82154 - DNA, 8350 bp, Oryza sativa
cggcccacagtaggcgaccgcttgcgatggtcggggggcatataagcccatagcccgaccggggccatgcatggccggcgttttttctctcctaaacatccacaaattaggggggaaggtttttgacctcaaatctttgattgggttccatataaaaggtgtagagctcgttctccttctttatttgcttctatttttgtcagttttcatcggtggaatacgaagaaacttgcagttttataaatgaaatagtgtaggcacctttttgttttttttatttttttagcaaatacatattgcaatcttttacatgtttttaaaagtaattagcacctacattgaaacgttgggtttgcctctattaagtttattttcatttggatgaaaggacgaatattttcattttttagaaatggatagacagtattctattaatgcttaaaattgctgtggggctgtttaaatagtccgaacaactcgtgtagatagattccactacaagcagtataaccagttgaggtacactcacttagcctctcgaagagttctgtttgcatacattttcaaattaggaacaaaattagctcttcaatttaggtcttccttttaacgtcagaattacatagaaattaacttcacaacgataaagctaatttccagtggaaaatgcgctcattcttgacagaagtgacatttatgcaataaaaaatgcaccgcaattcacctctacccacgtctcatctactcgttcaaatgatttttttttctcacgtggcaccatataatacatgtatgtaaaccaaaccttttaattaaaaaacccgagataaaaatatgtcaattttcaaaatagtgacctagctagctcctaggtagcaactaaacttgaacgaatttgtaccccaaaatataaataaaaaatgccatcttttaattttcattcaaagaaaattatatctccgtcccattataagtgtagttacgatttttcatatctaacatttgaccatccgttttatttgaaaaaaattatgattagtatttttatagttattagatgataaaatatgaataatattttatgtgtgattattttttgtagttttatcataaaatttttaaataaaactgaccatcaaacgttggacacggaaacttacaactgcacttataatgggttggagatagtatagtacagtagtacataaatttgtcaacttgtgatgatcaagtacgtacactcccgccaaagtttaacgtactacctttcttcctcctttataaatataaacccccatcgtcttctccgatgtctcaaacccaatcaaactccaaccaaactcacctacctacccccaacccatccagagctagagctatgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatggtgaggcgatcgatcgatcaagaattggtttgcatcagctgcagaatttagcgtggactgagaggagtttcttgttgtgtttgtcttgtcttgaatcttgcagagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctgatgctgtcaaatcacatcgccattggcggccattgcaagccatggcatggcacctgatgatgctgatccagtgaactggtcactcgttcttgatgcgttttcagtttcttgtacagtgtttttccccagcaacagtgaagtagtattcagttattcactgttcagtcatgagttcatcgcaaaatatgatgtaagtatgtgtcttgagattgttttagcagtggcttttgtttgtataatgtatttctctgtaattaattaatagctgttttcagtgataaactaaattttctgaaatggaaaaaatgaacatgacctattcgatccaagatcgcaaatccgcaacaggcgaggatgatatatacagcagagtataggttcagttttcgaaatagctctgagaggaaaaatattcaagattactgaacaatccatcatccatggcaaatacaacccacttaattatctgcatgatgaaaaatagactattgtcatttctgctacagtacttaacttcccttttagcccaaaaatcgaccaaccaaatcatgttatggtctttctcatgcatggaaatttttaatttcttttcaatagttaagaagagcaagacagaggttacgccaaacattttaatagtgaaaaaataacctcactaatacctcaatggaacgtgctatcagcattgtcttagaaactacattaaaattagagggaaaaacaaattcgggcattgccacggctatatacattataacataggaaggattaactaattggaacatgcacaaatgggtgtttgagatcctatcctttcttctatgtgacgattggtgaggtgttgtttatcatttccttccaactcgtcgcatcaaaagctatgctcaattagctgattagtctaagtccaaggaaggatacttgcatgatgggttttcggtttagtttaggttaggcaacagcaataccagcttccatgatacaagggcacggcactggttttgattatattagacccaaggctaaaagccacaacaatatataatgcattaacttttcttgaagagaatgaactattgttagtttattatatattgatgtaggaattatttatcatgtttggatttggtctgtctaatcacaagattagaagtacaagattagaagtacaggatttctccaacattgacaaaaacagaaccttcaaaccaaccaaatgttttgccaccttcaggctataagcaaagagcttgcgagcctctcttgctatttttcatcaaaatggatatctaaatacaaatttgagaaagcagaatccagaactcgacatcgtgaacagaccttccatgatgggggcctgcaacctgttacataggcgtcccctttgaagggtcggaataaaccccaacacagaagcaccaatacaaacactcaccataggcctctagggtggggccgtcaccgatgacacccatcgataatggggataggttgatgcctggcaaaaattatggttaaagcccatctccgatgattacggttattgatggtctccatttattggccgttgccgatattacacactataaatatcccaatcccttcttgtagtggttatcccgaccaaatgtattgttcacatttgtgtggtgggagggctaggtgggcgaatttttccatttttaaaaaaaaaattagaaaatttagaaaaaggctatctaggtaggggtggattttgagctggcttggcccggctcagctcggtctggctgattgggataacgagctggctcggcttgttatcctaacgagctaaagtcctggcttagctcggcttgtttgaaagctcaagctagctcgtttggctcgtgagctagagcgcacaagcagaacaagcaacgaggtggacgacaagcgaaccgatgaagcgagcaggagaaccgcgtggctagtagcatggtagtgctcgctggacctggtcatagcagcaggctccgcgacaccagagcgggaactcatcggagcactggtaccgcgtcagcaccggagctccaagcttgtcgtcaatccgcacctcgcctctcgagctcctggataagatggagaaggatggcaggcagcaacggcacacgcggaacgccccacgaaaaggaggagaatgggggcggggcggatggcggcgcaggatgcaagctgtggcacgcgcacgtgcaataggttaaagcatgcatcggctggagatccgatattgttaaatccaaatgattagataatcagtaaaacatttgttgcaatcggctagaaccaacttatatgtaatccttataagccgatgcaacgtccagataactcataggctgaaaccctgatgaaacccttattggcaatcaaaggcaagttagcttttatgattctaaacacgacttagtaggtcaaaactaattgatgcaacactaaatgtgaaaagaagcataaagtctaaacaatcaagcctttgattgatttttagggtggtggacacattatattatctaagccaacaaagtaatctagccaatatcgacaaaaccctagatagagatcggtcgatgcaagtagaaaacactatcaatctagattatataatgtatatgataactcgatgtcatacatggacaagattagagtgtcgaagcgatggaagcactaatcccgacaatgcaagcagccataacaagccttacccctcgtcggagatcgaagctaattaatgcaaccccaacttaaaacaagaactagctcatcgagaaagacgaaaacaaaaagggtggtgatttatacccatggatagatactagttcttattggacaagacataaactttcctaaagataaagtaaaagatacaagtcctgattgaactctaaacacacttccctaaaaataaaaggaaactacccgactatgcctaattaatagataattcccaagttgtgtcttccttgaacttggtctcttctagataaacttcatttaattgattaatttccttaatcgaatccatcaagaatccaactattggcagctgacaatttccatcagcaaattccaagactctgaagtcgatactgactctaggccgatgatgacttcggggcttaccaaattttggcgttaacatatacatatatacagttgctacaatttaaataatttgatctattctttgatatgcaacaacaatttatatttctccgttgatttttggaaggcagttataaggggggttttatgattcgataaatattaatgaccatatttgtttcgcttcactgttgtcctttatctgtatttgataatatttctttttgttttcatgccatggatattcgtttttgtttctgaatccgaaatgaatatgaaaagaattgtggacaattagtttccttcggtatctaagccatttttcatctctactcgagtgcggtggagctcatcagtggatctaggttgcggacaggggtgggagcagaagtatttgcagtggttctaggcatgtcggctacccaagatggaggagaggtagagtgagaggagaaagataaagagcaccgggggggggggggacaaaaaaaaggtatttcgcatgctgttgtggaaaaagtgggttgcccccctcaactatgtggtaaactggcatttttacgaagtcctctactttgtgcaactagagaaactgcacggatgaagaaaaaaaagcctaaaccatttttatgtcctgcttgaatccaaccaattaacatgaaaaaacaccaaataacaatatagagaagaagcaatgatgagatattgagactttatagaacacgtgttcgagaaaagagactgtatagaacaaaaacaacgtttttttgggctgtaattacagaggagacaattacatcatgaacaaatactccttttaacattccatctttatctatgtggtcaactaagctaagagtttacacaaattgaatgtcacaaggatatgtttcttcatatatactgaatgcacatcaactgacccgagaagattggcatctttcactaaccccatcatcagatccacttataataccagaactgaattgaacttgaatggactgtgaatgtgctccttgttaagattctcctatagtaatcccaaatcatgtctattttacatagatgccaggataaatgtttttatgatattccttgcagagcatcctatgaactgttgcctagaccagtataatttcacactagccacacttcttttgcaggtatcactacaatgttgcagatggtacgttggcacagcatattacagaaggaaatgaagatggattgttcattagttcagtagcttcttgttcgaatctgtgggctttaataatggatgctggcactggctttacttctcaagtatatgaactttctcaacatttttttcacaagctgagtaattatagtagtcctttttgtttcctccatgctaccggtttcatatccttcacgcaacgtggttagatatgttgcagatttttgagattgttggatggttgtacagcagtggagtttcttctattacctgatagagataaacaattaaacttagaatagtggtagatatatattaaaatgcaaataaactataacatagtggggtttatatttaaaggtgtcaaccaagtaactattacatagcctgatcagttgttgtaacagacggtataactttgatattgtaagctcacccatgatctagtttggtcactattttactaattaacaaatattagtgtttatcatagtataaacaggtcaagacctaggattcaatgccacaactaacagttaggataatatcaaatctatcaatttcatgttggtcttcattaggactcacttgcctttggcgggtgctagccaagccaaaacctccaaattggaggctttcccagttggggttggaaatgtcccaagaatttgaaatagaatgcaaacatcaacaacttctctattcattcaaaaaaaattgtttcgttcaaaacgtcttattgcttttgtcagggatatgatattttagtaggtatataactaaaagccacttacatgtttggagaattctgcttttcactgtccatgtaagcattgctcacaaaatgttggatgttccgggtcagcttattcattgcactccactgccctttttgcttccaaaactcctaatgcatcaagaaacattagtcacttaggcgaattgcatggagttggaattctgaagaaaatgtgtgcactgtttattgtcttgcaagttgtataattctgaactgccatttgcagcaactaaatttcaagatctaagtactaatgcaggaggtgcccacaagtaagaagaaaataaattattgaactgcccaacgagctcttttcaatattcaaactggcttgacaatttaagtgtaacataaaccttgttttgagcagcagagccagtaaactgaagagccaatgcatcccccatttcctcatagaacagcatcaaggtgcttgacaagggctcttctatatgaatctccaaacccttagtctgcaccaatgccttcagctggcgccccaagccgactagtccatccacaatttgggctctgtttgtgcggtctcggctgtctatgcagttagtcttgagcactcccttttgcagcacaattggcagtatctctattatcccaaatttgggttcattcatgctagtactgctacttgcactggtaacatcgttttgttccctgtaatacatgtcgaaagtagaataagaaaaagaaaacaatactattcaaggtggtatcagtatgcaaaggtgcacaatctaaacatgtagtaatgataaatctagagttctgtatatgccatgttacactacagtacattgctagtgtgtatattgctctgaaatttacctta

SEQ ID NO: 82155 - DNA, 6695 bp, Oryza sativa
ccttctggggatattgtaacttcaacggggcttatcttatgatctctaacgtcgagaaggtatatgtcccaataccctcagaatatggtctgcgggtatcccctgtctaggcttatctttgatgccgaatttcgacaccgtcaaactttcgctccagcttcctgacatcggtgaggtatttggctaactcggggttggagcatttgtagtccttgtgcacttgattggcgaccaactctgagtcccctttcacaattaatcgctttactccgagtgctacggcggctcgtaacccggatggtagcccttcgtactttgcaatgttattggttgctcgaaaattgaggtgtattgcatgtctgaaccgatctccagttagagatgttagaataaatcctgcccctgctctttggctgttgagtgctctatcgaaggtcatttttccatgtctcgttatctgtttgatcagctatactgttatcaggaatagtccagtcggtaacaaaatctgcgagaacctggaacttgatagctgttctcagaacgaagtggacattaaattggctaagcttgatgacccacttggcaatgcgtcctacaacatctttgttcctgaccacctcgcatagggggaaagaagagatgaccgtgactttgtgggcctagaagtagtgaagcggtttccatgatgtcataatcacagcgtagagcagcttctgtatttggggatattgggttttggcgtcgtggaggacctcgctgacatagtatatggggtgttgtactttgtccctctcgacaactatgacggtactaacagaataaggtgtggcggcaatataaaggaatagctcttccactggttgacggacaaccagtacagggggttggacaagtaccgtttgagcgcgataaacgcgttctcgacatcctgcgtccactcaaatttgtcctactttttaaggaaagcgaagaaagacggttctcgttctcccatactggcaacgaatcaacttagtgttgctatgcattttgtcaacttctaaacttctttgagttttgtggatgacttcatgttctcgatggccttgaccttctcaaggtttgcttcaattcctcgtccggagacaagaaaaccaagtaacttccccgatggtactccgaaagtatacttccctgggttcagcttcagtaaccctgacagtattgcatagttgcatggcctatggggcagagcctagctatgggacacacaacctctcctatgactccatgttgttcttcaacatgtgtaccacatagaaagtttgctatgcacctcttgttcatcaatctcaaaacggttttttttatttgtgtcgccacaaaatctcgttgattacagtcgagttttcagccctttgattttgctttagattagtgctgaatattatgtttgtgtatgcgtggttcgcgatccgcgctggctacctgcaatctatcatcgatgtattagtgatcgagagtagattatcgctcaaacatcgaatgagtgagagaaagaaactcaccctaaaactaacactacagacctatatgtgcacatcttttctatcaggtaatgtgttaattaagtgtaattattagagatgactaacgaagttaattactaggggcgaatctaccgttggggctagttgggggcttggggcttaagccccagctccattcacattaatgcccaatgtatttctctactccagggttagttaattaggcaaatctcatcaaagaagggtatgaagtagaaagggcatggatgcagcgggaggattgagaagatcctgacgccgtcttgggcattgatatgtcctctagtcagctaacagtagtttgggtcaggtgagaaaacacacggccgatggcaacatactagagcctcgtagatttgttacattttcacagtgcagtttgttttctttcgttttaggtacaagtttgatgttttgattggtgatagactggtagatatgtttgtagtagtttttcataagccccaccttaattttcattagattcgccactgttaattacaccccacttacatctcatttacacatcacttacacatgtaattactatataatcttgggacttacaatgtaaatacatgttgactatgtttttagtgaaaaatataacgccataaatatagctacttccattccaaaatacggtactgcaaagaatatgtatcccctaacccttcactaagaggaacaaaaaaccataactcctgacccctcttcctccttttaagggactatttggtatggctctatcttctatatcccagtttcaaactccaattttagtgaaagctagcttatataggaggtgaagattgtttctaaagtgtttggctaacttggtcagcttccaaaagacctgaaagagaagatagagaggagatggataatcctaccttgtttttctgtttatttaatgtacgattaataattattatttttccttaataattggacgtgtcaatagttgtaaggaggaattaattcataccatccatcccaaatctaatgcccaactagccaaagtggaccccacaatccataggagaatgtatgcctcgtagcaaatactacgctagatatatttgtcccgcacattacatagttcacgaaaacaaaggaacattaggcatgcatactacaaaatactccctccttcctaaatgtttgacaccgttaacttttttaaacatatttgaccgttcgtcttattcaaaaacttttgtaatatgtgtaaaactatatgtatacataaaaatatatttaacaataaatcaaatgatagaaaaagaattaacaattacttaaatttttttgaataagacgaacagtcaaacatttttaaaaaagtcaacggcatcaaatattttgggatggaggtagtatgtgcgatggaatttaaagatgcattaagctcttctatatagctacatgaaaaaagtgggtgctttcttatgtcaatgaatttgaactggttagtactatccaccatatatgaatgtataaaacatgtcatggtgtaatgctaatgatatatattgtcaactagttggtttttgacaattatatttttctaaaaaaagcgattaatttacatttattaaagcaaatgtacacaaagcattttgagatggaatatactaataatcaaatgacatgtgtcgcataaacccttggaccatgtatcagtgagcgagtagtagcgtaggagtactgtgcatctgcgccgcagaaaatctcgatcggaggttgggttgggccgcctttggacacatcggatcgatcggttccaaaccaaagttccaccgtgaaccacgtccacgcacatcccttcccaattcccatggaccggccgcaccacaccacccccgtacaccgtacaccaatccgactcgtccgcccgcgtcggggccccacctgtcagtgacacgtcccccgcgcccaaaccgctcctctctctacataggtgacccgtacaccgagctcatcacctcttctctctctctctctctctctctctctctctaactcccccgacgagagctcgtcgtcggcggcggcggcggtggcggagagacgcgtagggggggaaccctcggtggcggcggcgggcggggtgggaggacgtgaggtgagccccctcggggcgcgcggagatggggatctcgttcaagctgtccaaggtgggcgtccgggtccaccccgccgcgcgggtggccgccccggcgccggcggcggtcgcggcggagaaggcggccgagaaggaggcgaagcgcgaggtgaggaggagggtttctggttgcttgctcgggtgggttttggtcgatacatggtcggtggaggcgttggggcgccggcgatctgggggctttttgtgggtggaagagttggggggtaaacaaaatttcgaaatttggttggtatctcgtggcgaatttgcgcccatttgggttgtgtgtgattgttgtcgtcgtcgtcgcggaaaggtcgggtttttccggcgatttttgactcgaaacctcgtgcttttggtcccgcgtagaggattttacactccaaattgtggttttttttctcctaccctgaatggattggtttgaaagtgaaattacgcgttagagattgtatctggagtgctctttggttgcgaattggtttaaatttttctcgagttcaaagcagtttgtgagaaaaaaatcgaaatattttcgtgtttcttcggaagcatttacacggaagcttgatctttagggttaatggatttagagggcaatagcatgtcagtgataaggactaaataatccttcttttttgtttactatttttctgtttcatcctagatcctaacattgttgaccatggatatttattggacttgtggtttattatgtagtttgggaggatttggtcttgaaaaaaatgcacaattaagcatgttaaaatcccttctcatttgaatacaaatatgatttcttcccagtttccacattggttagttgtcgtaggatcatataatccatctggtattctggtggatacatctagacctttgaggttaatcattttaagtaatgtgatgatgaaggctaagttctaggtgtgacaccaacacacttaccgttccattttcactgggcagtagacaattcaaaatttgatccctggtgtttccttagctcaacttggcttcctaaaaattaggaaggcctcagtttgtgatatatcttgtttgtttcgaattttgtccggctggagattatttttatggtttttgttttgttgcataattttagtatgcaactttcttgccttaagaatcatttttcctatctaccatgaaatgctgacatgtgctctttatgtaggatggtgttgttgaaagagctagtgatgccaatggcatcacgatttcaccagcatgctctaggataattttgccaggtattgtcaatcaaaaatgtttatccaaaatcattctgtttagctacatttgatactaaatggtcaacattgtgtgcagagcacgaggtttccttcactttcagtctgtatgatagaggctatctcattgcaaagtcagcagcggtgtgttccccaactataattttctgtagtgaattataaaattactatttcatcatatggaggttcaacagaaatatgttattttaatctaaattcctttttattcagatggatccttgccagccatcaatacaggatggaaaaacacttcatccctatgacaaggcgtctgaaaaattgttttctgtaagtatgttgtatttcttttgtagttctacatctggtagcctatgtcagatggtcttttctatttgatcaagattctttcaatggtgggttattggatggaacgctttgaggttgcatgtatgagatgtccatgaaatttaaccatgtgattttcaatgtatacgatacatcaatttgcctgcatatttactgattcaccagccttcgctgtcttattgttactgatgaaagaggagaatagattaatatcatgagtatttgtacataaatggcgtgggcagaaacaatttgaaagacaataacctttatttagttttcttgataatgcaacactttacttttctatctaatgcagacattaatctagtaattgttatcttatcgctttttccaacgatacacctatactgtatgtgatcatgcattttcattgaataatgcatgactgctttaagcatgattttgtgcataagctttgagtagcttcaacttgccaatccaagctctagcttagaagcttgcccaggcttggacaaatttcttgttgagtttataatcgatgtcattgagtaaacttgaaagctaagttttattcatccatttatactgcttcttggttcaataccatgtgtctttacagttatggatttcagtaaattaatctattcttctacctttcaaaccagaatgtattaatgtaagaacaaatcacatatcccaatataaacttgtgttagatgctgtgattatggatttttacgaacttttattttagctgattatcgtcatattaattggcaatttgtgtcagtgtttctcaacaatgggttcgtggacaaaataacagcaatgctacttgttttgttctaatggattgatcaattttctcctttttgcttgctaaaatcactggaaacagttatgccatgttgatcacgattaatgccaatacattttaataagccgttttgcttcatcacctgcaggcaattgaatctgggagactgcctgaagatatacttgatgagataccaagcaagtactacaatggatcagtcatctgtgaggttggttattttatcagacttgaggcatgatatgtaattaatgtatgtaaggcaaaggattgttgaaaaatcttatcacaagccttatactgatttattttgctttatgttctatattcccagttacagctagtatatattttcctatatgatagagataataaattttgtctagaagattgcatacccttttcacaggccaatttaccatagaagttatgtatctaatggcaattactaaaacaactattctgtaataattaagtggtccttatgctacataatg

SEQ ID NO: 82156 - DNA, 1449 bp, Oryza sativa
tattttgtgtcgaacataataccctatatgttttatcaaacttaaagaagtttgtctaaaaaaaattaaacacttataatatgaaacataatgagtatatctctatatgatgaaaaacattatatatatatatatatatatatatatatatatatatatatatatatatattgtcggtgacataggatcgagggtatcatgactagagaattgggcagccgcggtcacccacgtggcccgacccccccgagggtgacgtggccacccctccctctgtctccccgaggggtcgggccgctcccgttttggccccgagggctggggtgccccgaccccttgtgattttggcaccacgtgtatgggttaggtgagcacaagcggggctcacctaaccgcatttatcgcgggttggacgagcgcgccacgccacatttaatgcagcatagcgcatgcttatccggtccgtgatcggtcgcagtgtgtgaccggtcacagaccggtcagatcgcgggttagggggcaacaggcggactgacacacgcctcgccccgtcccgtcggaatgatgagagcctgcacgcactcatgactagccggagccggcgtgggaactcctaaagttggcacgtcagccccggccagatacattccaggcttcatcgtaaccattgcaaggaagtcattgtatgaataagggcagacgtgtagcatgctaaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggatagcagccatggcaaatctccgcccattaatgagggagtaacagggagatccccggtgtcaggcgagtgatgacgctgggcctcactcaaagataagctgtgatttagcttccaggcgaaggcgcaagccagttttttcttttttgggaagatagggtgagtccccacccaaaagaagagtaagtagaagtggtgcatgtgggatccccttgagatataaaaggaggaccttgcccaccgaagggagcgggggaaaaagggaagagaaaggactctagaggggttctggagcctgaactctcttgctctccggctttctgtaactccttcacacacagatccaccagaacacaggagtagggtattacgcttctcagcggcccgaacctgtctacatcgcccgtgtctcgtgcacttgctctctcgcgaacattccccagatcgatcgaggacgaagaacctcacttagcgcccccggccgaaccggcaaaggggggcctacgcggtctcccggtgaggagtcccacgctccttcatatatatatatatatatatatatatatatatagagagagagagagtactttta

SEQ ID NO: 82157 - DNA, 881 bp, Oryza sativa
agaaaaaaaataaagatcatgaagctttttttaaaaaaattatcattctacctccttaatcttttcctttcccttgtccttcttcggtggaggcatttttgcgtaccagcaagtaggactgaaaacggggcgggtattttccgaccgcccgcccggccacattatttcgggtcaaattcgggtcgggaatttgggtacccggacccttacacggatacagggttcgaatacgggtaattttttgcggatatgagatcgggttcgggagagcggtatccgacggatacggattatccgggaaattatgcgggtattacccgataatctatccgtatattactcggatagatggacaacagcccaacaagcaagcgcccaacaggccaacacaacaggcaacagccagcccacatccaaaaggcccaccaaacaaagtgccaagcacaaaccctagccttcacttcacagttcagatcagtacagcattgagtctgaagctatcaagcaatgaatgtctacttttgctactactttggtacagttttgctgataggcattatgatgccataagcccctaatatattcataatagacatataggaaatggctgaatggctattgtctatgtggtatatttggttgttgctttgacttgatatttgaataaatattcgtaaccgatagagttcgtatccgtcttggtacgtattcgttccgtatttatgcccgatattatccgtgcttctattcgtatccgataatatcggtgcccgacccgattccgattataaaatgtgggttaggatatgggaaggatgagctccccccgaacccgacccgatttcacccctaccagcaagggatcgatcggaaggggtttg

SEQ ID NO: 82158 - DNA, 1856 bp, Oryza sativa
  unsure (1)..(1856): unsure at all n locations
gtgtcccgttgagtaattgatactctagtcgaanncgagctcggtaccctctcctcctcctccttcagagcagccatatcactttgattggcatcatccttagcacacggttcatcagaatcatccccattcttgtcaatgccaaatatactagcgtgttctccggcctggcagccagccatagctgcaaaacaagcaaagttttggttttgatgtttcccatccaacaaacaaaaaaaaaatactgcctccgtctcatattataagactttctagcattacccatattcatatagatattaatgaatctaaacacatacatatatttagattcattaacatatatatgaatgaatgaatacaatgctagaaagtcttataatataaaacggaggaagtaccaattaagagggatatactgactgatgcaaacgagtgaacaaagcagaacagatgtacatgaatgatgaatgatcgatcgattagttgtggattatatatacactcacatgagtaatctttctccgagtctatgaggctgcaatcacgctcggcaggaatatcaagaactgtcaacgccgccttctcttcccatgtgatctcccgcttacgcttgcctgcaacaattgcaagattcagtccgccgccgccgacgtcgtcgattaccataccgcccctctcgctttcgtccgccatcttgacgctcatgcagaagaagaacacggaaagaaagggacacaggtgagattaggtgcccatacaatgcgatttcgtcgaatcggaagagagaatcgaggcgatcgaggagtgtaccgtagacgtgttcgctggcagccctgatcgccccgtcgccgccggaggggagagagccttagggttttctctttctgtttccccgattatgaagaggctagggtttgtttggtgaggacgaacggcttgtttggcaacttgagggaagggaattgggagtttacaccaaggaattaatggtgagattaagatgggaatttgatttttcatcccagtctcttgtttggtagaggtggtggaaattgatagggagtttagttggtgattagatcattaatgaaaatggatggctgagatttgtttagacgaagtaaaggaggaattccctcctaattacctgcccctacccaggtattgaaaaggagggaattcattcctcaattccccatccccatccccatcccaccaaaattcccatgtcccccaaccaaacaaaacagttaatagactcatccctctaaactcctaatccctcctaaaaactctctccaaccaaacagaccggaagagtaggttacctgatgggcctttttctttggaaaagacttaacctgatgggcctatataaagaaaacccctttcaccgcagcggcggcgatcgatcgacttctcggttgcggcgtgctagggttcgaggagatcgcactcgcaccacgtacggtacgctcgcctcctcgatcgatcccctcttcctcttggtatgcgatgcataaaagaacaaatctaaatattgcaatttttgcttctcttctgaatttatagctgtggcgatgacagcattggcaagatgggtgaactaaccaagaaggtcaccatggagaagaaggaggagcatggaggtggtatggctgctgggaaggaggagaagcagcagccaactctgaaaaagcagcagcaggtgggaaaggtgaagaagaagttcctggattttgcacaggagttgacatgggaggagaaggtggtgagcgttcttgacatcgttcgccgctatcagttagctgaatacgaccccaagttaaaagaatttacccctacccgggtca

SEQ ID NO: 82159 - DNA, 4101 bp, Oryza sativa
attacgcgttctattcatagtcaaatttgttatttttgtttctacttgtataagttgaatttgaatttacaagtttgtgaagtgacatatcacatattgatctatcttactaaatttttttgtgactttttaagtgacatgcaaaaataagtggatatccccttaaggaatgaattgagttttcccatatactataagagtattttcttagtaacatgcgcattaatttgttcaccatacgtattagcgattccgtttcttttctcggttactttcaggttttatacaaaatgtacatctcattaaccatacataggtggtgtttgaatctcctaaaaataaagatgaagataaaaattaagtgtttcacgtgaaacgaggtggtaataacgtgtgattaattgagttttaattattacaaacttaaaaaatagattaatctaacattttagagcaactttcatataaaaagtttttgcacgaaacgcaccgtttagcagtttaaaaagcgtgccacgagtatttaaaatttcatcttcgtcttgttggagaaacggacaagacctatgatataagtactcttgagaaatctaggttgcaactaacattaatgttgtattgcgcaaggacattatatatagtaatccaacgtgggtgctggggggactcgtccccttacaccgtgagatcaccattgatagagataaaaggggaagaagagtgagaaaatgaagagtaggggactaaagaaggaagaaataaatgtctcaacttcaatctggttctggatccgcctaatagtagtggattcgtctagcaagaaaagcttcagcttggacatatatacgtacgtacagaggcgcccggcgtacaatttaaagcaaatcagtctgtattacgtatatattaatatttggttgaggctgttgtactgctatatatatatatattccaaacgcttaaatgaggaaacatacggttatcacccatttttccaataatagtttatcacctaattcctgattgaactagatcttaaatatatagtttagtgagcaaccgccaagtgatagctagtaggtcaggtttaatttgcaggtttttttgcacatcaggcggctaggaagaaacgggccgccggattatattatattgttgcacttaatttgtatgttctcaatgcaaggctttattattttggtaggaacgaagtatcaatgttcggcattgataagcaacaatatatatattatatagcatatagcttagtggttacaatgacctgagtagtacctcaaggttctgagtgcaaatctcatatagagcgaatttcagattgtgttgtttgcggagctaagttccctatttcaatggccgtatatatccggttggatgtagaggccgggtaaaaaaatatccttctctaaaaaaaagcaacaaggctagaaccaactaactaggtttatgtaatcagaagcaaccttcaatgagctacagattttcttgaaaagtaataaacattacattaataaaagtatttttcttcttcatcataaaagatgcataagaaaacgaagttaggaatagatctctccatttcgttgaacaaaaataaaggaaggaaaattaagtcagtaagatatctgaaggtgtgtgtaccctgtttgagtagaaaactccaataatgcgatgtgccaccagaccagagtgaacaagtccaaaaacactttgagcatattattcagaatccatccatcttctttagtatatatattctccaaagaattgaatttgtggtgcactgcaaagacttcaatccagcgtgtgaagatgataacttaaagaagcaattcatttcgaccaagaaagggaaggcacagatatacagaaccctgaaacataggaatcgatattcatatattgtcactgaatcagcagcagcagttgattttggttgagccagaaacactagggtaatattctgagtactcgtcaaggagtagaaatccagatatccagtagtgggatacttaactcataactctgagaagatgttgatcgatttcagcagtgtattcaggcgatcgatcgaactaatcaattaatcgaggggaggccgggagcgactgtcgatctgtctctgtgtttaggcatttaattaggactaaggctgcgttgtcttcttgaaacggctaattagtcacacgtaaaacgataacgtgattcacatataattaattaattaattaagtagtaatatataaagttttgatgaataaatttattagattttttaaaacaacttatgtataaaaagttttcatgtaaaatgtaccgtttaatagttactgctagagagctgatctttgtttggatggcaaaaatcatatttgtcccaattcgaatgggaaccgagactaaaaatcacggttcaaaatagctgtcaggccatgtcaaacccccaactatctttagtcccacattccacatatttttttagtcccatcaacccagactaaagatgtctccagggttagtttaaaaaagaaaacatctctatttaagtcatatgtgtgtagtaggtgggatgataacatgcgtgagagctgaggtgagagattgagttcgaatcccacatcccacacattttttttttgacttggtatgcatctttagtccggttatttcaaccgggaccggattgtgcatcctggttacacaaccgggactataaacggttgcgaaccagggctaaagtccctttctccagcagcgagtttgaaaagcgtactaatgaaaatcgagaagtagctaagctgaaatagctgaaaagtatgaaacctagggcatgcactagggtaactctattcactgcttacatgttttgcaaacgtagtaccattgtgttgccttgtagctactctctgacactctatctctccatatcgtcactagattatcgtggtgacccaatgtttgttgtttatagaaaaataattaggaaaaagtatatataaccattattggggttggtatacttaaccccatgagtatggaaaccggatcaaataacctcctagagtggttttataggtagttttagtatgtaggtggtgacgtggtatttattttgctttcatggcacaaatattagtcaattaaatttaagttggcccaccaacttcttctcattgattgacatggataaaagtttcatagtagtaccaataatgtatattattatcaagccactttcacttgtgaaaaataattacttaagcgattctctatggttatatccattaccctccgtttcacgtggccaaaaccatcgccacatcatcgcgtacatagggaaaaccacattatgggttatttaaaccggtttttatattttaagggtaaaacatatggtttcatttaaataaaagaaagtattggttccataattagcgaggttaagtaaaccaatctgaatacttaaggagactttttttttcaaaatgattaacatataaaaaacaaactgttttaatttaatattatagacgttaattatattattgtaagagcaattccaaagaaaaacatgttttgaaatgagaggaggaaagaagaagaagaagaagaaagactagtgcaatctagaagccttccaacggggaggagagagagggtaatccggggagtaggactagactactactagtacatgagatcgatcgatcgatcggcatctgcatctccgcccccgcccccgtggatctgaagcggcggaagagggatgtcgtcgtcgtctccctccggccacctgctcgcctctgtctcctccgccctcgccgtcctcctcctcctcctcgcctgcgtcgagctcggcgacgctgctgccgccgtcggagtctaccgcctcatccagtacgacctcgccggcgcccctctcggctcccgcgccgccgccctcaaccaccacgccgccgccctccctctccccgccgccgccgacctctcccgctccgccctcgtcgcgccgctcctcgatctcccgctcgccttcctccgcggtacatccctctcctctcctctctcttcttcaattaataa

SEQ ID NO: 82160 - DNA, 2013 bp, Oryza sativa
  unsure (1)..(2013): unsure at all n locations
cgtgctggcctttgattgcatgagcaacgcactcccatagggcgaattcgagctcggtacccatcaggaggtctttttcttttcttgcttcctttcggcaatgaggacacaacattaacattcttagcaaaagataacaaataagggttattttgcaacacagtatgaccaatacatgcattattataccatagtttacatttgccatttgcaaaatggcaataatatccatcaaaatcctatttttatacacttattaaattacataaaaaacatcttgaatgtaaagggtgaagccaatcggtagctctaggcaaagacttcaacagcttctacttttgctttaacttcattggcaactctaatggatcctttgtttctttgcgtagttcctgccgaacggaatccctttaaacaattacacgcctgaatagttactccagaaataatccaccatgtggatctaaaataacccacataatgagatttatttacaaatgtaataatggtctcacctttctttgccatgatcatttttaggaagtcaggacaatctttcttgtaatgtcatgtcttcttgcaatggaaacactgatggcttttcaacagtgaaatgttgatgctgtggcagatgctgaggctatttcccttttgaggggatggtttgtggctctttttcttgttatctttaacatagttaatagagccaccattggactctttgattctttcctcctcttgcacacaattagcgatgagcttttcaaaattccatttctctagacttatgttgaagttgacaataaagttgtcaaaatgctttggcaatgaggccataaccagatggaccagaaagtcatctgtgatacccaaatccattggcttcaacttggaagccatgttgctcatcctaagaatgtggtctcttacaccacccccatggtacctctctgtcacaagctgctttatcagctgtgtcgcataagtctttgaagaaccagtaaactggctctttattctttcgaggtactcagagacggtgtcacactctgggattgagcccaattctttgttgtgttgcaagatgagctttatttgttatctctttctgagaatgtgaatgttgtgtcctcgttgacaaaagaaaacaagaaaagaaagagaactcctgatgtctcatcgaaattatggcactatcgtttaggccatatttcgagggggagaattgagagactagttaagagtgatattcttcctccattggagttctcagatttagaacaatgcatagaatgcattaaaggaaaatttgttaagagcatcaaaaagggtgcaaaacgaagcgcgggaattttggagatcattcatacagatatttgtggtccatttcctgtgaaaagtgtggatggctatgactcgttcataacattcacagacgattactcccattatggttatatttatccaattaaagaaagatcagaagcattggataaatttaagatattcaaagctgaagttgaaaatcagcatgatatagagtttaaaatagtaagatctacccatggggggagtactatggtcggcatacgccttatgggcaagtccctggaccttttgcaaggttcttgctagagaatggaatagtagcccactattcaacaccgggcgaacctaaccagaatggggtagctgaaaggcgtanccgtacccttatggatatggtgcgcagcatgataagctactccgccctaccattgggtttatggatggaggcgttaaaaaccgccattcatatcctcaacagagtttcaagcaaatcggtgcccataacaccgtatgagctatgtacaggaagagtcctaaagttataccgcgataacaaacctacagtaatgtacgctcgcatcaatcagtcaagtggtgctgccaaacacattgacataaagtactatgttgtgaacaacacagtccgggatcaaacaatcagtctcgagcacattagaacagaaa

SEQ ID NO: 82161 - DNA, 13453 bp, Oryza sativa
  unsure (1)..(13453): unsure at all n locations
accatttcaaatatccaggtaccctcctcgtaccattagtttacagtttggttcagtgtttattgtttgatttttgtctacgttatactttaatgtattgatccttttctctttcggagatgactggataaaccatggccctgtggctatttgttggaagtgattgttccagctgatattttactaaagtaatactgtttatctgtgagaacgaacatacctgagatgaatactttgatctgaagggatggttacctggattgaaaggagagggtgaaactgaacaacttccaactattgccattgtttcaaattatgatactttcggtgctgcaccagtacgtcttcgtgaaaaatgtttctagtgccttctttaatattcttctagatattttgcataaatgcatattttctcaggcactttctgtgggaagcgacagcaacgggagtggagctgtggctcttctagagattgcaagactgttttcacgcctctattcaaatcctaagaccagaggcaagtacaaccttctgtttggcttaacatctggtggaccctacaattacaatggaactaacaaggttagttattctcttcagttttttttttaaaaaaatctgctttgtggcatctgtttttatcaactcatggctgtatcttttttgaattttggtacagtggcttagaagtttcgatcagcgtgtgcgtgagagcattgactatgcaatttgcttgaacagcgttggttcctgggacaatgaactctggatgcatgtgtcaaagccaccagaaaacccctacattaaacaaatctttgaagtatgttgaccatttcaagcatgttggtgcataacagttattagttgtcaagggcagtcacttttacacctctgaattcttttgctttcaggatttctctgatgtctctaaagagatgggtgtttcagttggaatcaagcacaagaagattaatgtctcaaatcctagggtatgcacttgtcacctttttaaagagtatatattaccattagttctgattaggaatggacatggtgatggtacccacataatatatttatgatccttatagattttactacattcaatgcaatgtgttacatgtctatctgttggactctgttgtcaacacggcactgtaatatgtaccagaagtattatcaattgttgatgatgttaaatactgtacatattgcttttaattgtcatgtaggctagtattggactgttcatcatagtttttcttactcaaatggaactgaatgatggatgaaaaccttgtggaggtgcatacaaaagaaacagaatttttccacgagaacttttgtgaaagctcatcgtcttaaatcaaatttgactcagaaaagattgccacaagagagacctcattaaaagaaaaatgtattctaagggcccctgtgaattttttatttcttcctgcagtgccattacatggttttatttgtttggccctcatattagcttcccttgttcgactgtctgaatggttcttagttcatatgtcctaagtatgcgtaattaaatatttattctgcccattgttttctcaacccactgatttgtaacagcagaactttactaacttgcctgtttcatgaccatcacaatcctcacaaccactattgcatttatgcatcatactgtgcaatcttcagcacatagtatgtaccaacatactaatttagtttgcaactttgcatatcttctgctggatgatttgctccttttagcatagtagtagcatggcatggaataaaaaaaatgcatgatcaagaattaactggtaattggcataagggccagtttataaattagttccaaacaagataatatcactggatgttatccttgtttactacctaccaattttgaagatgtaattttggaactgtattatttggactgttcaggggtcctattatatttagtcttatgtttgtagcttgccaagtaacatgctttcaaaacttccaggttgcgtgggaacatgagcagttctcaagatttagggtgactgcactaacactttcggaattgtcctctcctcctgactttttagaaagcaccggtggcctttatgacactaggtaaagcacttataatgttttccttttacatcattaatttatgtgtccattttttctaaccttttgtttgtatttgacttttcactgcagagaatcagcagatgctgagtcagtaattagaactgtcagattagtttctgaaagtcttgcggtaagctaaatcattgcttgtagaagttcttcattttgctttatacactagttcattgatgatgtttgttttattatttgttctaacatgccccccttgggtcagtctattatatacagctgaaataattttagagaatgtaggttatttcagtattgtatatttacatttattattgttttctggatgatctgtactgtttgcgggtttctgctgtgtaagaatttgcaaagctgatcagtggttacttgttttagattctagttgttgcttgaacctggtaagtgcttttattctgattaaagaataatttgactgtccctgtggtatgtagggtagagtgttcaactgatttcccactttgcataaaacttactgtgtagctttgtaaaatgtcaatggagaacctcacgtggttatgatggtgcatcagttttacatgcatattacaatgcttttctgttcacgctatttaggttgcattcttaaatgtgataaacacagggcatcgtggcttcaaaatagctactatgattaatgagtgatattaaagctgactagttgcctctttgcctttctgaactgaagttgaccagttcttatatactaattccatttacagagacacatctatggactaaaaggaaagaatattgatgtttttgcggagaacagcagtttagccatcaaccctcactacatccagtcctggttggatcttttatcacgaacaccacgggttgcaccgtttcttcagaagaacgatccctttatagcagccctaaagaaggttcgtttgccttctatcaaatagagtattcatctagttcacctagttcgtagttttcttgcaaaccatgacatttcatgccctgttgcaggaactatctgagcacactgctgatgtccacgttcaaagcgatgttcttgatggcatgttcactttctatgatgcaacaaaggcaactctaaatgtatatcaggtaagtgtttaggctttgtgtcatttgttcacgtttgagtagaacaattaaaccttgcagcagaatggtctaatatgcttattgtgaagagcatatgccctgctttgtgattccttatttttatgctcgtccgtctcaaaatatagctacttatgcctcttttttggagggattaaggctgagattggaaatggttgtgattggttaagatgagaaagtaggtgaagaattaaatcagggatagttgtgattggttgagatggggaattaggtcgagaagtacattatgagaaatttgaatgctagatgtagctatatattgagacagagggagtattataatattctgctcatgtattctgttatgaattgcttaacagcaacaaagaattcattttaaatggacttatgcaagatatgaacacattgaaatattctcatacattcttcgaattattaattcacaggttgcaagtgttacttttgatttactgttccttctggtgattggctcctacctaattattctcttcagtttcctagtaatcactacacgggtatgtatcatttcaagccttcaaatataagacaggaagctttgtttttcctgcagttgagaacttattttttttaatcagggtcttgatgatctcatcaacatattccggcgaccaccatcacgcaaggtcaagggggcataatagaatagattgtgctttgtgtattagtatccaggaacgcgctgctagttagaagagctagacaccaggacgacaggcgagacgacccagctctccacagcaaacagacttgtaatttcaaaattttcatgttcgatagccaatgtgagtggcttcagatactgcaaggcagaaacatcacgaattttgactgatgaagctgcattttgttttatgttatttttgctggtgctcgccattttggctaccatggaatcaaagggcctcttttgcagaattatcgatcctgtcagcaggggcgggctcaagatttagaggttgggtattcgaaataggtaaggggtaaaacaaatttacacccaaaagtctaataattggtttgtgtaatatcatatacaagtaatatattatatgcatgtagcccaaaattatatacttaaagttaattaaaaatttttaagtgttagcaagaccatgtgtgatagtgtatgactgctgcactgctacctgcttgttttgggctgtttacctgccggttctggattgtttaggggaataagttcatccaaggtcccttaacttgtcaacgaattcgattttcatccttcaatcacaaagccagatacaacgggtctctcaactatcaaaaccggtgcaatataagtcccatggtggtttgggtggcggttttggcttacgtggcgtctacgtggctaaattgatccggtcttcatctgatgtggcattgacgtggcaatttgatttggaaattaataaaaagagtgaccccacatgtcagctacaccaaaagaattaattaaaaatggtggggcccacgtgggctccacttgtcattcgctcccctaatcttcttcctcctctctctccccatctcccctctcctctctccaggagctggcggttcggcgacgcggccggccagcgaaagcggagccagggatgacctcggagacgaggacgccggggagctgcgcctggacggggacgccgacggtgattgttgttactggactcagagttggtgttgttgttgttgagctcaccgtggtaggagctgagagggggagagggagagatggggcggccgctgtgctgcgagaaggcaaacgtgaagaaggggccatggacggcggaggaggacgcgcgccaagctgctagcgtacacctccacccatggcaccagcaactggacctccattcctcagcgagcaggtcgtgaaaatcaatgatatcgccgttgctgctgatgggatcgagcttgaggtgcatttgatcatatcagatcagatcaaaatatggtgtttttgtttatctcttcttttgccctttcggcgatgcggcgtcaagggaggttcggtcgcctccgccacttcccgcggcatccacatctccaagttctccgtcggctttccccgacgacgaaccggactccggcttctcgcccgacgacccggacctcttgcgcaaccgccccgtccccgaccggctcctcgtcgtctccgccggcgtcgccgccaacctcctcttcgccttcctcatcgtctacacccaggcgctcaccgtcggcatccctgtccaggcgcagctccccggcgtcctcgtctccgaggtcatccctggctccgtcgccgccagccggccggccgcgtcgccgaaccgccagctcctggagagaggagaggggagatggggagagaggaggaagaagatgaggagagtgaatgacaagtggggcccatgtggaccacaccatttttaattaattcttttggtgtagcttgaacgcgtagagatgtagcctagaggggggtgaataggctttcctgaaattttctcaacaatcgcagcggttaaattaatagggcccggaacctcctggtgaagaacaccggaacttcctggcagtgatgagcagcccggaacttccggagttcttgggccaggaacttccgggcaacagagaaaattgaaatcggggacataaaacaggtcctagctagagacaatcaggcacaaggtagcacaagatgtaaatcacaagataccagcagattcaaacacagatcatgcacaagtgagacaaaggcgattttttcccgaagttcggatcacacggatcctactctcagttgaggtgctcaaagagccgggtctcgattaaccccttgcctcacttatgcaaagatcccagaagaagtccacagccttcaacttaacacttctaggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaactttcccgggacatctacaagatctttggaaactcacgggcgacacctaaccgtctaggagaagatctccaagagtaataagcccaagtgacagcccacaaggtatccaaagtgctcaaacgaacctaatcttcaatctatctccaaaacactcctacactctaatctaatctctcaatctcacaagataggctctagatttgagtggaggaagcaaaggaagcttgggagtggctagaaaaccctagaacatgaaagagctgaagtggaatggccaaagggtgacctggggacgaaatccatatatataacggctaggtgacgtcatctagccgttactcacaagtttgaactggaaacctgccaggaggttccgggcaaaagtgccaggaacttccgggcagcacttaggaaaaatctagctaaacttcggtgcccggaagttccggccagaacctccgggtagccctctctgtcccggggagaaagtaaactttggtgttcggaggttccggccagaacctccgggtaggcctctctgtcccggggaaaaacatttccaaaaaaatgattccaaaaacctttagactcatggatatgactcagagcactttgaataccctagaaccacacttgaaacccctctttatagtacggtttttcctaaactcaatttcgaaagtgaaagacctagtctaatcaccttcagtgtttttcgcacttaggaacattcaaattggggggcctccttgcattcttagccatcacaacttgctttgagactaaactcatgttaataaacttgataaacacgttagtcctctttaaccaccttgtcattaatcaccaaaacccactagggggtttaagtgcaccttcatagctgacatgtggggtcactctttttattaatttccaaatcaaattgccacgtcaatgccacatctatgccacgtcagatgaaaataggtcaatttagacacgtaggtgccacgtaagccaaaaccgccttccaaaccgccatgggacctatattgcaccggttttgatagttgagggacccgttgtatctggttttgtggttaagggatgaaaattggattcgttgacaagttaagggaccttggatgaacttattccttgtttaggctagtgaattgggccaggaaagcagggaggaggcaggcaggcccaagcagtgaagaagatgaactgaatatggcatttttttcattttcttcatacacatatacatagtacatactatatatacatattcttttgtcaaaaatcttgggtattcatctgaatacccttgaattgaagtgggcccgcccctgcctgtcagtgtgtgtgagacgggtaaagaagcacgatgtaattctcgcatcacgactttactttcccagtggaaaacaatgtctttataaataaatatgcggaaggcaaaagtgcatgttttcatatgcttacacacaataataacttgctgctgttggtcgtcaaaccccccatgccttcagttgcatatatattaccgtacgtacttgtgtaatatatatgtgcaagatgtttgatctgtagcaattttaccattgtattgctgggtgtttgtttcccttggtaaggtgtgagatggtaaaatatgacgtgcagtgaagtaagctattgttggcaaggtttgctcaatacggtatttgcagttgaggcatcaacaatcttcctaccgatcccgtttccgattaatatttccttccaattaataccgatgatcttcgattgtttccaattaatactcgtccaaaatattaggcccaaaatcttcttatatactatccaacaagaggatattatattactccaccattttgaaacccaattgagaataaatttgcagtagggactacacttactatgaaaacggatggggtgtcttttggtccaaattggagcnnnnnnnnnnnnnnnnnnnnnnnnnnnnnnnnnnncaatttttcacagcgctccgcactatcctcctcagttttggttgaatcgatctgagctgtttggttgggtttcagtttatccaagacactgggtcagttttgttctagccacactttgtcaccatttgccaataaatgttgttacacttgccaaagttgaggcgcctaagagaatcttgctacatttttatgagccaatgatgcgtgggacctaatttgttataaaagacccttgccacaatgtggttacaaatcaaacagctattaacgtgatcaaacatgcctaatcttggaggtggcaaattatggtaaaatgtggctagcaaccaaataccttgtaaatgttgagttgttctgtggtgaaaatattttttattaccgatgatgtatataatatagagtatgctcaaggaaaatgtcattcagtttaaaaaaagaagcaaagcattggaaggttgaaaatacaaattcattgatcattggtaaacaatatgtaggccagtaaaagagcactagagattagattaggattagagagggatgagcatgccatccatccatacatacatgcataaaaagaagaaagagtgtttgtttgtttgttgaaaaacaagaggataagcaagccatccatggccacccaaaatagttgtaacgcacacccagcccaatgggtccggtgatctgaattaaggaggtgtgttgtgtgcaccacagaacattgtcatgcagatgcagaggtagaggcagatgcagatgcaggcggcgcggccccgcgttggtgtccgtcctcgcggtggcattcggccgtttccactgcccaccttgagcttcaacaacaactccaacaggagtgcgtgtgcgtgtgcgtgtgcggtgtcggtgtcggactctgagcttgcggcgcgcgggttcgcggtgcggcgcagctcgacggggctggacgtgggggcgctgaacgaggtgttcgcgcgggtggggttcccgcggcggcaggaggagcggctgcggcgagcgctggagcacagcgaggtggtgtggctggaggactcggcgtcgtcgtcggcggggcggccggtggcgttcgcgcgcgcggcgggggacggcgtgttcaacgcggtggtctgggacgtggtggtggagccgtcgtgccagggcctcggcctcggccgcgccgtcatggagcgcctcgtcgccgacctgcgaggcaagggcgtctccaacatcgcgctctacgccgagccccgcgtcgtgggattctaccgcctcctcggcttcgccatggaccccgacgccatcaggggcatggccttctaccgctcaaggcaacaaatacaaaacacctcctcctagctccttttctatcttcttcttctccgatcaatatatccaaaacacatattggattgcatattaatttgcatgtgtatgtatgtatattcaagctgattattattgtctagacacacacacacacatgcagagtgaaatcaactcatcaaatacatatgtagttgcagctgattgcaaccagtaatccattccattcatcacacttgctaattacacttcattcttgttttacctctctctctctctctctcttgaagaaaagaaaaaaaaacaagaattttctgcttgcttagcttgttgcacattgcagaagaatacatacacatatatagtataatgcacacaaggaaggaactaaaacaggacacatgcagcacataccggagggaacagagaaatgcaatcaaaccaccaaatcaaatcaaacttgacgcttttgctctgcttgctggagctcgtcattggatcgcgcggatgaagaagctagaatatgatgtattatgaggcggtgtggtgggtgcggcggggcatggtgaaggcggccatgacgatgaggaccatgaggacgaagacggcgaggaaggaggcgatgacggcgccgctggtgcgctggcagaagccgtggaattgcaagcatatgggcacccagttggcgcgcaggttgccctcgtgcgccacgtacaccatcgccgccgccgcagacgctgccgccgtcagtaaacccaccatgatggtgtcgcagatgagcagcagaagcttgacaccggtggccttggagctcatgatggtggcggcggagaagggcagcgacagtaccatgtaccccgccgcgatcgcattcgccacaatgaagaacctgcatatatattttttcatttcattgattgatttattacagaataatagtaataagcttagtagctcaaatatatatgatgattactcgaaagccgggaagtcgtcgaatctggcgcggaactggaagtagttggtgaagacggagagcctctcgtcggaggtgccgatggagatggcggcggccagcgtggggccgaaggcagccaccctcagcacaaagtctatcagacccaagcaccgccggaggccgtcgccaccgctgccgccgctgcgcagcaggaacggcacgtcgctgctaccactgccagccttgcgatgcccctggaaaggcgccggcgccggcgccggggcaccagcaccgtcgtatgacgatgaagccttgccgtgcccgtgcccgtgctcgtcgacgtggacgctgcccgaggtgtcgctcccgctcatgctgcctgcttaatcaataatctcttctgctttcttaatttactactgctactatttgatcgatctatattatcttggtgttggcaatctatccccctatgtatgaaggtatatatagagtgccctctgctatatatacatattactctatttgcagaggagttgtagtagttgtttgggtcatcaaatcatactactaactgcttaataatcaaatattatcattgacctgagatctttgctggttgtatatatatgtaaggactcagcctaaatgatgagtttcaattcatatatgtgagtgaagaaaagaagttgagagttgctgttgcggatgaagtttgctagctccattacattcaatccactatacattggagcagttgtttcattgcattagctgcctgtttgtgcctcctttctttctaactgctcactcactcactcactctgccatttgcaatccatcatgcatgctgcaccattttgctttctacctgatcgatcaatgtaatgtactaccaactccctgcactaattatagacttctccgacgttacccaaaaatgtcctcccaagtcccaagtttcagttctgtattgtatttcttcagcattctcaaactatcagagattcagagacggcactccaacccattacctgaacatcaataaaatccgtcacgccagctgatccccgggagctacaaattaatcatttcatcacactccatgtagtaattcaacacttcactttgggcagatttaatttccctttcttccaaaaattgatttatcgggataacgacattactcataaaccatatttgtatattctcttcggaatattacatgacattcgctttatttaaggaaacggcacccaacagcactcataccagtggcacaagacaaacccccagctcatcatcaggcaaaaccatccaattcatgtgcaagcacaacggtacagaaaagtcttagccaacaccgggaaaatgatttcatctctcgagaagatatacactcgttttgtatatgccatctaaataatcaattaaaaatatgaaaaaaaattagtaatatagattaatatgaaatatatcacttcacaaatatacaagtttaaatttaatttgtacaagctgtaagaaaaataaaaaatatagttgcgaatgtgcaaaggagctagccagatctcgtactctgctttattggcaaactagctagctattgtactccgctttaatttgttctcctctgtttaattaagtgtgcgcgcctacatgatacaataactgagaatggatattcaatttgtcatgctaaatcaacactagtacagtaacagcacgtggtaatatatcatatttatttatgaaatgaaggaaacaattacagcagcaagcacataattaagaaatatgttattattggttaattgtgcttgtcctccgttatgatcatcttgtcgatgttgctgagcacctcggcatccctgtgggccatgttggtggcgtcatcggcggtgagcggcggcggtggaatggtgcagggctggtagtcggccacgtactgctccctggactgcatcatgaagtcgcggtcgcggcctcggcgggggcacgccatggactccgggcacagctccacggcgcggtccggcacggtgggcttgtagcggagcagcgaggcgtagcgcgtgagcacgtgcagcatgtagtcgtagacgtagtccatggccatgtcgtccgtggcgaaggcgctgccggcgaggcccatgcgctgcgcctgcgccgggtgggcgttgccccatcgcacggcgaagcggatgtcgcggcacagcttggagcgggaggggtcgatgggccagtagtgcttgccggcggcgaggcctcgggagaagaagtcctggtagggcgtggcgacggcgaggacgggcgagtcgcaggcgaggatgtacttgcggctgacggaccaggagcggccctgcacgtacagcttgtagcggtggcgacactggcgggccaggttggagtcgcggaaggcgttgcggttggcgaagccccagtcctggcggtacaacctgaccgtgtcgtcgggggggagggagtggttgcagcggaggagctcctgccgcagcggcgacacgtccgggttgcccttccagtaggcgtagggctcccttcggctccacggcagccgcgccttctcctccgccatctccgcgagcagcggcgcccatggccggatgttcacctccggccatccccagaaggaccagtccgggaagagcacgtccagggtggaggggtccttgcagtagcggaagaggggcggcgcggcggcccggtcggggtaggcggcggcgcgcacctcgggcatgtcgtcgcagttgaacatgaggtccaggtcggggacgcgccccgggtagcggcgga

SEQ ID NO: 82162 - DNA, 584 bp, Oryza sativa
ctttggagtaatctgattcgagagaagattatcttttcgactacgaaggtctcaggggctactgtggatattatgggtaccccatacccatacggcatggttatccgactagtcataggggataacttatatctatggaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcatatgagacaaactgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaaatcatgtttcgacacttgtattcctctcgtgcctccactgctgctcgatggagtggaggagtggtggcagcatggagggcgcgacgccagcgcg

SEQ ID NO: 82163 - DNA, 6060 bp, Oryza sativa
  unsure (1)..(6060): unsure at all n locations
cgctccaccgcctcccgactgatgcctgacgccaaccacgccgccaggtccagctctatgtgccggaagtaggacggacagtaatccaccgtcgacgtctgtggtggcggcggcgacatcgatgcaggcgccggcgccggagctgacgccgcatagcgggggcatgtgcccgtgtcattgccgctgccgcaggtgaatggaattggaatggaaacgagactagtgcggtgaggcctgtggcgccgtgcaccgtcaccattgccaaactgcaggaacgacgactgctccatccatccatcatgcatgtacagtacagaaaatgattaaatttattaattaactaatatataatcggtcagatactagctaagtatagatgattaggtaaaataaccagtactactatttattacttaattagtgaggaattaattaatagtagtaaagtctagttgtaattccattgatgcaaattaagcatgacgggcgaccaagactagctagttgtaaggaagagtggttgtaattccattgatgcatgcacgaccaagacgacgaatcgacgagcaacaggtacagctatacatctccatcaaatttattaagttgccgtatggaagccgttgtttgtcgatctccatcggaagcgcacagcttcaaatattgttaaattaaaatcactttaggtcaagatgataatggcctaatgtatgtttattcaaccatcatcgattgtgatggattggacacgtactcactagctcgcttagctatctagttcttcgatcgctcaaagtctgcgagccaaattaaaagtcgaacaagtttttccacatgttgtggcgcttaatttcaacgcgcggttttgttagtaaatgaattattccaacctgagatcgtacagcggtgagtagtaacgtcatgcatccttatatattctatgtacttacaacgtacgcagttgactcaactcaacagctagcctcgaagaacttatatcattcatacacgtatatatatacttaggctaaaaacaaccaaccatatacgcgcattacgtaattattatactacccttaatcttaatttcactataaattctaactaatgaggggttaatttgtcataagtaatgaagtgtctccttttaattttgtatctctaatggaaacatatactcctagctccgtcttaaattataatgcctatatttttttacacgctctttaataacatactttgaccattaatttatttcaatctatgttttcaacaaacatgcaactagcatcacaagaaagtactttaaaatatgaatctagtgatataacgtgcataataattagtatatgtagtacatagttagattattagttaaaagttaccgagtttaatttttcttaaaaataggacgtcctacaattggagtactatttttaatcaataaatatgtgtgttcaaaattaagtaaactacatgcatgcatttatgtactactactgtttttggcgatttatagtgcgttgtgatgcatgatcatctggtttactttccttgtgaaaaaccaaggcgcgcgccgcagaaccatagaaccactagtaatagtaacataattatatgtactagtagtgttttttcactcgttataaatatatctgatgcagtagtcttttgataggattaatatatactccctccgtattttaatatataatacaattaatcttttatcagcgtttaaccattcaatttatttaaaaaaattatgtaattatcattaattttattgtgacttgatttattctttaagcatggtatttttatatttgtaaaaaaaattgaataagataaatgtcaaacattgtttaaaaaatcaacggtgttggacatggagcgagtactactaagcttaatatccccaggagttaatcaactactccagcttagcttaacaaactagctacagtgccgtgtatctcgtgatcaagcactttcgtcgtgaacacggaccatactgcttgcatggctttgcttgctttctattggatctatatatccatctagctatctatattatattaattgatctgtcagtcgtctacaagtacagttataagcccaactatatatgcatgcatatatatatgcatacaaaatacaatttgggtgaaattaattaatttaagatgcatatccattgatcgaagcgtgttgattcaggtgtatacatgtgtaaattaatatagagggtggaaaatggaaatgcgcactaacaagcagcgctagctagtttccgtggatctgtagctagctatatatgatgtggtcatttgttggtggaaagaagaattaagctagtcaacattcaatgcgtgacagcatgagcatgctgtaagttagttaccactagtaattagctagtaatccaggtgctaaaccaaataaaactagctagattgtattgggtacggtgtttgacgtcaaacttggaaattatggccggccggtcggcatgtgttcacaactttaccaaatttcatcgttactaaattttggtagagtaaaaaaactaaatataatcttgatcacaattaattattacataccttatataatataatttggaaagttctttctctcagaagaaaaaactccaccaaaataaatttgttaaccccaatatatgttgaaattttaattgaggctgatttgagcgacaaattaaagtttcgtatatactaatttcaattcatcaactaataaataaatataactcctgggcctgtggtcgtgcgtcgtacgtgcatcgtcgctagctgctagcggtaaaaaaaaacaagtggatcgatcgcatcggagttgaatgaatgaattatataaggtatatgcatgcacgatcgaattgatatattgaagaaagaaatgataattgagcgagggacttgacttacaacggcgccggtgaaatcgacgagttgcggccaggtggtggtggtggtggcggcgacggcggcgagcaaggccagcaggacgaatccgccgacgacgacgacgatacccacgcgacccggcgcccgcactcgcttcttcaccgccgacgacacccacgttgaccaccaattgctgtagccgtagccggcctcctcctcctcctcctccgccgccgccttatttgagtccggctgctgctgctgcttcgtcgtcgtctcgccctcttccgctacctgcaccaaggccacgccttcctcctccgacttcgacttgtgattattgctacttcccctcatgatcgatcgatatattgtatttgatcgatcttaatttggtttaactaactatatattagtaatagtatcccgatcgatacatgcatatctaactatannnnnnnnnnnnnnnnnnnnnnnnnnagatacgtatatatgagatgaccggagaggagaggagatccaagtatatatgcatacatgagtgagctctacatagatagatagatagatagatgatagatagatagatagatcagctgcttctagctgctgctcatctctcgccctctcctagctagctaactccttcgtcttccctctagctagcatatatatatatatatatgacttgagcggctagctagctaattaagctacatctagctatctatctcgtctcttctcttgccatccatcaatatatataatcaggagggagctagcttaattagctctgtttatttatatgtttatatgtggagtagctaggagcgagtcagctatagcttgcgcggtatatatagacaagtctccagtctcagtaataaagtcagtcgtacgtcgtcgtcgcctgcgcagatcgtcgatgtaccaattaggagtactagacaaattaccttctgatgatcgatttccttttttctttcttcaattaattattccattccccttttatcgatggattgaccggctggccataaggaggatgtttcctaacccttagacaaaaccaaatcctattttttccccaatctttttcaacaatactatatatgtacatgtactatatatgtgaagcagtaatccaatattagtattacaatacaagagaagggaaattttaattttgacacagtggccgcccggtttatccattatctttagaaaaatatataaataaggggaaattaaattggcgaattgtttacttatatataacactcaactaattaagcttgcgcaactattagttattgatatctcagtcaaaatccaagtccatcatggtagcatatagttgcaccaatatgcagtgaatattttttttaataacaaatctcaaatataatttgtttgatacttaatttagttcacaggttccgatacaaaaccattgacttacacaatccatacataattctacgctaaacttacacacgtacgatcgaaatataaatggaattgctaaaaagcgtttgacagtttctgtcgtaaaacttttaaatacatatatgtcatcgtcagattgccttgagatttgtgtggcatgcaaggaaaaataataccctcaaaactttagaatttgttaacatcggaggattgccacgacaatcaatttgtgcggcctgcaaggaaaagtgggttgcaagcttagcttgtggcgctaggcacaatgtccacacgtgagtttcgataagttatatacaagttatctataagttacatcctaattacaataaattataatataattatattataattatatcaattataatataactacattctacgaggatgagctgctggtgttcatgatatacagtacgtggttttattttattcttttttttctaaaccaaagccgccatgcagtactgtatatatgtaggaaggttgatttggctcgacggcctggcaatcaatttgactgcagggtcaaattagctcatgtgcttaataatataattatccactcgaccgatcggcaaggttacgcatatgtcacggctgtgttcagcacccttttcccaaccatttccttcgttttccgtgcacacgcttttttaagctgttaaaatatatgttttctaaaaagtttctatataaaagttgcttaaaaaatcaaattaatttatttttaaaaaatagataatacttaattaatcacgcgtaaatagaccgttccgtttttcatgcgtactgttttggttggtaacaagaaattgcgaacacacccaaatacattgtccatattttaatgtatgacgccattaactttttaaccaacgtttaaccatttatcttatttaaaaaatttatataattatcatttattttattgtgacttgatttatcatcaaatattctttaagcataacataaatattttatatttacaaaaaaattgaataacatgaatggtcaaacgttgtttaaaaagtcaacggcgtcatgcattaaaatatggagggagtaatatataaataaccaacgggcttatttaagtttgtccatctatatgatctggcttgctagcttatttatgtgggtttattaactgtattatcttaattatgtattggtttcgcgcaaacggcaaaaggtacggatgttacgttcgaaacacgttgcgtacgtactgtgctatctagctagccaagtactcccacgtactactacatgtgccgatcccgttcatgcatccagctccctcaaattttgacaacttgatcttttaaaaaaaactatttttacaaatgaactaccgccaaaacttattttaaaaccgacccatttgttcaacgccaaatcatgtggcgctgaatttagacacctcaacactaaatagtatggcgctaaatgttcattggcacgctgacttagcctttcatccgtggtagcacggcattcagcgtcaattgacgtggcgttgaagtgtctatgttcagcgctacatgatttgaggctgaaaaaaaggtcattttttaaataagtttttgcgacggttcatttgtaaaattagctttttcaaagggataaattgttaaaatttgtgcatccagctacc

SEQ ID NO: 82164 - DNA, 7565 bp, Oryza sativa
taacagagcaatatattccagcagatctcttgctagctgacggtttcaaaaggaaaaaagaaacatctaagctactccctctgtcctaaaatttaagtaattttgattagatgagacgtattctaatactacgaagggattcgtaatattaggatgcgtccctttcatccaaatctattatatcttgggacggactgagcagtgaacttatttcgcgacgaaagcttagagaatggacacgtcttgtgcacttaaccctcccgtcatgcctacatatatacgatgaagcaaacaaagaaaagcaaagcaaaagctagtccaatcgatccaattgattgatcgagcgagggactatatatgtcgctataccacgaattaattgaaaggtacgtgttgaaaatcaacattgacagtataattgttgctttgtgtgcaatagcttaattggccaagtattaattaagagtagtattttttttagacagtgtacactatagctagctagtcaattaacacagtctctataaagtgcaactaatttgataagtaactaattactactccacatgatatatgtagactattacaataaattattatcaagcatcttgattatacatataaaatacaattttatttcgtttttatttctaggcaaataaatcgaaattttaatttgctgcatatatactccctccgttttttaatagataacaccgttgactttttcttatatgtttgacaattcgtcttattcaaaaaattttatgcaaatgtataagatataatcacacttaaagtactatgagtgataaaacaactcataacaaaataaattataattatgtaaattttttgaataagacaaatggtcatacggcgtcatctattaaaaaacggagggagtagcatgcaatctatgtttagttataagtagagctagcgtggcgaggatgcggtgcatgcagatagccacagccacaccaacgtatggttgccttcctattcagggaatctagatagatacctcatatagatgtatcacaattcgattagcgttcatttggttcaaaggatataatagggtgtggattggtttgggtcaaacttatttttcagtctgttttgtttgagaaacggtgagatgagtaatccctaacaaggaatattcctaagttagagtttaatatataggctctgtttttttctccaacaaaagttggattaaattttggatacttgtggcacgcttttcaaactgctaaatggtgtgtttcgtgtgaaaactttatatatgaaagttgttctaaaatatcagattaatctatttttcaagtttggaataattaaaactcaattaatcacacgttattacaacctcgttttgcgtgaaatatttaatatttatcttcatcttcatcttcagaatattcaaacaccacctatatattcttttttttcttatagtttatacagatagaaattggaagtagtaaaaaaattgtaacttaaaaaagaatgaacatatcgtattgttgtgtcaattttattaaatatatagtgagagaaaaaacaatatttacatactccctccgtttcaaaatatttgacaccgttgactttttagcacatatttgaccgttcgtcttattcaaaaaattttgtgaaatatgtaaaactatatgtgtacatgaaagtatatttaacaatggatcaaatgatatgaaaagaataaataattacttaaattttttgaataagacgaatggttaaacacgtacttaaaaagttaataatgttaaatattttgaaacggagatagtagtaactttagtaagaaatgactggagatgatcgatcgaggacatatatccgctcgagggctctagggggggaaaaatcattgtcaagagatggccgggggggagcgggtgatatgatatatcgagttgatgtggatggcttggctggctagctgtggctgcggctgcggcatctgcgcgcgcggcggcagggcgtccacgtaattgtaaccgccacccaactaactaaactaaactagtgctttcttttcttttctttctttcttgcagttgagttggggtgctacgcactagctactcaagtgcatgagctagctcaaacaatcgatcgatggcgatgaaggcggtgatcaagggcggcgatggcggaggcgggtgcatggtggtggtggcgcacgtgctagcggtggcggcgacggcgatggtgttggtgtggtgcgttcacttccgcggcggactcgccctgcgctcccacaacaagcagctcatcttcaacacccacccggtgctcatggtgcttggcctcgtcgtcctcgccgccgaggccatcctctcctaccgctccctctccatcatcgtcagcagcagggacgccagaaagaaggtgcacctggggctgcacgccgtggggctcgccctcggcggcgtcggcatctacgcggtgttcaagtaccacgccgaggccgacatccccaacctctactccctccactcctggatcggcatcgccaccatctccctctacgcgctccactggctcctcgccttcctcaccttcttcttccccggcgcctcccacgacaccaggcgctccgccgtcccgtggcacgcgctcctcggcctcctcgtcttcgcgctcgccgtgggcaacgcccagctcggcttcctcgagaagctcaccttcctgcaggccccgccgctgcgcctgtccaggtacggggcggaggcgctactcgtcaacttcacggcgctggtggtcctcctcctcggcgtcgccgtcgtcctcgccaccgccaacgtcgactccactaaatacaccgccatgtaattccattttattatacatatatttcatcatcttttctttattattactctacatataatcgatcgatctagctacacacccgtagtacgcagtgtcgtaccatatatacatgcatcgcgctgagtgtgtgcgcgcgcgcacgtgtcatgtggctttgtgtaattaattaattattattattcctcaattccatcgtgcatctttaattaccatgcatgtatatatatatctggccgagtgtaaatactatgtatgtatgtatgtatgtatgtatgtatgtatgtatgtatgtatgtatggatacacacttacgtactcatctgtaaaatacataatatattgcgtctcatctgtgtacgtatatatagcaaattgtttttgccgtctgctgtatagcttgttatatatcgcgattatactatcataattttaccgtgaaatataggagtatatatatgggcgggccttggctttaatttccttgcttttttatacaaagcaacatatataatataatgttcttttttgttgcacggaaaggatttactggttgggctactataccagcatcagtacgagatgcaaaaataaataaagcaaaaagaaaacgacagcctaatcgagagagatgtatccccaaaagttaaagctaggaaaaaaacagcactttaaatagtcatcaacaaaatattttgttttctacttgaaaacccaaacaattaacctgcataacatgactatgagacacatatgcatgttaatataactaattagtgttatgtccgtgcgttgcaatgggatttttttctacaatgttaatataggttttttttctatatgtttctttttgttgattttcacatgaatacgtactagttattttggtgcggttgtttttagagacagttttttaagtgggaaactatgatgatagagaaagagtttaaaatactgaaaatttgacattctgactattttctaaaacttattttacaaatagccgtagcaaaaactttaactaaaacaacaaacgccctttgtctcagcgccaaacaccttgcgccgagatccaacatcaacattacaactatattgattatttccccaataaacgaagactttttttttaaatattacgtatttaattccatccataaatcgacctcagcgccaggggtattggagttgtgcatccaccgtctatgatatatatttcattatatttatttagtattactctacatataatcgatcgatctatagctacacacccgtagtagtgtcgtaccatatatgcttcgcgctgggtgtgcgcgcgcgtgtgtggctttgtaattaattaattattactcctcaattccatcgtgcatcttataccatgcatgtatatatatatggccgagtgtacatactatatatatatgtacgtacgtacacatctgaaaatacataatatatattgcgtctcatttgtgtatgtttatatacggattaagtatagcaaattgtttttgtcgtctactgtatatctggttatatatcccgattatactatcataattttaccgtgaaatatgggagtatatatatgggccagccttggctttaatttccttgcttttttatacaaaccaacatatatagtccctctgttttatattgtaagtaattctaccatttcctacattcatattattcatatttatattaatgaatcatcaatatgaatgtggaaaacactggaatgacttacattgtgaaacagaagaagtagcgttcttttttgttgcacgtatggaaaaggattctactcgttgggctaccagcatcagcatgaggtgcaaaaataaataaagcaaaaagaaaacgacagcctaatcgagagagatgtatccccaaaagttaaagctgggaaaaaaacagcactttaaatagtcatcaacaaaatattttgttttctatttgaaaacccaaacaattaattaacatgtataacatggctacgagacacatatgcatgttaatataaatagctagtgtcatgtctgtgtccgtgcgttgcaatgtgattggaattatatataggttttttttctatatgtttatttttgttgattttcacatgaatacgtactagttatttttgtggggttgtttttagaggcggtttcttaagtggggaactatgatgatggagaaagagtttaaaatagtgaaaatttgacattctgaccattttctaaaacttattttgcaaatagccgtaccaagaactttaactaaaacgctaagcaccctctttctcagcgccaaacgccttgcaccgagatccaacgtctcagcgctagaggtcttggggcgtagagcatccgccgtctgtttacagacaaaccaatgaccaatcatttcgagtagctcagttgtggtacaatgatttctgtgcttttgatggtccaaaccatccaacatttcccttattttttccacaaactagtacctaaccagaaaaaaaaatataaaaaagccaaaaatgtgtcgctgctgttaagatgcaaactagggttgctagcgctaccgaaggcaagagctaccatcacaccacgttcacttccatgctatataaggcatgttaattctttttaatccgtggatgcatgttagtgccagcgagctcaaaaggtccctgtgttgagaagtttgcccttagcaccaagaagtttagcgctaaaatttggttcattttctaatatagtttttgccatgatctaattataaaataagttttgtaaaatgggtaaaatactaaatgtatggtttaaagtagttgagaaatactgggttttgggtagggtggttttattatgaggcggttttttagtggggacttcgatggcggggaaggatgacgatgactctacttttaaattagtatactagtgttgtgaccatgctatttcactgtaatcaaaacaatgtagaatacataaagcattgatacatgaatagcagatagtggggtcatagcagattctcctgcgaatattgtatagcaagcgatatggcgaacgttatatattccgatagcgaaataagaaaaccactcaattctgcatatttgtgaggtagagtagtgcttaatttacagaaacaatatcatattatagacgacatatgagttatggagataagtaaaaaaatgcggtactcttccttcatgttgaaaataattatctatttagacaaaactaatatcaaactttaaaaacattgactaccaataacttctaaaatatttgtctttataatcatggagaccatataatacacagattaatcttaaaatatacttaagtaaaagcatatatttattgatatttctacatacattacatacattgtagaagatcgcaaaccaaagtcatctgccacattgtcgggagcatacctctcatcaagttatcacatttcatattgtagcctttaacagaaattaggagttaatgcatttttttcaccgtgtacctatccaaaacaacaattatttttaacaattatttttaacctaaaaggattgtattttctataatatgtaccaaataacacctactatttttcacatagcagacgtaatattcctccaccattttagtagcacagcatcaccatggtaatataaaaaccacgatactgctatttagtaccatcatgcatggttataacataggggtgtatggggatagtcatgctatacatataaaaaacttgcttaatactagttaattttctagtattagtataattttttattttagaaaaatagaattgtgataaagggctggtttggtttgtggcctaacttgaccttaccaatttttgtcaataccaaattttagcaagttttagcatatgcaaagttttgtttggattgaagccaaaatagcctaagttaactattaaaatggcctatttttctaggtttggcagaaattgacttcaaaccaaataaacacttaacactattgaaattaccaaatattggtaaggccaatttaggacacaagccaacagctcaaaactcggctggagtgttgggccggcgtgggcttgttatacgtaaccattgttagaaagcgtattttatgggttaaggaggcgcactcgaagaaaggcccctccccccgttttccccttgtctcaaagcgcattttggagattggagtttggagtttggagagagagaaatgcaaatcggaatttgaagtttggagtcaccgccgccgttgaggtccgtcgtctcgtccgagtccggtccgcgcggaagtaggggcggaagtgcgggcgggagatgggggtgaagaacctgtgggacatcctggagtcgtgcaagaagaagctcccgctccaccacctccagtgagtccccgatcgatcgatcgatccgccattaaaattaaaattaatttccggggagggtttgctaatggattgggaaatgaaatggtggaggaaggaacaagaaggtgtgcgtggacctgtcgtgctggctggtccagatgtacagcgccaaccgctcgccggccttcgccaaggacaaggtctacctcaagaacctcttccaccgcatccgcgccctcctcgccctcaactgcaccctcctcttcgtcaccggtaatcccattctccttttctacttt

SEQ ID NO: 82165 - DNA, 5825 bp, Oryza sativa
cctcctatatgaaaatttatggaaatatatggataccatatacctatgcgtgtacggaaaggtaattttgtaaaaaaataaatatggtggtatgaaaggaaattatctccctggtagaaggtgtcagagtctaactcggaggggacaaggtctccttatcccgggttcaattgtggtaccccgaggtctactcgaagaagggggcagagcactataaatagaaggacccctagatcaaggaggaatagaccaagacaaaccgtagccactagctagccaaatcaagatacatctagaggaaatcggagccatattcgtcgactagatctagccaagtcattcttggcggattagcgtagttgatctaattccagattaatctttctggtattctaaatataatcccatataaattggattagggctattaccttacgaggggcctaagcaagtataaatccttgtcttcattttgcggtctaacccatcgacaaatagttctaaataaatagaaacacattcgctatcgtcatctactttcagcatgcataataaattatggctcatgcaattttttcttacattcccatgcacttccttgtaagcaatattgccatcgttctcctttctacaaccatcccaatgccaactagcccctttgaccgctcgtaggacctccttaatgacatgcggcagaatttgaattgtagttacacttattggacaacattattatcagaatactagactattatctagattcttaatactaggttatgtccaatctagtactagattgctatattttgggataggggaagtaattgtgactatatagtgagaacggggttgatgcactagtgcttgaatgaaccataaagtattatcatgtatatttatgtagcattcttattaattttgcatgcaatccatctctttttgcactatgttccttgttgcgtcgaatctatatcaaatgacatagtttttttttccttgtgtttgtttgattatatgaatattttgtgtttctcccatttctttttttgataaatgtttcttccatttgtagtttttttcctgtgtgtgtttaattatatgaatattttgtgtgtctcccatttatttttctgatatatgtttctcccatttctagttcatcttgtcttagattttgtttatttttcataatcttgaaaaatgtggtccttttaatatcactatatcatagttactagatgttataatgtagtttcttttgttgtgacacatttatcttgttattgtagcagtcacatggtattatatggcctacacatataaatgataggaaagaatctaatttcaagataggattggttgaagctctcagcaaaccattttgccagggagagtatgataggctttatggcatggctagtactcgtgagccattaaaaaaggaacgccggacacgcagtggttcaaagacttactactcttctcattcgatggggaaatcatattttgattgctacccaggtatgcgcaaatgtactacctccgttcacaaaaggatgatgtcctagaatgagtttagtcaaaccgcgacatgttaaatcattagtagatgaaataatatcaatgtttaaatgtgaaacttatattattagatttgacaagaacaaactctcatatagttatgtctctactactttatatagaactgtagtttgagaatgtaatgataaaacatgtgcattgtaggtaatgtcattgtccaagttggcatccttcttgaatgtaatgtttaaattaatgaaatttgggagcatttgaaaaatattattgttttttctcacttttcttatttgcatgctttctttgactctagatctcgcggaacaagttgaagaaactagctatcccaatcgcttggcgctattgcgcgggcttttctactggttggaggtaacctcgtactattattgtgattgttagtaagtgttgtgttcaaaaaattaagtgtgcagtatcttgttgctaatgatcatacttctatcttctagtaatgactaacatatttcgagtttacttgtacacacttctcccaatgagaacagtttaattgttttggacttaacataaatattttctattgtttgctacacaatttgtctagacctatgcatgttgtatgttgaccacatgtttgttatacttttttgcttttacagtattagtactagcattgagttcataccatgatgtgtgcatagtagcactattttatttctttgtacatttactcttcttggcaggttttcttgatcgtgtattttcttttgcagaatgttgggaaaaaacaccaattcatgccatggagaaatgagcacaaacgtttcaaatatgttaatttattatgagaccatattaccttgttgccacctccatatcagagtgggaagctatggaatccaacgagttgtgggtcgtgaacctagcgccagttgcttgcgcataccagttttcttttgtatttttatcttgtttgattggagttatgtaaactttggattggttacatacttacttttcccaaatgttttggttgcgatttgtggagataatttcacaagttctgatctccctaaaataccgagcccattttaaaaagtgttaaattatcaaatctcttcccaagaatactagcaacattacttcagccactaggcgggcctgctcggcccattcaggtttgactctaacctagcccagtagtacacctccacgcgatttcgccaccgcggccgcggcggcgcatcggcgtcgtgatcccgcgcggcgcggcctccccaccgccctagcgcagccgcagccttagccgccgccgcgccatctccgtcggcatttgcaaggtcagagacctcccgcaccgctccctcctgatctccaatctacgagtcaaccatttgatcgatttttcttgatctgttgcgtgcttcgatttcatggccagttgtttgctcggctttattcggtagtgaaacctttgaattttccccaacccaaagtacttcgatttggtgagcaactgacatctcctgttcagacttcagaagcggttgcatgatgattcagttagcttggacccgctcgtatagtgttatacattaaaaaataaattgtattgtgtattctatttttagagaaagaaagaataaactatgtagaagctacaattctacttcaaatagagccgtgcaataatattgcacagaaaaattcaagctatttatcaacaataacaaatgtctgtatgccagaccagacaagttctgtgacgcatctaaatagatgctgactttgaaccctgcccaaaaattttcgttggcattagataccttataacgaaattattcgtctgaaaatgaatggaggttgcaattagtatcattttataagggagcgtgtgtataaaactggaattccctagcttatacaactgtggttcagtgattgcttctttaggacatcccattcccagcagccaaggatcactgatcatgcaaaaaggaatttcctctatttgactgaatcactcacgaatcattgctatggaattctgaaaatgttcaaatgaatatattgtctctagctctgaaagaaagatttgttttggcaccataaacaacccttattgacctgtacttataaccagcttgagattacatcattattagagtaaatatttacaacctcgcaagataccggaagaacctgctgttatcatatatgctacagaaagaaaaaacacaaccaagcacaatctacagcctgattgcacaaagaggaatttgattaataatggaatgacttaacatggtgatggactaagtaaggttcttcttcgaaaggttgtacacactacaagattttgacaaatgaaggggcgtcgtcccttggtcctgcaagagatcgatataaatacagatggtcaacattatcggcagtcacatcttcattaccagaatggccactaatcacttcagccaccaaatttggcatttgctgagctacgtatctacagcctgtcatggttactctgcaagagctcatccacaagaatctcatattccaaaagtggcttaaaccagagagcaatccctcgtcaccaaaaggacattccctgacctcaagcttctgcaaccgagtgcatccttcaaacacatatctgagtgacatgtcagtattgccagagaaggcaacagacagagttttgatcgatttcccatattgcccaatgtacgcgaaggccttgtccgtgaccagaccagaggtcgaaagcctggaaagcttcttgcaattcatcacaattgctccaaaaccttcatccattggctccccggtgatccgatcagggagataagttttcaaaatgctgaggcgaaagacctcaagattagggcagttgctggacataatgaccattgctgcatttgtcatgcttccacaatagtatgttagggttttaagcttttggcagcctttcgagatagtttcaagcccaacatctgatactgagagatgatgctcactcccacgaagcaaacgatacactcgtaaatcctggagatctaagcacgtctcagcgatggcagaaaggccatcatcacctatggagtcgcgcacacagaatgtccggagattgccacaggagcgaatgatgggagcaagctgttgccctgttaaggtggcagagctgatgttgagggatgtgagattggcacaaaccgggtagatcgcagggaggtaatctggattggcgtcctggagacctgagagagagtggagtgacctgcatgctgcgaagtatgtcgcaagttcagacaccgatggaggggcctcacctgcagggtagccagtcttggaccggaacacacccgtgccaaggtgcgttagattgggagcgattgccatgaggcagcacagctgctctaccgtcacatggcgattcacacccagctggcacagacctggtgagcgcgcgacaagggcctccagtgactcaaagttgcagggcgtgtcaacacagctgaacagaagagactccagcgacgtgctgggcttgggaaacatagagatccagtccacctgcttgtccactgtgtcctcgactttatcattaatcagatcaagcacatggagatgcctgcactgctccgcaattatggcgaggccggtggcactgaacttgtcgcagctcatcagtgagagctcccttaactgagggaatgactgcgcgatgagcctgaggtcattgtctgataccgtcatccgcttgaggaagatgcacttaaggtgcgggtatgcgggacccaaagcagccacccagggcgatgcgtatgcaccccagcctttgggcactaaagtggagtctgcgaagcatggcctgcccttcagagtgatggagcgcaggccacgaaaacgctcaatgacacgattcggagaaacagcataacagtttctgatgaagagctcttgccgtgtctccgcctcagcatggtaccagtagcgacagactagcgatgccatgttcctatcacgtgccgttgtgaggaactggagaatgctttccagcagtacattctcaagcacatggttgggctgcggacacctccccacaccgtcactatgccactcaccgtctcccaacatcgaccttccaatcccatagttggagttgcatgttcttcgtcttcatcgccgtaaaaaaccccatccaccaactgaaaattgattctagggttgcctggatgattgctaatagcagatgttaatggaaa

SEQ ID NO: 82166 - DNA, 3043 bp, Oryza sativa
ttataattctgctccgctgagtacactctggaaaagcttgatttagaatatcccacacagaagcagccgataaattgtcaatgataattaaatacctgccaataatatatgcatattaaatacattttgctaggctactattaaaattgatcagaagggagctaaactaaaataaactagctgggtggcccgcataattgtgtggctagcaccatataaaatcggagtaaactcttttacacataattttcttaaactttttaaatagtctataatcatctcattgtcctaggatttttaaaaaatcaaaccttttcgccattagttctcaattttataattgttaaaagtcacaccatttgtccttgcttgctactttgtcgccctttatttgcgacatgcaatgtttctattcattcctcatgggatctttaaaaatcagaccttatatttagtttatagaagtttcgtcaaatgccacccatcaccctcctatttattgtcattgggttttaaaaatcaaatatgatccttgccggtgttctcttttttactttgtagaagcatgtgaaccgtcacgaccctactcctgcatagcctagttcttgtccaccctcttaatcattgttgagattctaatagttgaagcaatcgtcaatagttctgtttcatagtttcaggagttttatcaatcaccagcacactactcctttactgttcgcccgctacctttccaattattatatgtaattcttgtattctagatggattgttcttacaacattcctaatatttcttatttttagttcgaattttggttgtttttctttttctaattcccaaattattttattttttattctaaattttaattaaacttgtatcgtgttttgcactaactgttcttttaatattccttctttttattctaaattttgcttatttctaaattatattctgatttgaactattatttttattttctaaattctgaatttatttcatattttattctatttttgttcttccaatttcataatttatttcatatttattctaaattttaattaatctcgtcttgtgttctctactttccatattccttttattatttttattccaaattttagttatttctaaattgtattcctacttgaacccttatttttctatttctatttcagaatttattttatttcgtatttcgaattttaatggatcttgtattgcgtcctaggaggactcttatttcaatatttctcttttttattatgaattttagtttatttctaaattataattcaacatgaactctgttgtgaatagactcttattacaatatttcttatttttttattcttattatattttattttattcctaaattgtaatcatatgtgaactcttttttttttcttttccaatttctgcaattagtctatttattattttaattaatctcttactatgttcttgatggactcttctttcaatatttttattttttatttcgaattttagtttatttctaaattatattcctagttctaccctctttcttctttttctctgattaatgtgtgatttttattatatatttcagtttatttctaaattgtaatcctacgtgaactgtcttatttccttttccaatttctgaacttttttattttgaattttaattaaactcataccgtgtcctagatagactttctctcaacattttattccaaatttcagtttatttctaaattgtattccttcccgcgtagttttgcgtgaagctagataattcatgtagtgtaagatttaatatatagatctgaaattttatttttataaaaaaatcattatatatagaagtatatttagatttcatatacaactcttaggtcctatttctataaggtatggatttcacatataaattttagattctattctatagtcttagatttcatatacaacacttaacttctattataactgtattttatatacaaatatatcaatcaatctatgctgttataatctggacccaccatgatctaatggtaaaatgtttttctttttttatgattaatgtgggaatttctagtctctacaatgaacgtagtgccttctttcaagcttgttttaatgatataatagattttaaggaacaagttttactggaagaaggataataaacatgttctaacttgtgagtaaaagaatgtgcaactagaatgttgttgactatcaataaatgtaatagcaggtagtatttttgtgtgcctaaattgtatgatccaatattcacttctatggtgtttcagtcaaaaatgcctataacacctacatcaagtttgtgaaatataatgagagcagactagcttactgagtgaccagaagatctgctgtaccttgtgtgtaagttctaatattaacttctgagcaagcttttatttaattttggacataagaaataatatttatttcagaaaatagcagcaccttttatcttgtagatgtctcctgatattatcaataagttcaagctccttacaatcttcgtgggggttattttgctggacctgggagattatgtcgcagaagagccttttcatattaggcttttggggaacctggatgaaagctctacagtcgaatcgtccaccaaatttgttgtagaaaagcttggcaagtgtagttttaccaataccaccacatccgacaatagataccatcttgagctttggatccccatcattggccagccatttgataaacttgctcgtccgcccatcaatgactaggtcagcagtttgttcatagggtgttgatagaacatagctaacggacgcatatctttgtctataggtgcaactgtggagatcgtaccgttcgtaccgttctattgcctcttggacataaatcctgaattccgatatcatgcttccgatctgttggtgccacttgagtcttctaggaacaccactaatcttcagatggttgatcctgcagacaaatctggtcttggtatttagatggacatgccctg

SEQ ID NO: 82167 - DNA, 6343 bp, Oryza sativa
ttatttatttatttcttttcttctttcaggatggctgtttcacttcagactcggatgcttttctttttggcgctaggactgtttatagagatgttttcataggtgaagctgattgcttattggcttgcatcacaactcatcaacaattttgttgctgcctgctgccttgttctattatcaactagtctttgcttatatatttatctggaaatcctactcatgttctcaatcaaattaggggagggtggctatgtcatttgctatgaaatggaagacatagagaaaactcttggctttggcaggaactcgctggtaagttgcaatgaatttgttctgcccgagtttcaacttatgggatctcttctgaacaaatgttttgactgcttgtgacatatcacaaagatgtaaaataaacttacttaaatatgccccttatgctcctagaaagatcacttagacttttgtcagttaatggcttaacacggtcaaagcaactaatagataaagacctttaagagtagactgcactgcaggcacaacagcttagtaagtgaatgcaatgtgctgatttaaaacaagaacttgcaagttgtatgcatagagcaacaccattttctcaactctgatatcacaagaaaatgtctcagcgcactcttaaaaatcctttgggtaattatcatgtattagtcagagattacgggatgttgcatgtaattgctgatgacttgtatgacaatatgatgcaataacaatattacatctcccaccaatgacttttttttgggcttctgattctcaggattttttttttgtgtgataatgcgtaaattcttattgtcctgacttgacaacctttccagatatcacttgcagtgctccttggtagtgattattctaatggagttaatgggtttggcccagtaagtacaaaaaaaactgtcattttcattgtcttagtataacatgcatctgttcttatatgtttctatatgaaatctgacactcgacgacaagatgggaatcatggagcttatcattatatttgtaatggtgctcttttaatgttccaggaaacagcatgccggcttgttaagtctgtaggcgacaatttaattcttgatcagattttgtctaatggagttaaagctactagaaaatgtaaagggaaaaatagtggaaacaaggtggacgacatgtgccccaaagcaagttcctgcggtaagcagactctgtggtgcttttctctaaaatttaagtaattagctatgccataaacatgttgtggacagggaatacgcaacatcatttatgtaatatccttgttttacagaggttggcatgactcaagactctgatggtcaatttcgtgacgtcataaatgcatatctggagccaaaatgtcactcacctgattcggaagctgtgcagaggtaaaagagttagtggaaaactacttcgctgtatagtttatttgtctcggattttgaggttcagccccaattgctgatatgatactttgctttcagtatgtgttcacctttttatatttttcttgtcatttttgggtgattctgtggaaaattgatcagggtgttaaagataggggttgcttaaattgcttttctgaaggttcgtttgttctatctccatagggtatgcggacagcacccatttcttcggccacagcttcaaaaaatatgcgaggaatattttgattggagtccagagaaaactggtactctctgaagtcctcgactgttatgatgattagcattattagtatgtgcaagaggaaggcagtaacatgttttaataggtatggatcctgacttgttttcttctgtatgtctgcagatcaatatatacttccgaagattgctgagagagaacttcggaggttttcagaccttcgctctgcgtcttcagcactaggaataaaacctttgttgagtgaggtaaaaactttggtctgtctgaagcaaacgttttacatgtacctttctcaagtctaagtatctaatttacagataccagtaccatgccctgtactggcgattgtgaagcagaggaaagttcatgggaatgaatgttatgaggtttcatggagaaatatagaagggctccaagtttcagtagtccctggggatcttgttaaaaggtagtaacactgtaacagtcctctcttatccggcaatagcaacagtgattgtgtgctgctggcacatttttctgaatattgcgaggtgcgattatgcacagaaagcatgcataagacacatattaggagttcaagtagaagtctattgaatccagaagttagttgcttgatgcaacaaaccattgccgctcatgcacttttcattttactcttaaggaggaggattcttgcccttcctaaatgcttttgcctgtgcaattgcagtgcgtgcccggagaaaataacagaatttttggagaagaagggtgaagagaagaagcagaagaggagagcaaggccaaagaaatcagggcaggctgcagtgaaagatgttgatgaacagctccaagagttgctgcttggtattgaagctgatagtggtggcatattgggtgctacagccagtgtgtgtcagactctgacagcagcctacactgtggctgtggaagatgtagttgatctgtcgtctccttctcctcctcttcggaagctctccaagtcccaaaagaagatgatggccgaggatgtcaatgtggctggtatgaacatgaacaagatggagtcagaaagtagttttagcacgcaatcaagtactagtgatgttgacaaccagctgattgatctgtcttcacccctggctggtggtgataatggtatgaaaggtggaagaagagccctggcagacataagcaatgttggttcacacagcactgagacagacggaggaggaggaggtggtggtggtgtggcatcggtcggccatggaaccaccatcgacctatcttctccgtcgccggccataggcgacagatcaagggttcatcacgatgatgatgatgtaatacacgagaggaaagcaagggacctgagaatgttcctggacagcatacggaacgagctgtattgagtgattatttatgaatgtttggctggcgttttttgagatgatagtgaaatggaattggaattacaaatccgtttgagatgagacgatgcgttccctgagcgcgcaggccctgaggtagagaagggcgtgggcgagcatcccgcagaggaagccgagcgcggcgctggagcccaccagcgacaccgccgtgcacagcagcatcacgaacgcctccgccctcgtggacatgtccctcgccgccgccgcgagctccactccggcgaacagcagcagcgcgccgagaagaccgacggggaactggacgaggacacgcagcatggagccgcccagcagcaggcccagcgccagcttcagcacgcccagcgccgccacgcacccgccgctcctccccccgaacttgtactgccccgccagccctcccgcgccgtggcagcacggcatggcgccgaaccagcaccccaccaggttcatggctcccatcgtcaccgacaccgacgtcggcgactccttccgctccgggaacaggtcgcgcgtcagcttgcacaccgccaccaccgagttgagcaccgacagcgggatctgcggcagcgcgcccttgatgaacccttgcttccacgcctcccgagagatgtgcaccacccgcatccgcgacggcccagcgcgcagctccctcaccgccgctgggtgacgcgccaccgcgaacgcaacgcccaccacgaacaccaccacagccgaaggaacggaacccaaccgacgacgccaccactgttgctgctgctgctgctgctgacgctgctcctgctcttctccggccccgttgacgagcacgatgaagcagaccgccgcgatggcgagcacgaggccgtcgaggcccacccaggggcgccgcccgagggacttgcccttgcccaagtcctgctcgtagcgtatgtacttgacggcggccatggcgaagttgaggccctgggcgagctggatgccacgcacgacggagagcgggacgaagcggtagacgaggtccatgaggcgggtgaggccgaggaagaggacgaaggcggcggtgaggatgccggcggccatgatctccgggatggcgaaggaggggtcggcgagggcggcggcggcgatggacttcatgggctggacgggcatggggacgccgtagaggaggccggtgatggcgttgtagatgccggtgaagacgagggtggtgccgaggtccagctgccgggacagcgccagcgacagcacgatggggatgtacgtcccgaggtcgcccatggcgccgttcacctcgccccacaccgaccggaacctcaggttttccaccgcccgccgcgccaacccttccttcatccgcccatctccacctccatctccaccgccgcccaccgcctccggatctactaccacgcccacgccggccatcaccgctgctcgtctcttctcttctctgctcgccgcgcaggatttataggatcctacctgtctctagtatttgtcactgatgatgtatttctgccatggtcaactaatacagtataacttctcgtcaactacaccctccaaacacaagtatgtcctcctaaattccgtgaaaatgccgttaacaaatttattattagaaaaactctcataactgttacatttatggaactactatttccaatttatgggaaatgatttaaacggtgaaaaagagtttatatatgtatcataaagaatatttttttccttaaactcgttcgtccatccatcccatgccctcgtactctcaaaatgtagatagaagatcttagaacttgtttagggcatgtttgagtagcttctggcagctacagtttaatttctagctactagaaccttctttaaacagtatagatttttatttagattctgagaatatgtagatgtgaaatttagcaaatgaattagaggttttccggcttctccaaattaaactcttccaaacagctcctaagcgtgttatttcgatctcagtttaccatgattccagcgagatcctatgtggcagcgcggcgctgatgtgtcatgtcaagtcgtggttggagatggagggcacgaggatgtgcatgccgaggagctgatcgtggccggagtccaaggagggattggccccagcggcaacagtggaaactggaaaggaggataatctagattatcctgtccagccggataaaatgtcaaacgtactcctgtgtagtagtgtctacgtaatttagagtagcagtattgtagtgtcccattcatgcaaccaagggacgaatgaacagaccggcctcattctctcaggtaaaatcttaagtactctacataaaatattgtctttagtacttcctccgtttataaatatttgacaccattgacttttaagcacatatttgatcgttcgacttattcaaaaaattttgtgaaatatgtaaaactatatgtataaatataattatatttaataatgaatcaaatgataggaaaaaaactaataattacttaagttttttaataagacaaacggtcaaacatatttaaaaaagttaacagcgtcaaatatttacatatataaatatggaacagcattgtccctttcctttcagtttggctgcaacggcatgcaccgagatttatccaggtcattgtcaatatattcctctcttcacatctcgaaatcctaacatatacagacgacatgatggtaagcaagcagctgtttgctcgctgacttttgatgccaaattcccctatcaattcatagctgagaattgcttctttctataacatattaatgttatcttccgatacaactagatcaacgtgatagagattatctgataccgacggacagcaccttcaaagtaagaagatagggcctgtttggcacagctccagctccagctctacccctcctggagctggagctcagccaaccagtgtcatctgcactaaaactgggagtggagttgggtggagctctctcacaaaatgaactaagttgtggagctgggtttaagcagctccactactccactccaaacctaactcttggagctaaatttacgaatatatgctgaaacagactagcacattgtgacctgatgaaagcattaacataccagctgacccaaggtgaaaacgtcacatattccttgattattaatttaaaataaccaacagaactaatgcaaagattaggagggggacacattcgatgccaaaagaca

SEQ ID NO: 82168 - DNA, 524 bp, Oryza sativa
ctgcgtggattttttgagcgctcgtaccttttcgcatgctaacatctttacatctcacctatgataattcgttcatcttttttcgtaagcgaacctcttatggctccgactgtaaaattcgaccaagcgggactaaatcatgggggcctttggctatttttgtaagcagtaaccagagggtatttttttactccatatagaaataaaagcctggtattggtaataaccatttttctagtagtggaagctgttgctcactgttgctgtctaggcccgccgatgctgctgaatcagtgtggcactctggctgggtagtggagggaaagtatgcagctttctagctgtggttgacaatgatggtgccatgacgcctgggagtgggagggagcggacgaggagagtccaagggactggatttaaccatagctggttgggctggccgtttttttagtgtctcctgaattgtatagccgtctttggtaaaagaactgcgtgtgaaaatacggttattttctttggtaaaa

SEQ ID NO: 82169 - DNA, 798 bp, Oryza sativa
ccaacctagcgagcttatagtaacttactagtacacagttgtcactctcatcaaagagacggatcatcgatgtgcggcacattctacggttcatgttatgggaattaattagatttcacccacagctgtcacacaagatagataattgttgaacaccgcacaagaaataccagatttttagcgatctagacgtccactattttcttcatcatactccaggagttaattctttctggacaaaacagaaaatatgccatatcggtcgatttgacatgatcaggtcttcaaggtggcagacaatgtgaatatgcatccaaccaacacggcaatcagtagaactacaaacgccattagaatgctgaaactgctgccatgcgtcttcctcgagccattctgtccagagttcatctctttcagaccaggctctgaaggcgcttttgacaaagctccagggaccacatcccaaaacgatcctagcgtcgcagccgatgcactttctggttctacgatcgaatagtttcccatatctgcttcaagcgacatcacttccttgcagcgctccatggcatcctgcacatgtcacacataagggtgtcaagcagccaaaccaaaccttatcatttattctagccgatcatggatatgttagacaaactaacataccacaaaccaaccagcgaacaacatatagaatactacttcctccatcccataatataagggattatgtaatttttggtaaaaattaaggaagtagtgaaatgacgtgatagtacaaaaggtgagggctgcaggaat

SEQ ID NO: 82170 - DNA, 671 bp, Oryza sativa
aaacccaaaacaaggagcaacacagttaaaaagaaaggatctaactaaaagaaaaaaaacggctgaagcttcatttacccttttttttctacgtccctttttggtatagcatgtttcatattattaacatatgtattagtaagaaatggcttcagttctccaaactatgatagaaatattaattttgtacttgctagtagttgttaccgtataatagccggataagaccaggcacaattttaacatacaacaatggatactacttaggacaacaaatcaacagctatgcatttagtgggggtgtcctacagacatgtgattatagccttaccattctgtccatttggagaagtgtattcaggctgccttcatttacaggtactggcaagggaggcatctgacccatgataccaggcgtctcactcattctacaacatttttttttataaacaaattagctaacttagacagggagcgatgaaatatgacggtaaaatgttccggcttgatcatgcttacttctgcatctcactgcattaatatacgaaaatactatgcgttcgatgttagatacgattttaaatttttaatacgatcaaacaccacgctgtccacgtggagcggtggaaccaaattttctattggaccagaacttgcagccattaataacg

SEQ ID NO: 82171 - DNA, 870 bp, Oryza sativa
cctgactagcagataagggagctcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgttgatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcaggagaatttgtctaacacttgtctcttttacagcctcctcttcttcgttcttgtcctgtacaacaatcatcgagtgaccaaactccatcgcccgtagagagccatcatattgaagaagaagaacaaccaactgcttctgctatcacagtaagtttccttttgacacaagaatttagatcggccatgtctatttagctctaactccctttaaataattattgcaggtcttagccaatcttttctcttttgacataagggactatcttg

SEQ ID NO: 82172 - DNA, 17374 bp, Oryza sativa
gggacaatatttgcaacagcaggcaaaaattgctacaattcaccaccattcatttatttcatgaatatatcaactaataaattttgtcctactcttggtgtctggtaacttcaataatagtataatttagaagtcactgcaataataatacaatcaatttgttagttaatataatatattattcctgtctcaaaatatagtaacttttagctatatatgtttctaatcatgctttttttgtctagatacattgataaaacttgttatattttgggatggagggagtagtacattcattttgtcagtttatttctctacctgttcatgtctaattgatattgaaggggaaattccatccgcatttactgcttgggttgaaattttctgctgcatatatattggattggcaagtcattcagataattatatgcactccattcaattgctcccggtattcattcaaatccgcatgtggtttagtcaaatgtactgtggatttgaatgccatgtttagtagtagtaccgattaccgaagatgcacagatgtgctggaaaacagtaccaaaaaaaactgtaatgatctgaggaattatccttcgtgagctgtacgtgtacgttataatgttttttttttaaatttctgtaagattcaggatgttgtccccttgctaatttgttttatttttgtagtactagtgtggaagtgctctgaaaaccataaagaagacaaaaaagaatactccagcctgcctgaaactgctttgtacatcagaggcgaagggttggattatttattaatcgtacgtgacataaagtttgtgattatattatactaattgggagtgcagcatggcattggcaggttcagccaggtgagaaaggaaaggaatctgcatgcattgcactagcagcagcatacaagtgcagtactggaagcagagcacccagctgatatatatcatgcatgtaattaagcaagttcatgtgaaaattgaagtttgcttaattttgcagggcaggttgagggacatgacagatggatatattttatataggcagattaatgtgtgtgcatcaatcttagtatattcttgttacagaggagttagttgtggagtcgattaattgagctggactggatcggagcctcttttgtgttgtctttgtctccaagtgattaattagttgtagcaagtatgtgcacacttgcacatactccatatgtgtactggactggagtcagtcacctatcctttattattccattttggacttaagcggcagactaacacttccacacaaattaaacacaagcatgtgaagatcgatcgatataattaatccatcgagtcattgcatgcatatatattgattggatttaatatgcacacaggggtagggcacaaatctcattcaattcatctatgaaaatttaaccatatttgagaaggcataagaaggtaacatattttttatataaatttaaaatctctaggcactagatatatcaagatatcaatagtgtaaatttaggtatcttgagatatatttttttaagaaccataaaattttaccatttacctatctttaatctgatcaaattactttgtagtactagcaggatcgaggatgggcggcctgtcctaagagtaggtacaatagcagactattaaccagctacaaatatattttaatgagataaaagatgagagagaagagcagtgggctacaggtctgtagccagttgtagcacggactctaagacgcaacatgtgtatgacaggtgggaccatatactaatagtatagtaagcaactattgtataaattggctattagattggctatagatgaattgaagctagtagttggctatactattaaccttgctctaagtgcactactctagtgcttaattagttgtacacaatcccttcaaaaaaaataaaagttgtacatagatataccagggaacaaatcctatgcacataaatttctcgtgtacatcaactaacaaatgttacgaaaagttcttaaaataatagatatttatttctaatagtattacacatatatgcaaagtcttatattaaaattcattatattttaggctaaaaaaagagaaaaatctgacagttttaagggtaaatatctgtcagaattttgttacggctaaaatataatgaatttgaaaataagatttcacacatagatataatactattggaagcatgcgtctaattttttaagaattttctatgacatttgctagttggtgtgtataggatatgtccccgacacatcatatgtctatagtgtgcttagttaaatatatatgcatatatatggtagtgcactcctactacctgcacatatatgtgcctaaaatcctctttctctctctagctacatcgatcggtctcacacgagctaacttattagcttctcatgaactccggacggtccatctgaattctatcttgtctgatcccatccatatcaatacattagctagccatggtgaataggaagaagaagaagaccaagcttggtatcacctctcttctcttcagcagcagcagcagcagcggcagggacacatccactactactagtggcttgccgtattcgtattcgtcgtgctccaatatgtcgtcgtcgtcgtcggcggcggcggcggcgtggcaatggccatcctgcaagcagccgaggacactctccttcaggcagcagcagcagacgatgatgaagaccatgaactccgcttacttatccgcgggcttctccttcgcctctcgagacagccacagctccacctgcagctgctgcaggagcaggacggcgtccgacgcctcggcctccgccgacgccgtcacccgcgcgctgcgctccgaccgcctcttttttgaccctgacgcgtccccggccgccgccgccgacctcaagctcaacaaggccaaggccaataagacgaagaagaaggtggaggcgttcggcggggcgacggcgatgaccatcgagtcgtcgaacccgtaccgcgacttccgggagtcgatggaggcgatggtgactagcggcggcggcggcggcggcgctgatgactggcggtggctggaggaaatgctggggtggtacctccgggccaacgtcaagagcacacacggcctcatcgttggcgccttcctcgatttgctcgtctctgctgccgcctcgccagctgcttcttcttcttcctcctctccggcggccaaaggcaaatattcctcttgctgcagcgcctgttcctcttcctccatcaagctggaagaagaacatcagctacgacattactaatatataattgatccacacatctacggtaattaatgttcgtttaattaatcaattcaatggattaattatatattggagcgtgcattttattaactactccagtggtagtacatcatatactagtatattcgaatttcatacatccacagtttcccctctcaatttgtgaataggcggagtcgatcgccatcaccatatgtacgtgtgatattttaatttgtcagtcaccgatctctccctatgacatgctcacttcgtactaaaataaataaattataagatgaaatgtgatacatcttaattattactacgatatgtccagattggtaaatcagaatatcacatttcatactaagtttatttattctataatgaagggagtatatacatgtgcgcatcaatcgatggcatatgcatatctctctatctactatgtgacgcactacatagtttttcatagagaaaatatataatgcaaaactctatagatactacaaatctttttttttgcggggatagatactacaaatctgaaactactgtaggataaaatatgaatgtctgatatttatccatatctcaatgagtggtatagtagtgtttaggccctgtttagatagatgggactaaaacttttaattccctatcacatcggatgtttggatactaattataaatattaaacatagactattaataaaacccatccataatcttagactaatttgcgagacgaatctattgagcctaattaatccatgattagcctatgtgatgttacagtaaacattctctaattatggattaattatgcttaaaaattttgtctcgaattagcttttatttatataattagttttgtaagtagtctatatttaatactctaaattagtgtctaaagacagggactaaagttaagttcctgatccaaacaccaccttagtgagcgcccagcacagctagcctagataggccaggcgtgctgccttgctatgttgatttatatatcgattgagatctactggaacaatgatgcatgagatgagatcgataattgtatatactggggcgagcagctagcttgtgatcattggacataagacggtcgatcagacatcattaattacagtatatcaatgttgtatatttcagcagtgccgttggacgactgatctcatccagaaatatggcatcgatagccactcggcctgtcctttttgcgctcagaagcttgagacggcgaagcacatcctactcgactgcgtgttcgctcgtcaggtctggttacgggtgctgtcgcctcctggctggattgccctctctcccctcagtggcagctggcttcaagactggtggccatcttctaggtcatgtttacctaatcacctccgtgccagtttcgactccctggtccttctggtctcttggcaggaacacaactccagagtttttgactctgcgctttcttcggtctcagtgattctagagtccatcctttcagagggccgttgtggtcgttagtgggcgttgcttactttggatacttgttaggagtgttgcgtggctttgccccctcccgctgtttgaagtagcgttatccgttgtacgagtttttctttttcttccttggtttttgtctttattttcttccttccttggcataagccggtctggctgattgtgttgtgtaacaaaaactctattcttttaatttattgacgtacaatctttttactcgttcgtgaaaaaaaaacagtatatcaatgatcgatataccggggaaggtcattttgtcccataaatggttgtacaatagggtgtatttgacaggagtaaagtagaagacggagaaaatatatgattaattaagtattaattattttaaacttaaaaatattaatataaaattttgaaagcaacttttcttttattaagaaaatatcatttagcggctcaaaaaacatgtgagcgacagagggtattttctcttagtccactactaacgcgaaggcaaccttgttctttctagctatgtgatgtaattaaatggctatacaaaattctaaaaaatattaataacatagatatgtaattgtgtgagatatcattacacaacatacaggtttaaatataacatatacaagtctattatatatactattataaaaattgaagatgtttccacggtccgtcatccgtgtttgagtcggttttaattttatgttttggttttaatctatatctcttctctatctctattattataaaaattaaagatgaagatgtttttgccggtattttggttcatcatccgtgtatgagttggtttttaagttcgtttgcttttggaaatacatatccgtctttgagttggtttgtaagatcgttcacttttggtaatacagaaggaatcatataagaaatctgtttaaaaaaactcgcatgctaacttgagacgttggactcctaactgcagctcatgattttctaaaaatatatatatgtaagcgaactccgacaaagaatttcatcttaactaatgtaacgctccgcttttcgtgagtcgttaaaaactaactcggtaaaatcctaattgcgaaaattttcgttctttgtgtgagagtctaagttgtgccaaggatcccaatttaatcccgttgttccctctcatcgaaatcaaaatcctccacctcgaaaattcctcttccgattcaagtctctggaatcaaattccgaaagtcaatcccttcccttgaatcctccccaaataattgttcccattcccgaaagtatcaaactcccactttgtttccttactcgtctccttgaacccttgtgtacaagtatcaaaatttagatccaaatcccaattccggaagtcactctctcccttccttgaactcgttgccaaatctttctcccgatttcgagagaatcgtttctcatccaaatcatttccttgactccaccttatattcccgagaacaaatacccaagtattccttttgtatcttttccatgacttctccttgagtttcccttgatacatccctaaaccctcgagttcgaatatcaaatttgaattcgaatccaaaccctaaatctctccaattctatccaaatcagttttctctgtgaaagtctagtttgcctcccccaagttctatgggccgaacgcccctccccagcccatttcctccctctgccgtcctcctccctcctctcgcacgtgcgatgcatccgcgtgagccgagcagagagagagttctctcgctctctcgtcctcttcctctctctcgctgtttctctctctctcgttcgatctccctctcctcggcgccgatttcccgccgccgccgttcgaaatccggccgcacccccgcgtcgcgcgcgcgctcgctcgcgaggtggccgaccggccgaacgccgccgccatcagtcctcgcgccgccgacgccacgtgcgaccgccttgcccccgctccatgacaaaccgaccgccgccatcatcgccgacgtcatccatggcccccccgccaccccacgccgcacccgtccaagagtgggagaagcagctgctctccctctcctcctcctcctcactctccctctcctcattatggcaagggaccaagccccttttttacccttcttttccctttcccgaccactgccggtgtcactgcctctacgccgcttgaccgaccgcgccaactcgctctccttgaccgcgccagcccgcgctcccgcggtttgatttccgccgcttgatccaccgccttcgccgtccaacgcatccacgccgtcgccgttttcgcactgcccacgaaaccgccgctgccacccgtgaacaccagccgagctcccttgaccatcgaactcctttccaaacaattgtcccaactccgaaaatatgtggtttccttcggatccctctcaaataatcccttgaaccgccaaatacaaatctatcccgaaaatatcaatttctcaccttgatctcccttccctggttccttcatatttagctgagttcaaacatgcaatttgaattcgaatttcaattcaaatccaagccccaaacctcccaactcaaattctctgtataagtctatttagcctccccatgttttggatgggccggatttcctcccctcggcccaccttccccgctgctcctcccctcgcgtgctcgcgcgtgcgccatggccgagagagagagagagctctctctgttccttctattctctctctctctctcttattctctctctctctcgtcgagctcccccaccggtgccgatttccggccgccgctgttcgaaattcggccgtgccagctgctccgcgcgcgcgcgccgtggtggccgaccgcctggtcgccgctgccgtcagcgcccgcgccgcccgtgccctgtcaccgcccgaccccgctgctctgtgcgctcgcgtccaaagacgcggaggcagcgcctctctctcccacgcgctccatcctccctctcctcgtccaaaatcgacaaggagctgagctcctttcccctccccctttttctgcttttccccctctcagctagcgtcacatcctctgcctcccgtgaccgtctgtcgccacttgaccgcgaggccgccagccgagctccccttgaccgccctcattggttccttcccctcgaagccccatctccacctataaaacccgcactcccctccctcgttcggctcctagcctctccaccatcgcaccgtttctcaggccaagaacgctcgcccaacgccgcggcctcctccgtcgctggtgttcccttcctcgccgccttgcgtcgccgctcggccaacgcggtgctgcctgccgtgaacaccatcctccagacccagcgccgccctccccgaagcccggccgttttccttcgccggcttcccgtttgctcgccatcgacgccgttcatcgccatcggtgagctcttcacctaatcctcctcgttgtcaccctcctggatcactgtagaacactcccgaaccgccgctttgatcgccggacccctctccctccccggcggcgttccgcccttccccacaccgcgcctcgccgtcgccggcctctctcagagtctctccgccccatccgaccccgagaacaatttcccagagtcctagagatgctcccgccaccacgaattgaccccattctctcccggcgtgttttcccccttttgctcgccgccggtggccgccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtctttctcctctcgccggcccgcgtggctgccacgtaggcgccacgtcggtgccaactcggctagaccgagtcaaaccggccagcctggctagccccctccgtgcgcacggaccacggtgcgccatgcggctgcacgtgggcccgtcgcgcctcggtccacccggcgcaccaatcgtgagccgcatccacccgaaaccctaaacgccgcccgcgtgctcccatccctccgtgaaccgtgtcgccgacatgcgggccccacccgggacctcgcatggtgggttcggtccacccggaccgccccctctcccttccgcgcgcccctaatgggccgcctccttgcgcccgcgccggcccaatggcttggccgagcctccttcaacccattgggccgcgcctcacgctcggcctaaaagtccatatttcctccctccgtccaagtcagtgtccatctctcatgagctaaaagtccatatctgctccctcccaatttactcctctctcaccttttgtaggccccacatgtcaatgagtaattaaagaatattccaagaatattcttttccacgaattcaataaaccatctctcgtattccagaaaaattcgacaaatcatttccttgtccagaaaattcagataaacttccaatattcatatctctcgatccgtagctccgatcgactccgttccacttccagtatttctataaaattgagatctatttaatggcactattaattagtctaaataggatccttcttttggtcttttgtttaggttttctattgtttgcgtatagttacggttgcggattttcgtcgatcgtggttatctcgaagattcgtgaagctccgtgaaggccttgagcaaggcaagtcaccctttgatcaattgcccctataattgaaaagtcattattattttgtttgcaacttgcatgattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaatgacgagaagcttgctcacttaccgatcaaggtggttggagttgatttgtgaatgcctaaaatggcctatacttacgtgaggatttgatccttctatgtggcatgaggtaaccctgggtcggcttgggaaaggctttgtcgcgaacctctgacaccgaccagtgtctggagtaagttcgtgtcttgtgggtaaagtgtacccctctgcagaggttaactaactgttcgaacagccgtgcccacggtcatgggcagatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggcttcccgagtggaagcggattgttatgctgctgggcagctggactctgggagtctgagaaaatgaaagaagctctgggagccgattaatcaagtggaatggctctgggagccgagaagtaatgatctgacccgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaaattcccgtgacttgctgagtacgaaagtactcacccttgctctatataaatatatatatatatatatatatatatatatatatatatatatatatatatatatatatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtccgtgtcatcggttgtattctcgggctgtctgagctgcaacctaagttaaggtaaataagtcctctatttattttaaagattgctatgattcatatttgtcaccgtgggtaccagcactatgtcctaggactggtaccgagatcgcggttttgtaggaagcggttcgcgccgttttccctacgacacgctcctatcaggtgccgttgtacggcggtatcagattggggtgtgacaactaaaccataaaacaataataaaattaaaatagacttcacccgttgcaacgcacgggcattttttctagttgagacaaaaataacaaatctgactatgaataatagtgcttgtactactaattagggtgtaatctagtagtattttattactcatgttgtggatcaaatttgaaaatgacttttttggtggatgtagacgagtatcagttaatgttgtcattcagatttttcttataactatttgagtagtatttaagatttacagagaaacgagtactggacatacagttaggggagaaaaggaaaaagcagttccaatcgatgtcaaagtaactaggtgtcagccaaagtaactaattaacaatgaacaagtaagtatgtagggttaactatactgaactgaaaataaatgccatatatatatagttgcatggaatggaagatgaatatatatatatatatatatatatatatatatatatatatatatatatatatatatagagagagagagagagagagagagagagagagagagatctctaaagagagatgagtaataattggatcagtaggagatgtggcaggtggtggggtggaagtggtggggattatgattattagtggtggtggtggcgttggaaggagaagggtggaggcggagcctgagggggcagtcgagcttgatgttggggccgggcagcctgataatggcggacggcgtgagcttgatctcggtcttggcggccatggtgacgtggatggagtagatgccctcggtgtcctcgcggcggaaggcggcggcggcgaggccgcccaagagctggtggcggccttggaaggagggggtgatgcgggtggtgttggtggaggcgggctgggagaagtcagggaggagggcgtgggcgaagcgctggtcgtggtagtaggcgtcggcggcgatggagtggtagcggagggcgaggcgggcgttgtgcctcgtcaggtccacccccaccgacaggttgtagctcagcgtccactccttgagcgccagcgagaaggtggacagctccgcccccgccgccgtcgcgtgcaggaggtttggccggaacatgaggtacaccaccatcgccaccacaagcacgcaccccatccccgccaccacgcagctcgccacgccgcacaccgccgaccgccggcaggggtagcaaacctcgccgcccgctcccattctacctcgatcgcatcgaccagatgactggaattggatgcgagacgaggggagtaaggcgctgcatgcttatgcccctctttgcatgcgttgaactggcaacgtacccactgcaacctgcaagataaggcctaaccagcctagcctgcccagccacatcatggcccacttacttccagccacggcccaactggaaatgggccgcatcaaacagtttaacaaacaagagaaagttctccttgatcacatccctcaactaggggtcgagttttatctatatattatattgacggtgatttttgactgacatggtgccctcgtggcacattgatattatcatcatcctacgtggcgtctaggtggtgcatacatagccccaacttatgaaagtccctgatatggacccacacataagtctacgagaaaaatatagtgaggtccgcatatcatctccccctctctctacacttttatattcctcttgatgtcttggttgtccaccgccaccgggcaccaagggcagtacaaggaggtgctcccttcaagcctcacctatcccctcccccctccctctgagctggcagccacaacgccaatgccgagggatgttaccagggcaagattctccgacaacacagcctattcggttgcaaagaaccctgccaccacacgaatcccctaaccttgtgagggccacaaggaaggagcaacaagggccacaaactggcactccaccagctcccattggaacacctaatgtctctaccatcgggatgagatcggtggcgggtttaggtggcattgctacctactcccaacatggtgggatgggactgggctcgcaagtggcagccgggggagggggcatctctgcatgatgatagcgggctagaggacgtcagtctcgcatcgtcgctgaccggctcagccctcctcgtgcttcccctctcattcccttggctctgtcgagatccttcgtagcctcacacggtcgatgcgagtgcaatgcgcgaggaacaccgatagtagctagggagagagagggggtggaaggggaaggagataagagtgaggatgacacctggtccaactgcacttttttattttttaactagatacccactgacatgtgggtcccacatatatgttttatttttaacaggattcccacttacatgtgtgtcccattgttttttcctctagtgacacataagcatcatgtaggcacctcgtgggacgaaaacccaattgaataagcatcccacgtcagccaaaaagctcttggtaccgcagaggaatttgattttcatttattttggatatagggaatgcttaatacccgattttatggttgatatatagatgtacattactactctacctctatttgagtgacttaaagtgaacattttttagcaaacaactagtagggcctagctaccgctcctttctctcctttctctctcacgaaaccatggcatggcaagttggcaactcctcctatttctaggctgcggtggcgccgcagctaccaccgtcgtccatggaatgccggccactctcaccctaaagcctgcgacctcgactatcgcctgcgatggaatgggaccctcccttttaatttgagcagccaaaggtaattaatacttcttctatttgttctttaatatatgacattgttgatttttagatatatttgatcattcattttattaaaaagttattgaattattattttttttattatgatttgatttatcattaaatatttttttaaggatgacttatattttttatatttatataaaatttttaaataagataaatgactaaaagtttatcaaaaagtcaacggcgacatatattaaaaacagatttagtaataatcagccctggtttctgtttctcccctaaaatccatctccatctactatttgaagaaattaacagggtagctgatggtatgtgtacggtgctaaacctccaaatcggatattactactccagttggtagtgcaatgtcatgtcgaattgatgatattttccttttaagtttgcttctctatcactctatctgcacccagcccaactactttgcttggatcttaattacacagtccgtcaaacccaaaatttactagtcaaaactcaaaacagatatgatctttcaaaaatcaaattacgagtaacaagctagggccaaaacaaagtacacccagtaaaccttcaaagaaaaaagaaaacccaccagtattgtgccttaaacaaaatccaaggaattgaattctgtgaaacacaggggtattaattattaatcttgacatatccatgaatttgtattccggcagttacatattctcgtatgttcatcctggtggcaattgtattattgcgtatcacatattcacattagtttataaattggtgtcaaaattttaaaacttattttaaggttgattttaaagtttattttgatcgtagtttatttttcggcatcgacttttaaatcgtgagtaacacacaactataaaaaaaatttacctacaatattttttacttctgttccattttcatctaagcagctgtaggctaaacgatcggaccaagccaactttgctaaggtctccttcgaaacatatgaatttttcataagaaacatttcaatttttctaaattttttatgaaattcctccaatccaaaataggcctaggaccggccggctgtgaggatcaaatagtgcaggcaaagaagataagattgatgcaacaagccacatatatacatgtagagatatgtatatgggtgtaggtgtttgccccacttagtttggacaaatgcacgcaagagtccagaaatgtcatcatgcaactataaggacatctcaactcccaaccatctccttttcttttcttgttcttttttcctgacaatcaatttatttgctacttctccactcaactggacatatagatcgatctttctagctagtgatgagtactgatactagcatgtcaacaaattaaaggagctaggtaaggtacctggtgaccaatcctttgacaactcgttaattagtgagtattaattaacaatggcaggtaattttcatctgtaatacctttttgtcaataaattaatgttccgggctggcgttggacaactgctgtagtttcctaaaataaataaataaataaataaataaataaataaataaataaataaatatatatatatatatatatatatatatatatatatatatatatatatatatataagctagacggacgtttcatgtatcaattgtaatatgcctagcattatttctgctactagcttgtttaatttattgattaatagctagaaataaattgaaggtgaagacgaacactctttgttgaaaaatgaacagaacattaattgattacaatgttgcaactatgtagtatgcatgtgaagataagtacaattattatatattctagtagtaattacaagattgtagcaattgcttaattatcccctctctatatgcgaattattactacaagtagctgtacacctgaaccatgcagctagccacaagcatggcactgtacgtagtaccaaaaaaaacacaggcatgaaaattaagtaagaaaaaggtcaaattaattcgtactgtaaatacataaaaccactggtggcaggcatatatgcaagattactccgatcctcactcgatcagttgagctgagcttttaattatatagcttcttcatcagggctgtgcttgtagaatgtagatcgatcaattaagcaagcaattatatatggaaggaggagaattaattaaggatgatatgatttgttggatgcatgagaggaggatgaggagatggatggatggatcagacgtcgacgacgcaggcggcggctcgctggaacctgaagtagccgttgccgccgccggagttggagccgtagcttccccggccgtcgttgacgatgagcagggcggggcacctgacgcggaggtggtagtgtccggtgatgaaggcgccggccttgtagcggatccagccgtcgacgcggatggtgacgagcaggtagccggcggtctcgtcctgggtgatggagacggcgaggtagggcgggagctggacgttgttgccggagaggaaaggggaccagacggtgaggtccgggtggccctggtacaccggcggcagcgacgtcggcacggtgatgcggaggcccttgtactcggcgtacacgtcggcgcggtcgtagtagatgcccacgcgctcgttgccgttgcgggcggcgagggtggtctgcatggtgacggtgaggaaggagaagtagccggaggaggcggtggcgccggcgtaggaaccaccggtggtgacgttgaggcagacgacggtgaggtcgttgaggtagaagcgaggcttggtggggcggaggatgagccagacgatgaggacgatgaggaggaggaggagaaggatgccgaagatggccgcgcagcaacgccggtacaggcgctgccgctcgcaatccttgtgttgctcgcagtgcttgatcgacattatatatctatattcttgctagctagctagtactatttctctaaatttcttgtgtaattcttcccaactctctctcaatctgctacaacttgttgcttcaattccttgtagctagcaactaactgggactaataatcgatcttactaataattgaggggtatggtaggaaaggaataattgagaggtatggtaggaaaggaagggctgcaggaat

SEQ ID NO: 82173 - DNA, 678 bp, Oryza sativa
  unsure (1)..(678): unsure at all n locations
catctttccaaccgcgagctctcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgcncgccgccctgtccgcgcctgacgggccgccggcgtgccgtgccgtgccgtgccgcgggccgtgccgtgccggcccgctacagtagccgtgccgtgccgtgccggcccgcgggctcggccaccggcccaagcacggcacggctactcgtgccgtgccggcacggcccgttactgtagcaggccgtgccgggccgtgcctgctacaggttcgcccgtgctccgggccgcccgtttggcccggcccattttgccacctctatgcatgggtcactatcgctgaaccattgcatgcgctggtcggtatcaccgtcaccaccttcttttgcttctaatcccgccat

SEQ ID NO: 82174 - DNA, 623 bp, Oryza sativa
ctgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatctcggtacccacacaagagacgagtgttttacaactcccttaattgctatttgaagttgctcgtagaattcctttctaactgtttgtctgtgaatatattaaaagggaaaattggtatgggagaaaatttgaattggaagacacgcgtaagagttgcacttgaagctgcacaaggtattctataatagcaaggcaaaaaaaacaaagcaaaagtgttatggctcatcttttcttctaactatagtttccttatttgtaggcctggattatctccataagggttgcaacttgccaataattcatggggatatgaagacgaacaacattctgttgggtcaaaattttaaagcaaaaatagcagattttggaactcatatttcagccgttgcagctggatctatgggttatattgactctgagtatgaatct
